United States Patent 8,781,750 (CELL-TYPE-SPECIFIC PATTERNS OF GENE EXPRESSION) - sequence listing, part 13

SEQ ID NO: 36314 - DNA, 1048668 bp, Homo sapiens
gcctcccgccgcctcccgcgcggccatggactgagcgccgccggccaggccgcggggatggggccgccgctcccgctgctgctgctgctactgctgctgctgccgccacgcgtcctgcctgccgccccttcgtccgtcccccgcggccggcagctcccggggcgtctgggtgagtggggggcgccgggggaggggcgcctcaatgaattagttgggggcgttgtgagaggggcgcctccgtgagggggtctgggtggggagaggcgccaccctgaggggtcggggggagaggcgcctctgtgaggggttcgggggggaggggcggcgcctcagtgagggggttgcggggaggggcgcctctgagtgagggggcatgcagggaaggcgcctcaataaatgagtgggggcgttgggggaggggcgcctctgagaggttctgggggagggacgcctcaatgaatgagaggggggcgtggggggaggggcgcctcaatgaatgcggggcgtgggggaaggggcgcctcaatgaatgagtggggggtttaggggaggggcgtctcggtgagtgacggggcgggtggggaggggtgcctcagtgagtgagtggggagcgcgccttggcgagcgggtcgggggctccgggggtctcggggttccagcgcgacacccccaggctctgggtctcaagcccccggccacgggtcgcgcgcctctctgtcctcactgggggctcggagcaggtctcgcgcccctgcctcagtttcctccccggcgccgcctcctgcctctaccccggctcctgggcctcacgccccgagccccgccactcggcactcccctggccctggagcgcgcggccctggtccggcgtgggtgcgccccccgctcgtgttccgccgcgtgtgccgcgaggggccgggcctcggatgtcccgctgcacccgcttctacctgcgtcccccgcacccccccgcgggcagcgccgccgaaatcagaggacatttttcctccgtggcagccgcgggaggaaagggagggcggcagcttcacggcagcgagggagtggaagccgctgctttcccaggcggacgcccctgttttaaacccataaaacctccagtccccggcacctcctttcctgctaatcttgtttattaagaagatttaccataaagccaatgtttccaggcggcttcggggccagaattacacatgacaggttaggataatcggtgtccacggggtgcagaagcaaacgcaggcggggatggaggggggtccttcgccgttgcccagcgccgcctgcacccacctcagtgcagctgggctccggcaccttcctctcggcctctaggcccttctggtctccagtagtgctttatcgtcaaaatcccaaacaaacaaaaactgcagagaaccaggagtcttgacacagtctccctggactcctgagttgacgctcccctccctcaagccagagtcccctgaattcctcccttgccttgaggtttcctcacactccctaacctgcttgtctctgttagaaggaacacaggcgctgggaaaggaggtccttgctcacctgccttggagtcctgggagggagtgtctgtgctggtcccgcacctctgggatgtagcccagtcactgtgcccccagggcccaggtgaagccctcacccttccatgctggagcacgggggagtcctgcatgggaggcttgggggccttgctcactctgcctcctcctggtgccttgccccctatcaggaaagaaggcccagctgtgcaccagtggcctcttgctggggttgtattccttcctccagctggcttgacctggccagtcaccttatgggagagttgtttgctctgaggccaggtgccgcccttcacctacacatgaagcacacatgggcgtggagtgtcccagggaaggtaggtcattatggtgtgagctggaggctggtccttgactgctttccttgccattgcaatggctagttcacagcattcttccaaaatcacagagaaagtcagaaaggtggggggtagctgagagaggcagcaaaggaaaacccaaagatggaagtgcatgaagagaggaaagctgctaaactgaatgataatgcccaatgcagcagtgttattttggctaccagcaaagttgactcatataattaaaactggtgccatgtttccctcggctctgatcacggtgtcactggtaacagaaggctgtgtcataaagagacttatggacacacttattttgtgggaaaacattaaggatgcagacatcgttgaaattgtttcgaggactccaggtgaaaggcatcacctacattctcaggtaattggaaactgccccagtggtatagacaaagagtgagatgtatatgtggtcttcccattgcaggagccaccttggggcagaatgtggccatgtgtcagctacctatgtcccctccaccttgtaccatcctcactcagtgttgctgccattttgtcagaacacaatccacggagaatgcaaggagaagctttcttacctgtgccgggcaggtgctgctatttttctttctctcctgtctggatcttgtttggcaatggtcacgccaactacattgttccaaataatgaggctcgattaaagatgcacagagcggccttaaatccggcccagctgtgccatttgtaatctatttatttatttacctattaacattcaacttcacgttgaggcctccagaacacatgtggttcaaggagatccaagtttttgctcctctgttacgtcaaacagccttgtaggttagaactagaggttgatgttaacaagacctaaagaccaattctttttatataggatgccttgtcttgagcaaggggcctttctcatgttgacagtgaaggagctcttgatgaaacccagggtcgataactgctgtctctgagtttattctcgtggccttgagccgcactccacgatgctgacttatttccagaacagctgttggcagcaccctgtggtagtggaagtctcactgcttcctctcttttcccctgatttatttagtttcctgccctcccatcacccactctgcctgttcctttctggtcggaagggctcccttatggcattaattaattatctgtgagaccattatcgaagctgaacacaggggaacatggcatcctttctagtgacacgattcagctttgcttgtagccaaaataacattgctgtgttatgcagggctgttcagacagcctgatggtcttttcttcatatgcttcagtctttgagttttcctcccgaccggcccgcctttctctgtgatttcagggcatcctttgtgcaggtctcagtgctttttccttaagtttaacttgaacataagccctttgttaagggctttacgctgttcttcacttacatggaggctgacttgtgaacctgctcaggtggcccctatgtttaggggggcagttttataaaggcccccccttccttttgctaaagaagcacaactttcacttgccaatgatagagtcagcctttcatgcagattttgcttcgagaatccagattcagaaccagtgggtgcacctggctgtgaagacaggagattgttcattttgctcctttgttttggccttccgatttgcctacacagacttttcattcaccagggagcccacacagagccgagaggcagagccatcggagcaggactctgctggctttgtgaaggagatggcgtgattgtttatttttaaatcaaaggatccttactgccacaaaagcacaaatctatctttacttcttggggtccagagcctctgattccgtttggttggatggtaatgagcaacctgtcccttcccccaagaagagcctgctccttgcacatctgtgagcttctctgcctgttgttccctgtctctcctgctcggtctccatcagcctaagggctgatgttctgggcagaaggaatggggtgtgttgtaaccctaggcttctggaagaaggaggtgccagacaatgggttcactcatgaagctagattcaggaagcaggatgtagggtgtcaggctcagaagggatgggcagggaatggaagagcttttaaaatgacttcttctcagtgctgagcttagctgtgtgttagcgtctggcagctcttcttccaagctgatttgtttttgtacctggtgatcaaggtcagtggtgcctgccagggaggggaggtgggggtgggcaatcactttgtcatagtcctctctctgctttactccgagatggtgttgggccccatcatggtgcacagcgggaatctctgtgtgctatgaaacatgtcagcatgttgggtctccagcttcctgtgaagaatagggctatcgacacagggtacacgggacaaaggttagctggtgtgatgtgcagtccaaggctcaacatcccaaggccccatcttctgatgaactctgtggtaacactgatcattttatgtgacaataatttctgcattctgggtttgttttgtcctagtgttcatgcgggattacctaatttttggatgcagttactcatcgacttttctttagattttgaaagtgaggaatatgggactaggaaggggagtgaagcctcaaggagacataggggttcagctaagctgtcatcagacatggtctcattaagaaagttccactcaatgcaactggctttgcgggtgagccatgactactgcctcttggagggttaccttagaatttcaaattcctcatgaaaaagtgtttgcagccaaacatcacccaaactaataatagctccctggcattgggtgacagatatctaagatatgcctggatatgtgtaaatattactagtttaaggattctttttttttttttttttttttttttgagatggagtctcgctttgtcacccaggctggagtacaatggcgcaatcatggctcattgcagcctcgagctcctgggctcaagcaatccacccatcttagccttctgaatagctgggactacaggcacatgcctctgcaccaggctaatttaaaaaagttttgtcttagtttgggttcatgagtaaatataataactaaaaaatgaacaaaaaatattaaaaatgaatttttttttttttgagagaggacggtcttgctatgttgcccaggctggtcttgaactcctggcctcaagtgatcctcctgccttggcctctcaaagtgctgggattacgtgcatagccactgtgcccgaccaggtttaaggattctttgtgcgtggagcggtgaagaaaaagcttaataaatggcagaaagggttttcatccagccgaatcccaagagacgaaggccagatgagcctcggctgagaacctctcttatctttcctgacatgatgttccacttctcagagaaagcaaacagctaaattcatggcagataaccctccacaccacataaaagcacctggcagctctttccacattagtttaagttgaccttcataaatgtagacccagctggacttattttttaatcttagttgatagaaggccagaaaacctgagaagcagaaaacagttaatccacttttctgctgcttggaaacagtgtggaaacagtgtgttgaaggaagggcatttttttcttttaattcctgttatctctaagaactctgccacagccactatttaaatacctagaacaggaagtaaaaatgggtgaggctcccttggaaacacctgcttctgcacattttaaataccttttttgtttgtcactctacatcacgaggctggtaagtgggtggcttttgcaggcagctggaaaactggacctcggactaccgagctgcatttgtcttgaacggcttctgtgtgtgtaacacaaagaaacgagagatgatgagtgtttggtgacagttactcagtgttaactctcatctctggaagtggtaagagggcatttcacttcctttgtttttgtctgttccctctaatagtcctaactgggattcagaaaaccaagggcattccctgggtagtgccaggactaggactgtgtcttgtgagggtgattcaaggccatggcaggtgacaggggatgaactaatagttacaaaaccgattctggagctttctttttaaaatttaattttaaattatcataaagtaaaatggacttttcttttttggtgtactgtgttacatatagattcaggtggccacctcctctgtcagtgtacggatcattccatcacccccaaaacttcccagtgtgctcccttcacagtgacagcctctcccatccctgtacctctgggtacccccaaatcttgaacccctgagccttccatgttcactgacatgtattccccagaataacccgcataggtatttctatcttcaatttacagatagaaagactgagtcttggagtggttaaggaatgtaccacaggacacctggtgggtagtcctgggatggggtcctaggtctctggagcctcctttctctcccagtggtcatcccaggatgggccgaggattctacacgctgtcagaacatgtctctctggttgcacagaacaaggacgtctgtctcgttcttacaggagtggggaccatttcacttgtcaaactgcctttctcttagaagcttctcaacctcaggccacggagattttaaagtgctctttggcaccagcaggggattgattttctgagttgggttttgttttgggtgtcagattcaaatatttggtgtgccttctgagggaattttgatgtttggaaatgggcgacttatttttggagacttttgtccttcccataatggcagggaatgaaaatgccacccttaggattcactactcgatgtgtccataaaaattttatgttccgaatgctttctgggcttccgtcaggtttttaaaaacgtggtgacacaaacaccaaagaagtgagctctcatctcagacttgtcataacaaaaacccacttcagaataagggatgagagagggattactttcctaagaacatttatttaagagtaggttctgtttaggtttgatgtttagagtggcaagcaggcagggggttggttcagggactccctactcttttctgaactatgctggtggaaggaaagtgtagaattttctatcatgtgatgtgggtgctccgtcaccacgtggttctgaaaggtcattttgaaaaggcttctgatgcagtgttctgtatacagcacaaagggcatgtttagaaatggtttgtttggcggaaggaattttcagaaggaaggctgacctggtttctgaaaggaaaggacttcatattaatcatgcaagtgaattctggttccaaatgtgaaatacattcaacttgtaaatggatggagccgctaataaaattggcagtcagaggctgtgattttaatccagctcaaagcagcagttaatctgtggtacaatttgaggctgaccccacaatgtgtacattctctgaaatagccgctcttctagaggactcaactgtgcacaccagcgcaagctccatttcttagccggaggcaggggatggaacataggtaaagcagtggcaggagctgctgtctgatgacttcccacctcaagtccattttgtccctcacatctcttttactaagagttcttgaatctctttctctgcttttcctgaaaacaggccaaggttgagaccactggacttccatctgatttgagtgttctgcactgagatacagctgtggttagagctgctgtgggaagcacagccatcagttcctatggagcggcacccattcttgtggtagaagacttgcggcatccatgtgcctgctttgttatgctgttatggtccttgattctatgaaatagccaacatgaaattatgatcagttaaggtaacagaaatggggctttttcactgaaatagaaagaggattctagcagagtcagaaactgctggtgatttctgcaaatatggtagggaatagggaatatgtggctgtttcaagagcacaaattaaatgacagtactgcttccatgcagcgtgttgacagattgagaggtcaccttatctttccaatcagataatctttacagtttgcacttgcactcatattagaagtcaagagaaatggaaagacttcacctataatctctctggatttacaccttgagcaaaatacctggttcttcatgtttttgagaggattacctgagatgggtgggagagtccttggtaaccacagagtttctgataagtcatagtggttgttatttttggatgctccaggtttctacagttaatgttggaggtggtggctgacaggatggaatattgttattgttagaaacaatattactttagaaaatccaagtctcagatgaactgacaatagagattattgcaaaagcattgccattaccttttaaagagtaatatcatttatatttcttaataggcatatccaaacaggttacatcaataaggatgaggcctggttttgttgtgatgatgagagtaactgatggtgacagccctttggagtttatttcacatcatccctttgatgactgtaaagcccttgaataaaagaagtgggacttggccaggcgcagtggctcacgcctgtaatcccagcacttcgggaggctgaggtgggcagatcatctgaggtcaggagttcgagaccagcctggccaacatggtgaaaccccgtctctactaaaaatataaaaattagctggttgtagtggcaggtgcctgtaatcccagctacttggggggctgaggcaggagaatcacttgaacctggaagatggaggatgcagtgaaatgagattgtgccagtgcactgcagcctgggcaacagagggagactctgtctcaacaacaacaacaacaaaaaaaaaaagagaagaagtaggacttaagggaacaatagacactgggaatgcctaaagaagggagggaggaaggagccaagggtcaaaaaactacttatcaagtactgtgttcctcgtttgggtgacaggatcatcataaacccaacagtcggcatcactcaatacacccacgtaacaaacctgcgtatacatgtactctttgaatctatgattttttttttttttacagagacagggtctggctctgtagcccagactggagtgcagtggcatagtcatagttcactgcagccctgaactcctgggctcaagtgtttctccccactcagcctcctgagtagctgatactacaggtatgtgccaccatgcctggcttgaactcctggactcaagtgatcctccttccttgtcctcccaaactgctgagattataggcatgagccaccatgcctggcctctggaatctcaaaaaaaaaaaaaggtgacttaaataatattcatacaaatttcttacaagtttgagtagaaagtataataaaaagagatagtacatacactttttttagatatgctaaacactttcttttaaaatgttttattatgtaatatttgataaatgcaaaattcagagcacgttttttagtatacttggcatgtctaggttgcactgtttttaagtgcctgaattttggtcttgtcaacgagcttgccgggtgggtgttgttccctttgctcttctgaagcgaggtgagtgtctggctggcttgctttgccctctggcctgcagggtaagggtgggcagtcttgctgtgcccatcttcctggcctgtggggatggcaaggggagagggaggtggccgggcagtgcagggtctgtgttagggcccagtgcactattcagagtttgcacagggccctttcccttactccatccacttaggattgtgtcagagtccaaggggagacctgtgggccctggatgggccctgtccctgtcatcacatcccatacttggggatcggtggctctggtggaccccattcctgtggtcacatcctatcctttatctgtctgttttatcaggttacaacagtcttcctcttagaggaaatgaagacaaggtgagtgctcactttgctgtttgggctttcttaggagcccacagtgttgtgcaggccccatgctgtctgtggcattcgggagggctgggagccctcagtgttgtgcaggccccatgctgtttgtggcatcaggcagggtggggagccctcagtgttgtgcaggccccatgctgtctgtggcatcaggcagggtgggcagccctcagtgttgtgtaggccccatgttgtctgtggcatcaggcagggtggggagccctcagtgttgtgcaggccccatgctgtctgtggcatcaggcagggtgggcagccctcagtgttgtgcaggccccatgctgtctgtggcatcaggcagggtggggagccctcagtgttgtgcaggccccatgctgtctgtggcattcaggagggctgggagccctcagtgttgtgcaggccccatgctgtctgtggcatcaggcagggtggggagccctcagtgttgtgcaggccccatgctgtctgtggcattcaggagggctgggagccctcagtgttgtgtaggccccatgctgtctgtggcatcaggcagggtgggcagccctcagtgttgtgtaggccccatgctgtttgtggcatcaggcagggtggggagccctcagtgttgtgcaggccccatgctgtctgtggcatcaggcagggtgcgcagccctcagtgttgtgtaggccccatgttgtttgtggcatcaggcagggtggggagccctcagtgttgtgcaggccccatgctgtctgtggcatcaggcagggtgggcagccctcagtgttgtgtaggccccatgttgtttgtggcatcaggcagggtggggagccctcagtgttgtgtaggccccatgctgtttgtggtgtttgggagctctcagtgttgtgcaggccccatggtgtttgtggcatcgggcaggactgggagccagatgccctgtgcatttccatcttgctccagaacctctgtcttgaccactggctgtcagccatggctccccatgctgtgcttctgtgggacctttgtggtgtgttcctgttccttatgttcactcagatcagcagcatgttactccccggaggcctctgcgggagaggcaggcagaggtgctggtgggaggctccttagcagcccccatgtccctggtggtgcaggctgtgggccccggggcttgtcccgagagggcccctcatgttttcagccctttttctggctcacacttgtgcctggaatgtgcttaaaaaaggctttgaggcagagttgtgtggaatagagaaactgtgacgtcagaagcagaactttacagagatgttcgttcttgcaaaacgagtgtggtctgaaaacggcttcttctgcatgagcctgacagggttgctgtgcaggcagcccgggctggcagtgcctggctgtgagtgacttggtgtgtttgcagacacacagctctgtctgagtgaccacaccaggggacacacctcacccaggcctgggagttcctgcttgctgcttatttggggtaagaggcaggctcttccagcggggaaagtattgacagcatatggaatggggatgttgcaaactcagagaacattttttaaatgagtttttcattgctgtgagcttaacaagaaggaagcattttgatcacttgaaaaaggaaatgttttcaagtggaaaatatttttaaaaataaagattagattcttggtttagttttctataaaacaatctacttatttttaaatttttattataatttctagtaatactgaaattattattggttataactattttgtctctttgggaagtaagatgtagttctcaagagatgtgttgatttagtgcccttctgagaaaataaaaacatgcaactgtgtgaaaaatttggatacttatgtagttatgcctcttgtatcctccacaggttctgaggggttgaaatatagatgtaaaacctggccgggcacattggctcatgcctgtaatccaagcactttgggaggctgaggtgggaggactgattgaggccaagagtttgagaccagcctgggcaacacagtgagactctatctctacaaaaaatgtaaaaaattagctgggcctggtggcacacacctgtggtctcacttatttggaaggctgagacaggaggatcacttgagcccaggagtttgaggctacagtgagcagtgataaaaagtaaaacccatcttatggggctagccaactacattattgacaatatcagtcaatagcaaatgttaaaaagtgacgtgtttggtttattggtacttttaaataatatataacatttgtttaatgatttaatatttttcatagcactctgaaagaacgtcagatattcagggtaagtcaagcactatgaaaaaaaagaatgtcccagattgttacaggtgatttcacataagataacatgtttgacaaagattgtagataaaataagtacgaactccaaaatcaaagcctcattttgaaagattctaccatgtgtgggtatattgttagcatgttccaaatgttgaaatagttcttctagactattaaaagatgctactttcctgtgtaaaataaatgacaaaagggaagaaaaatatgtcctttgaagaaaggatggaagtctgttttaatttgcagcctgaaggagaagagggtgagtagtctggtggtggccagttctgccgtgtaaatcagtggctctcacctctgctgctgggactaggtggatggcggacagggacgttgttcgacatcctgcagtaggcaggacactccacggagccacccacccagtgtgccagcaaggcctgtccagcagcctgatgcatgtggaggaagctgccgggcatgcagtcctcacatgtagcagaggaagaatttggcctaaattatggcagaacaaactttaaaagaaagaaagaagtattggccccttccatgccaccttccagttctggctagagtaactgccacaactgaaaatctgatcctatcactcttctgccagagctgccccacatctaaccttaggaaggaagcccaagccctggacagggctcttgggccctcactggcaggaggcttctgcctcatcccccttgtggcccctcctctcagtgtctcagtgtctgatggcgccaccaacagaaatgtgcatttatttaccggatacatattcttatttacaagttatatatgtgctctactgaactcattgtatgtttataataaaaaattcaaaacaaatttaagagaatgagaaattaaacatcactaatgattaaaatattttgctgaagatacaaaaacttctttgtattcactaaaatttttattaatgtgattaataacattttagatacttagtttttaagtgtctaatctggagagcttcaatctatggttatttgctgtctcgatgcacaatatatgctgagaacagtgctcatcactactgaaaatatgcataaatctataattgagaaagtccgaacgatgatttttaatctttctggttgccttcttgtgggtctaactgtgatgctttccacttcaaaatgtgtctaaagaagagctcccattggaagtacagattttcttgtatttgtcttattaacaatccacgattcctttctaagaatcttttcaaatctctggattacgtatagttaaaatgggtcacctaatccataaatctcttcacaggcccatggaaattgcagcatagtttgagaatgacacaagggggcccactcttctggcaccagatcccaagaggccatttgctgtggggtctcgtggggctccagcattagcccatatatcaagcttaatttttaggacatctaagagtgggcatatgtcaatatatatgttcagtaatttttgctgaataaatgaatacatcaattacagactctcagagctggaaaagagtctctggtccagtttcatcgattcataagtaacttccacataaggacattcagacccaggcatggggagtgacttgctgttgaccttcctggacagagacccgagctcttggttggttgattttcaaggaaagaaccccagagacatgaagctgtggtgagcactggcagtcagaaaggagaagtggtcactcctccagaccgcttctagctctgctactctaggattggattgaagacccctatgctgactctttatttttaaaattgataccaacgaatgacttttcacaagtaacataatctttttctgaaaattgtttgactttatttaaaaatctattctggcctcctcagcacccaaagttgatgttttctgcatttctaggaagcagattccctttcccatcccccctccatttctctgaacatcttgaattgtttagctgggtatagtgttagtgacatacaaagaaatgttgatgatcagatgaggcatctgtaccagaggatgatcattaattcccattaagtatttttataaaagtaaaatgagggaagaaatacattactgtgtgcctcagaagactcttgtccattcatcatgcatcatgctaattactcttttaaatttagattcttagtctaagaacatttcaaaatgaattaacaactattcctcagcttagaaaatgtcatggagtgagatttatttatttagttggaataaaatgtaaatcattcagaaagtataaactcatacttgcaagcttactatactggcaaaatcagtgggctgataatatgtactatagtctcatctttatttagaaactgctgttcctatatcagcttaataattttttactgaagaacaaagtgtaaagcaatttaagtggcaaagatctctgagtgctgtgtccagtagtggtggactaagggagtcaatgaccctggcaccaaaaacagatctggacaaaatgtatgaaataatgaaggatcacagtgatgagtcagagggcagagacccaggagaagggtagggatgtggcacttagggtcagtgttttccagaggtgtcagccggtcctgatcaggagcctcggagagctgttgggcagaggtccctggtatgcctcagagactcgagttaggacccagcaggctgcacccagaaagggttcagcagacagctgtcttcgtaggcacagagctggctcagtgccctggtgggtcagggctgtcagggctgctggaatcctcagccgctagatggggcaaagtggatcttctctggaggaggtagcataactagagccttaagttaaccccacagttgttcacatcactacccagtaccaaacaaaacaacattttgaggggaattcatatgtttatccttttcaggttcctctatctcactgtgaacgaagaggatcagttttccacccaactagacagccagacagagaaacctcttttcagaacattgtactgaatacctactatgtgctagtcattggacttgcaaacacgagcaagacagagtccctgccctccagaaccttccctgctttccagaagctcctgaaccttttctgccttctagaaccttccctgcctttcagaaccttctgtgcttccagaagctcactagcacctttctctttccagtgcattcctagtgcttatcttatagtagaatttcatgaggttaattcacttaataactctagagaattttccatgttgtatatactgttcttggctcgggaagttcttattcatctccacgtgtgataagactttggtgaataaatgcaccattttattccgtggatatttatttagttgtgtttcctaatttttgccaagaaatggaaacagcagcaatgaaattggtttttatttttttggatccttaagaaataggtgctttttgaagaatcaggggagaagtaacgcaagaccccagaagtatgccaacatataaaaccccaagtcaaaaggtcaaaccacgcatttgatccctcaagtcccctgcttgaccctcttccaagtgtactttccttcctttcattcctgctctaaagctttttaatactttcactcctgctcaaaagaaaaaaaaaaaaaaaaaaaaagaaataggtgtgtgtttttttttgtttttttttgtttttgttttttttgagttggagtctcactctattacccaggctggagtgcagtggtgcaatctcagctcactgcaacctctgcctcccatgttcaagtgattctcctgcctcagcgtcccaagtagctgggattacaggcgcccactaccatgcttggctaatttttgtattttttaagtagagatggggtttcatcagactggtctcaaactcctgacctcaggtgatccacccacctcggcctcccaaagtgctgggattacaggcgtgagccactgtgcctggccagaaataggtgcttttcatgaagtgtgccaacacacggcataattaaaaaaaaataagcaaaaacaaaaacaaaaaatattccaagccttgccacagggcttggaaataaaatgaaataaaatcaaatgaaataaaacagaatggattaaaacctgaagagggactaggtggagtgtccggtgcggctcctgccagtgcgtcagccatggcggcggctgctgggaaggctcctgcgtatggctttgccatccgggacccgggctttgctctgcaggggtgggcttctgagcagaggaaggccagaggtaaccaggtccatgcacgtttgtgtctttccacaatgtcgggcttttatggatgcttttagtctcagtcacaaaagccatgagctccacagggttcctgaggaggcggttctccttggtgcttcccggtgagtccgtggtcggagacgggggctcacaggctcaagcttctccgcgggctctcggcgttgcaaaccgtacccagccgcgtgctgagccggtatacacgtgttacggcggagacacgccgcagcaagccgggtgacacttcacatcaaggagactgtgtgggagagcgggctagcaggccactcggggggcacggaggacacagggagaggcttcagtggcagagccggccgggggatcgggacccaccacggggagacgcgtcagttgaggggtcggagctgccgaagccgctttctcacggtgcagagtccgtctgtgaggatggatggtgggagagggtgctggagggcgctcggttctgtcctcatctggttggacgcagcctttattatgtattaatttatttattcagcaaaacaccttgtcccggttggcagagcgcggtggagtgtggggtggaggcctctgagggcgtcccttataccccggcgcgctgctcagggcgaggaccgagggcccatggccaaggagcggcctccagaaggacacggagcccggaaacgcgggctgtggctgcgcgctccccgcctggctgcccaggtcggcctgcaggggttggagacggctccgcggagagcctggggcccgatctcagcccggcgcggcggcttctcggggcttccccctgcctgggggaaacgggtggaggacgcgcctgagggaacgcgagggaggaaaggcctggcggccttggcgcgtgggctctgggctcccccgtctgcgagcggcacccgctggccagggcgcggggctgagggaggccgggagggcgccgccccgcgctcctgtcaggcggcctcgcgccccgagttcctgtcaggcggcctcgcgccccgcgttcctgtcagtcaggcggcctcgcgccccgcgttcctgtcagtcaggcggcctcgcgccccgcgttcctgtcagtcaggcggcctcgcgccccgcgttcctgtcagtcaggcggcctcgcgccccgcgttcctgtcagtcaggcggcctcgcgccccgcgttcctgtcaggcggcctcgcgccccgcgttcctgtcagttaggcggcctcgcgccccgcgttcttgttgggcagccttgtgccccgcgctcctgtcagtggcgccctcgaggccgctgggagctgctgcctccgtgtcccctcttcctggtgaggggcccagcaggaccctgagagcaggaccctgagagccggacccctcggccccacagcctggcgtgcgcgagctcctagccttcctccgctgtgacgtcccggggagggtgtcagggagtctcgtccgcccaagcgggcgcatctgggtctggccctcgtcctgtgaggcccacgtgatctttttcgaggtcgctcagtggtgattgagttctgggaattaagtccaaactccctggtttacaacccaaagccggtgcgttcgctcagggacacggggcctccctgggccaggagcctccagggcacggccagcgccagtcaacccgtggaaacgctgcattcctattgtcagatgtattccccttaaaatacctaaattcctgagatttcacatacatacatgtacagttagttatatgtgttttgaaacacattcttgctctgtcgcccaggctggagtgcagccaaatagtcacagctcactgtagcctcccatgccttgggctccagtgattctcctgtctcagcctccccaggagcggggaccacaggcctaatccctcacacctgcttaatttttgtattttttgtagagatggggtctcactatgttgaccagactgtcctcaaactcctgggctaaagtgttcctcccaccttagcctcctgaagtgttgggattacaggtgtaatcctgtgcctggaggaatattttttaatgttagtaatttttaaaagaagtgtgataggaaagtttttttttttatttaaacatttttagttacacacataaagatttggcaactttacatgtaggttaccccagtttgttaaaaaagattattagtctgtgaaattaaaaagatagaaaaaaatagaaaccactattttaaagaatatttctgtaaagtgtgataggtgaaagctgtttgctccaggagtagttgtttagagtatttgttataaatctcagctttgtgtaatacaagtcagtcatatgatttaccccagtatttgaagaccctcttttcctgcagatttcctcagtagttcaaaaaaagaaaatctactctaaaagctgttttttttttttcttctccaaaccaaggtctccaaaaggaagcatgtgatgttcctaccgcctctgggagtgacatataaaagtttggcttcgctatattgtgtgtgagcttgggcggttcatctcctttctctgcatctcagtttccccattcttgaaatgaggaagttgagctagatactgtttgcaggtataaaatttaaaacattattattattattagacagagtctcactcttgcccaggctggagtgcagtggtgtgatcttggctcactgcaacctttgcctccagggctcaagcgattctcctgcctcagcctcccaagtagctggaactacaggcatgtaccaccacacccagctaatttttatatttttagtagatacgaggtttcaccatgttggccaggctggtctcgaacttgtgacctcaagtgatctgcctgcatcagcctcccaaagtgttgggattacagatgtgagccactgcacctgggcaaaagagtttttaataaaggaaagataagagtctcatcagcttctgactgtcgttagcacgttggtcatttctgtgtccaggccagacttggagttgggatggcccgtgccccatcttgcacacctgggcagcaaggaagggtgggatgaggtgagatgggggttcaccatttggttttctctgcccctcatcaggtgtgggggggtgcagcccccagtgttcactgggcttgatgttctctccccttgcagagtccctgaccatgctgtctctacccctttcggcacgatgcccgtaccccttcagtccgcttgctcctcgagggccatgtccccgcccaagacagctttcccctgtgtttccaatcagttaattaacttggctgttaattggggacctacttgtgttgtccagggcccagcctgggcgtagcacgtggcaggaacttaatgagtgggagccggaggtctgcatagagcctgctgagtctcagccttgacatttcacatcactgtaatgaaaagccttcctaaaaataatctctgcttgcatcatgtctaatagattctgtttggagagtggaaaatgcaatcgcaggcacggctggcctcgtcaggcctgtttgtcacagtgacagaatggccagttctccagcccagcaaacgctgggataaacaccataaatatgtgggaagtgcacacaggtgtgtgccaggcaggtggcccgtgagggcaatggggctttctctaatgtttgatcagtcccacattctagcctttgttaaggattggctatgttaatggggacttgtgaaaatgtagatacttaaattagaagcacagggagctgttctccttaccttcctccccttcagaaaaaatgaagaagaaaatgaaaaatcctttctcctttggagacttttatttatttattttttaaactttaacaatcttttggttgggcatggtggctcatgcctataatctcagcactttgggaggctgaggtgggtggatcacttgaggtcaggagtttgagaccagcctggccaatatggtgaaaccatctctactaaaaatacaaaaatttgcttggtgtggtagcggctccctataatcccagctacttgggacattgaggcaggagagttgcttgaactcaggaggtagaggttgcagtgagcagagattgtgccactgcactccagcctgggtgacagagtgagactctgtctcaaacaaacaaaacaaaacaaaacaaaaaaaaccccactttaacaatcttttattaccaaaccccgcgaagggtggccaacagcaaaaatagcatctctaacaagatccaggatggagacctttagaggagggaattcagaaattgagaaaggacttcagtttcaagtgtccagggctccctagtcctttaaatgcccagtcacctgcagagtaccttttgtgcggtgcttgtggcaggatgcctggcccggggctgccaagtgcccgctatggggcctgtttcccaaagcttgtcctcgggaggctacagtcagctcgatggctgagtctcttctggaattgctcaggagctaaagcttggccacttctttttttttttttgagacagttttgctcttgtcacccaggctggagtgcaatggtgcgatcttggctcactgcaatttcctcctcctgggttcaagcaattctcctgcctcagtctcctgagtgcctgggataacaggtgcccgccaccacgcccagttaattttttgtatttttagtaaagacagggcttcaccatgttggtgaggctggtcttgaactcctaacctcaggtgatccacccaccttggcctcccaaagtgctgggattataggtgttagccactgcgcccggccaagcttggccacttctgatgtcagtggataaaaagagtaattttattgattctcaaagttatcaaaattatccataatctcagggagagatttttaaagggagagaaatggctgacacaaaggaaaatataggtgtcctaaatatttagaggacagtgttgtgggcttagtgtcaggtgacctgtggaaagttcctaagaagctccatgcctcggtttcctcatcagaatatcctgcatctggcagagacaataggcagatctgtgtttggagatgtgggacagtctctagacgtgcgggtaactacgggaacagtgcctgcctccagggttcctggggggcttgcatgagatggtttctatgtcttgtgtgtagaaagtaagttggagtcatgaagtaacagagggcgactcctggacccttggcgtctaccgtgcctttgcttactttcttcctggggattttcccgtgctttgacagttgttgaagcctgcagatcccagacgggaagtttgccgtccgagttaagatttctcaccattgagctgaggccctgtttggaattctgagcaaagctgctattttggggacacgtccacctttgtgctcagcagaggtggtgtccagatggcctgtggcacctggggttgagatgaccagccacagcccagagctggctctgtctcacctctcaggatgagaggtaatttgcaaagttcctgggaatttgcaaagttcccggtaatttgcaaagttccctttggtgtggttgtatttaaaagctgcatatttagttccattctgataatctatgtttatgtagccacaaatatgcctgtatagattgcagctctaaaagtcaaatacggctggatcctgatactcagatctgatgtagcacggactgtgtcatgttcctgggaacctcatagttttatagagcagaagcctccatgccttgtttgtttcatccttgccttcctccacaatacaattttctgaatggtgtcagcatccctgggtccatgcatggctgggatgactttttagagtttgtgtaaagccgttacgtggggcagggcctgcgcagggtctccctcaggagaatgcaactctcattaaagagcaggcacacaccacagggaaggcacgagccttgcacatttctccttagatttgcacacatttctctttagctcccagcagggcgtctgtgacccttcattttcctggctgatatgggccacagagccatttcctgggctgagaagggatctgtggtctgccgtgctgagctgcccgccctctggccttaccactggcattctttgcctgtgctttaaataaacatgtgtgggtgaagctgccatgctgagggaaagggtctagatggagctggagggtgcagtggaaggtgaggagtcaagccaggtattcctggggcatgaagggtgggcagggggcttgggggctggggccagggcctggcatgcacccgtctcctggctccctggcaactgcctagccccgtgctgcttcgtgttggttccatgcttcaggagcactgggatggcagccgcacagctggccttgctggtgttggtgatgggggtggtgcctggcagcctcacgtcctggtgatggaggtgggagtcagctcagctgctcacaggtcgattggctgtatccatcacaaaatgtacaattctattacccccaaatcccacttctaggaattttccttacaaacttacttgcacacatgtgcaaagatgtttgcataagcgtgttcattgctgcctttttttttgtcataatactcatttgaaacaacttgatttttcataagcaagaggttagttaaatatatcatattcacaccacagaatatcctgcagctgttggaaagaatgaggtaggtctttgtgtggaggtacgggacagtccctagacctgtgattaacaagacgtatggcaacagttaactcagatccagagctggctgtgccccccgcaagtgctgccctagccctttctttgtatcatctttgtataattttgtttaatcatcccagcagccccctgatgcaggagctgtcatgatgtgtgtttcgtagacatcccaggcactgtggcatcagagcccaagttctaaccacttactggagaacaaatccaggtgtaaggaatgaccccaatcttagaaatatatgctatgcatagatcctataaacagaaaagaccattccctaaaaaataggcatctaatcaaagacctcacttgtttcttcacaatctgagggataaggggaagggagggagactgtgcccctagatggaaggcccctctcttctcccctcacacatcagtgctcatgtactgccacgccacatgcctgtgagtctctgcagagggtgtgccctgagctaacaaggatgttcagatgtccccggcgagagctgcaggattcttcatccaacactcccatcggggtgggctgggagcatctgaatgctgtgtgattagctccactaagtgtttgttgtaatcaagttgcatttccacggccttatatcttggtcatttttttagcttgcaccagctgggttttggcaccgcctcacccaaacttcatattatgagacatcacggccaacttgcaaactgctgcagtaataagacttgcattttgtgatgcttttgttctcactgacgtgccgtatctgcgttccacttgggtacttcttgctttgaacgagaagcacaaggctattggcgaagttgatgctggggatcggtcagcaatttcatattttccaagaagccattttaggaccctggacaaggtctcgagctgcaaacttgtggtcctgccttgggagaaggcacaaatttccctgtgaggtttcaggtaggacctctcttcttcggtggcactgcaccagcagataccttctttgtccgtgcaaggcttcgagaggctctatgtggacgaggctgtggccgtggttgatttctctgaaaccaggaggaccacaccctgccccctcaatgtaggttttcctgggccaggaaacatttgctgtgggaaacactccgctctcggcctctgccatgcactaatgctggaacggatggggacacattctggtctttaaagggcctgcactcagcatgatgaaggctttgttgtttagttaattcacattgtccatacatgggattgttgagctgtgtcccattctgttgaggtatgtgcccctgggagcgtcattgatcctgacgtggcaaggcttcacgtatgattcaggccagcggtcttccaagagctttgccttcacgccattatcactcaacacactctccttcaggctcccaagcaagcacacagggcttcatgcacaatcagccttgtggctttcaagtgctaaatggactattaataataggaaactttaacataacactgggtttgtttgtgggaggtggaatgggtgtcttaatgctgacaggccctgggtttcgctgcattgatttgcatttcctctgctgctgttgccgcagttgattccacgattatatttttcatgtaaagggcagatggaggagtaaggctatttgccctcttcctgttctggtctgggtgtttgtccccgcaagtgcatgtgttgaaacctagctcctgacatgctggtgttaggagatgggggctttgggaggtgacaaggtctcaaaggtggatgctcctgatgggattcgagctcatcagtcactaataaggcagctccagagagcttcctcgcccccttcatggagtgagaccatggcgagaaggcgtcatctatgatccaggaagcaggaccttgggatgccgagtctcctggtgccctgctctccgacttcacagccttcagagctgtgagaaatcaaggtctgttgtttccaggccacccgacctgtggcattctgttacagttccagctaagacatttcctgacagagagacttctcttggaggtcatgagatctcaaaagacatgtgttcattggcccctttgtgaatctcttcgcacgagagagaggcaggtctgcagctcagtgtctcagccctcagtgagcttcctctcagtgttcctcttcttggggaccacgcttgctgggctgcaatgcttcacccaaattgtggtgttccagggccacgggcagtggggatgggaggtagggagagctgctgctactgtggggggtggcacggtcccccctagtgagagtttggtcctggtgttggcccgggccatctcccctgtcggaagtgtcttgtcttgcacagggactgtgcacagacctgtgctatgcttttgagtcattcaggattgttaaatgtcaaagtgcattttctgaggtatgttagacccaatattctgcatttctgaccagccctggggaggccaaagctgccagtcttgaggccacaattagagcatcaaggtctgagtcagtgcagaagccaatgaattatcagaaaaagtttatacttgctttaaaataaaaaaaattgaaatatcacccaaaccttctggtgtgtaacaccatttggtcttttctttaaaaaattccttgtatttggtgagaaaacatgcagttgctcaaggtcacccatgtcctgcagaagcggcattttcctctttacagaaggagccccacacccccgaagagctgtcagggggattttctcaggcaggggtttatctcttagacctggggagacttctaaggcaacgggtgttacagaattgtaattttcaaaaataccttgaagtagtaatgagaattactggggttattacttctagaatcattggaaattctgacttcaaggaactatgagaattaagtaatctaatgtcccgatctacgtaatctttcttaatctttgatatttattgacttgatcaagtattcatcaagatcaagggtggaagacttcactaaaattagaaacagggctcccgattcccaggccctgcccttcttgccacactaacagaataaccctgtgcacattctgacatgtgaatgggccttattgacatgcatggactacaaaaatcagattaatcaaccgatgcccagtcacacgtgaaggaacaacatatggacaagatttctcttcgatgcaaggctgcgttgctttaggttttttaacctgtaccctgctgggaggatgcaggttaggacagctgccttcttttaaagctgttcaagatgcagtgttctagtcatgtgtttttggcaaaccaaatatctttggctctaacttaaggagtaacattcacatggttgatgtctgttctcaaagggcttcatgaaaagtgccgcccatgtgcccctgctcatggtgggtttctgctgaaggtgaggcgatggccacacctgccttgtgagactgcctggggacacagtgaggaaccgccacacggtcccagcacagtcctgcgcgcggagcgcaagtggtcaccgttcttacacgttgtgttctctgcatgttgacacttagtagggtctcaaagaatatcagttccactttcacctagcagtccagcaattcatgtaaaataagcaaaccccccatttgtcccctagcgaggccaaaacatttgcctattactctaagtgttcgtgcacatgatcagaaactatatgaggtaagcgttaaaacacgcccacttctgggtacatacatacctgaaaccatcagaagtagggacctggacagatattggcacatccatgctcatagcagcactattcacaataaccgaaggttagaagccacccaagtgtccactgacggatgagtggtaagcaagatgtggtccatccatccacacggtggacttattacccagtcttcagcgtgctacaccatgggtggcctttgaatacattatgctgagtgaaagaagccggtcctaaaaggacaaatgctgtttgatacgaggtggttagaatcatcaagttcacaggaacagaaagtggaacggagcaggggaaaggggagtcagtgtttaatcgggacagagtttcagtttgggaaggtgagaaaattctggggatctgttggagaacaatgtgcatagttaacactagtgaactgaagatttagaaatgattaagatggtacattttattctatttttaccacaataaaaaaatatgtaagtggggagacaacagctgggaggattttgttctttgacatcgcctcacctctcagatgaccttctttgctccaggccttccagggtccctgggaccaaggaccccagtcatgagggaggcagcctgtgtccattctttactgacatcacttctgtgagagggagtggcagggaaggggccaaaaggtgatgcaggggtgattgcagcctcagagggggccctgaaaagctggctgggtgaggtatccccgcggtcacctcctgtggtcacatctcagaaagaggaactgctcaggctgagtgaacagcctatctcctctgcaccctgcgatgggacagtcgttatttgcattgggaacgaatattcggtaagagggaggcaggtgaacaagtggatgtgcctcatggtggagtcctgccaggctgggtattggcctggaaagatggaagtgtgtcattctgagaaagaaaaagtcaggtatcaaaaaagtacatatggtatgacctcatatggatcgttaaaatattacagtgttgagaagtatgagtaggatgtggtgaatgcattttattttcttcttttttgcttctctttaagaaaacattgtgtaatgagagcaatagaaattcatttttatacaaaatatttttcttattattcctttttaaatggggtgatgaagaacaaagaaaacatgagagaagaatctcctccaagcactggaagaattcctgctgggggctccgggagaaccatcactttgtggcctctgctctgtcgggatctggggccaggcagggcctcactgggtctgggtttgagagtcttcctgggcctctggaccccccagtgtggcccctccctgctgcctgcagacctcggggatccagctcctcctcattggaaacatgacatacagtcataattaacccctggtcagacctggggaggtgttaagaggtgagaggtctctgtcttctgggcctcatctcttggtgtgcagtctgagagcctcctgtccagagaagctgagtggcaccccagaggaaggactccagattactgcttttttttttttttttttttttttagtctagcactgatgtatccagaaggtgcaaggacctgcctggcttggcgtgaatactgaggagaatcctgctcctctctgtgccaaattatggagactctttccctgctcacctttgggtccctcattgctgcacctgttttttcacaggctccatttgtgaggacacacctgcctctaggtgcctggaaatattggctggaggtaccctgcctccgctgggctctgcaggtgccaggccttcatgtccctgggaccaactggtagctgggcagtgttcactgctcagcaccccctggggcagcaccccagggacagtttacaaatggaaagctgcaccctgcggcctcaggatctaaagaagagaacatggccataggctagagacaatccaacaatacatttggagtctactaatttagtatttgtgtctggactgaagttacctgttatgtaagaattattttaaaagacctgggtgcagtggctcaggcctgtaatcccagcactttgggaggctgaggtgggaggattgcttgaggccaggagttcaagaccaggctgggcaacatagcaagaccccgtctctccagaacaatgaaaaatttagtggggtgtggtggctcttgcctgtggtctcagctccttgggaggctgaggcaggaggatcccccaagcccagaagttcaaggctgcagtgagtaatgatgataccactgcactccagcctgggcaacagagtgagaccctgtctctaaaaacaaaaatacaaagaattatttaaaagggggtctatgaagttaaccaatagctactgctgggaagatggcgaggtgccttaccaggagagctttatcaatagtgctgctgggaatgctgggaagagggcgaggtgcctcactaggagagtggaccacgggggtttccatgcacagtcagtgtgagggtcccaagtcacccttccttcctgaccacattggccagcccacttctaggcgccatggtgctctggaaacgctgttttctttgagcacaaacatcccaggttgctcactagaggaggagctttagaaatctcagtgggttctaaaggtgtgagcccagaaatacagctacatgatgagaaagcgtaggccaggaggggcctgttctcagctcttcagagagagaggtgaggaaacacacccgagcacagccagccacgggttgagcggagcggcggccgtgacctttgtggactggctggcttgtacctgcagggccaagaagcgactgagtggaccatggcaccaggttggggaatcagagcccatgatggcagaaaagatgtctaacctgcacgggagctgcctgacctgcgcgggagctgcctaaactgcgtgggagccgcctgacctgcgtgggagccgtctgacctgcgcgggagccgcctgccctgcgcgggagcgacctgcccaggagcgacctgcacaggagccgcctgacctgcgcgggagccacctgcctgggagtgacctgcacgggagccctctgacctgcgtgggagcgacctgcgtgggagccgcctgacctgcgcgggagccgcctgacctgcgtgggagccgcctgccctgcccgggagccgcctgccctgcgcgggagcgacctgcccaggagcgacctgcacaggagccgcctgacctgcgcgggagccacctgcctgggagtgacctgcgcgggagccctctgacctgcgtgggagcgacctgcgtgggagcgacctgcgtgggagccgcctgacctgtgcgggagccacctgacctgcgtgggagtgacctgcgcgggagccgcctgacctgcgtgggagcgacctgcacgggagccccctgaccttcacgggagccgcctgacctgcccgggagctgtctgacctgcgcgggagctgcctgacctgcgtgggagcgacctgcgcgggagccgcctgacctgcgtgggagcgacctgcgtgggagcaacctgctcgggagccgcctgacctgcccgggagccgcctgacctgcccgggagccgtctgacctgcgcgggagctgcagtgttctctgaggggaggagaccaggttttgttctgtctatcctctacctatctacctttgaatcatctccattcacctatcaaacatctatttatataacttatctttctaatctatctttttttttttttttgaaacagagttttgctctgtcgcccaggctggagtgcagtggtgtggtctcggctcactgcaacttccgcctcccagttcaagtgattctcctgcctcagcctcctgagtagctgggattacaggcatgcgccaccatgcccggctaatttttgtatttttagtagagacgtagtttcactatgttgcccagactggtcttgaactcttgacctcaggtgatctgcccgcctcggcctcccaaaatgctgggattacaggtgtaagccaccatgcccagcccatctaatctgtctttacgtatcaatcatctctatctatctatctaatctatctttacctgtcaatcgtctacctatccatcatctatatccacctatcaatcacccatctatatctatcctctatcattatctatcatcatctatcaatagaacatagtctttcacatctaacaatgtctatcagctatttatcaatcatctatatctgtcatctagtctatcctattaggtatctatctatctatctatgacaaccatctgttgatctagtaaagaaggacattccaaggctgttttgattttgtaggagaaagccatttggtgccaactctgtacctagtgaagatttattttgggacgtgtgttgtgtgtgccatgttgtgattattgttcacagattttgttctctgcgagctgggtcctcgaagataggatgtgtcttcatcatcctgagcttgctggagcctgtctctgtggtctgccccatgtagatggcctgctaggcagtgggtggaacccgctgggaagcaacaccggccacctgttggcggaagagctccctttacccttcagattcctgactctgttgccagcttctgtgaagggttgacgggcggtgcttgtgcccctaaccctgccatgggagctgagggaggctgggtctgggggacagctggaagatgccagttgagtggaaatatattcttctgccaagggcacaatgggagagaacgaaagggcagcaggactgcccctgtgttgggatgggacatggcagcatgggcctcttcctgctcctgccccaccccggtgacgtcagtgttgggaggtttcagcgaggaaggcagggcagagcggtgggggcgaggggcaccactgagccgtggatgctgcttgtgaagggagaaggacctgcttcgttcgacgctgggcttggtgccgccttctcctggaaggacctgactggcgccctaaggcataagccccaacctcccccaaaaggcagctgtgggatcttgcagtcgtaagagctgctgaagatggaaaacttgtgatttcctctggcggagttggtggttgcgtcgggggtgatttgcagtagatcagtctgctgagcaccggagatccgtttgttctcacaggctttcctctcattccactgtgacgctctttgtaatgtgcatctggtgtgtgactctgtatcaggcttgctgtgggcagcctcagaattcagggcccaggcaggcatctccggtgaggggagttggtagtcgaggaggggccggataaattaaacgtgtccccgggtcgtgggtgaggatgggctcagcctccctgggaggatgctggggaggtgaggcggctgtctgtgctgctggcaggagcgaaaaccccatcatatagagggggctgctgtttggggcagagatggctatgtgcggcattccagacacagcccatggaggggctgtgctcctgcgctggatcgggggagccacatcctatagtcccaggccactgcgtcttggaagggcctggccagcagcaggcatgggccgaagaaccccacatcccactccccctccaccaaaaaggggggccagagccgcgactagcagagttggtcttttttcagttttgttcaaatctcaaatattccttaaatcctctgtgcccagaacaagctgagagcaatcaagaactttaaaacccagtattcaaggctctaccctcagaaaataaataatgggagagagagagagagagaacacagataaagcaatatgagacagatgatagatggcagatagacagatactgatcaaaattcttacgcacttttcacctcccagagcaattaccctctttaccatactggtaaagaatcatcagtgccctaaacaaccaaccaattgtctcctggtttcaggaccaaggacagaaaacaaagttgcacaaggaccctctctggtttcggtctctgtttttcttgttgttgttgtttgagacggagtctcactctttcgcccaggctggagtgcagtggcgcgatctcagctcactacaactccgcctcccaggttcaagcaattctcatgcctcagcctcctgagtagctgggactacaggcacatgccaccacatccggctaattttttgtatttttagaagagatggggtatataaggaaggttctgtagactcccaagcctgtgtgtgtgtagacagggaaggcaatgtagactcccaaacctgtgcctttacacagcaaaattggtgtagacccccaagtctatgaggaaatgtggtatagactcccaagcctgtgtgtgtttagacagggagggtggtgtagactcctaagcctatgtgtgtacatggggaagttgtgtacactgggttaggagctggagccctccaaatgcatgtgttagagcccccccgatgcaatgtgttaggagctgggatcccccaaatgcaggaagggtggtgtagactcccaagcctgtgtatagacaggaagggtgttatagactcccaagtctgcatatttagacagggaaggtggcgtagactcccaggcctgtctgcgtgtagacaggaagggtgatatagactcctaagcctgtgcgtatttagacagggaaggtggtgtagactcctaagcctctgtgtgtagacaaggagggtggtataaattcccaagcctgtgcatgtgtagacagggaaggcgatgtagacccccaagcctgtgtctgtacacagttaaggtggtgtagacaggaaaggtggtgtagactcccaagcctgtgtgtgtgtgtagacaaggagggtggtctagactcccaagcctgtgtgtgtataaggggaggctggtgtagactcctaagcctgtgcatatacacagggaaggtcgtgtagactcccaagcctacaggtgtagacagggagtgtggtatagactcccaagcctttgtgtgcttagggagtgtggtgtagactcccaagcctgtgtatatgcatggggaatgtggtgtagactccaaagcctattcatgtataggggaaggtagtgtagactcccaagcctgtatgtgtgtagacaggaagggtggtatagactcccaagcctgtgtgtgtacatggggaaggtggtgtagactcccaagcatgtgtgtgtacgcaggaaggtagtgtagactcccaagtctgtggaaatatacagggaaggtagcctaggctcccaaacctgcaggtgtagacaggaagggtggtgtagactctcaagcctgtgtgtgtacatgggaaagatgatgtagattcccaagcctgtttgtgtagacagggaggctggtgcagactcctaagcctgagtgtgtagacacggaggatagtgtccactctctagggtttctctggggtgtcaggagcccttggatgcacatgtcaagtgcacaaaacgtgtggtctttactggttgttgtcagtgtatgtagacacttttttgattatgaaagtatcgggccatgcacggtgtctcacacctgtaatcccagaactttgggaggctgaggtgggcagattgcttgaggtcaggagtttgagaccagcctggccaacatggtgaaaccccatctctaccaataatagaaaaattagcagggcatggtggtgggtgcctgtaatcctagctcaggaggctgaggcagaaaaatcgcttgaaccagagaggaagagattgtagtgagctgagattgcatcagtgcactccagcctacactccagcccgcactccagcctaggctacagagtaagacctagtctctagagaaaaattattttttaaaaaacagtatgtattgccagaatgtatggtcacctttctcactgatcttctcaggctgacttaggagctggggccccccaaatgcatgtactggagccccaccccaatggggtgtggttaggaggcggtggcgggggctcaaatgcatgcattagagacccaccttgatgcaatgggttaggaggcagggccccccaaatgcatgcattagaaccctacccctgatgtgatgggttaggagctggggccccccaaatgcatgtgttagagccccaccctgatgcaatgggttaggagctggggccccccaaatgcatgtgttagagctctacccccgatgtaatgggttaggaggcagggccccccaaatgcatgcattagaaccccacccctgatgtgatgggttaggagctggggcccccaaatgcatgtgttagagccccactccagatgcaatgggttaggagctggggccccccaaatgcatgtgttagagccccaccctgatgcaatgggttaggagctggggccccccaaatgcatgtgttagagctctacccccgatgtaatgggttaggaggcagggccccccaaatgcatgcattagaaccccacccctgatgtgatgggttaggagctggggcccccaaatgcatgtgttagagccccactccagatgcaatgggttaggagctggggccccccaaatgcatgtgttagagccccaccctgatgcaatgggttaggagctggggccccccaaatgcatgtgttagagctctacccccaatgtaatggattaggaggcagggccccccaaatgcatgcattagaaccccacccctgatgtgatgggttaggagctggggcccccaaatgcatgtgttagagccccactccagatgcaatgggttaggagctggggccccccaaatgcatgtgttagagccccactccagatgcaatgggttaggcagggccccccaagtgcatgcatgagaaccccacccctgatgggatgggttaggagctggggcccccaaatgcatgtgttagagccccaccctgatgggatgggttaggaggcggggccttccagaggtgattagggttgggtgaggtcacgagagtggctctgaggcaagaccatgagacagcatcatgagggagccggctgccctcctccttcccaccatgggaggacacagcaaggcagtgaccatccgcagtgggaatagggccctcaccagagcccagctgtgccagcaccctgatcttggacctccagtctcagagctgtgcaaagcgagtgtcggttgttgcagctgccctgccctggtgttctgccacagcagctggtgcggatgcctccctccttctccaagggccccgtgctcacggtcgctgctggtggacaggcctccttgctgctgtgtcctgtcacaaatgccagttctggaaatgtgctgtgtgggtcactcatggatgggatgagggccagatgtccgtggaggggtgaaggaaagcgtgaagggaagcgcgacggccgcctgatggagttaaaaaagcttcacgacatctccccagtgttggatttcagcagcaggatttaaaaactgaaaagggcacttaaagacgaggtaattacacttagtaggaagtcaggtcccagcccattaacgacgcctatgagagaaatagattagacattgaaaagaaaacaaagccacctcaagtaaaggggaagtaaaatgaataaacgaagaggctgaaagaattcccagagatgcaaaagtcaaaccacctgggaggcgtctgggagcctttggctgagtcccggggagcctcgggcaggcctgtgttctcagtcattgcagttagactccgtgggtggccacgccagccatgagtgggcctgtgggcctgcaagcccctctccctgcccagacctcagccctgtcttaggggaggcacctgaactgggtgttaaagcactcaggcctagtgccctggggccgagtgcatggcttccaaaagtgaccagtgggggatgtgggagcgtcctgctgccctccatcttggattcccaagtttgttctttcccagtggcagcctcaggagatgtcctgaggggcaggctggtggggagccgggcagcatccgtgacccttcctgcgagcgccccaggcttcctatcgggacgtgggctcagccggcgggcagtggcacccgctggggctccgaggagctcgaggagtcaatctccaccccgacgcctggtgcgcagccctcagagcacaggctatctccgtctttcattttcagaacgaggctggggggctctgaggatgtgtgctctcgtgtgaaagccccatgaggtccttcctgacgccgacctctcccagccccgagttccaggggaggacggcgaggcgcggcacagaccccaggacgagggcaagggggagggctcccaggcctgcttccctttcgtgctgggtctagtgaggtcacgtcatgcacacataatcaacccaagtcatttctaaactctggaagttcttaattgggctcttgggaggaagaaagaggaagaggaaaacttggaggccagttgccagccctctggggacacgcagtcccatctcacaggaggagtgaatcggtgttctcacggggttttccgaagccatctgtatttcagagctttgtgatggagcgaagttcttcactcccactcctgggctgatctcctctgggaggcggagcttccagcgtttggagcgagccctggctgcaggcccacagctgcttcctccaccctagcgagcgctcaggcgaagcccagcctccgcaggactttgcttttgcaaaggagaagacaaagccagcagaacctccgtagcttacgggaattttacctattcacggctgcccctttgcccttcgcggatccaatggactcagtgaggcgccatccctggggttcaggggttgggtctgagtctcgctgcaacaactgggggaccggtgtctgccagaatccgcccggtgaacacaaagctcgccagaggaggcagggcacggcgtccacgtggggtgaccagctccccgtggagaccctgtcccctgccgagtggatggtggggagaagccaccaccgtctgattcacttcgggagcttttatgtcaacttcagtttcaaaaataagattctttcattaaaaaaagcctgaatcatttatgcagacaatgctgatcacacactcccttctctcccaacattccagccccattctttcccgcttgtgctcgccttggatgacaagaacctgtggaaaaccagcttctcagtcctgctccctcggcccccctggggtggcactgctgtctgcatctcctctttggagggagctcaaggccaactcaagcgggggccgggcgttggccgtgcctgggctggggtggtcttgccaaggaggagatgggtggcaggtcccggaaggtctttcctgggaaaggctgttggcacggactgcggttcctctcctttgtggagttgtgcccactcaacacatcatcctgtagagccccctcctgcgctggctttggtggtcagggcggctcctgcctcccctctagaggccgcctgggttcacgctggtcccacactgggcttagagtcatgctgggggagtgtgaagtcacacggagaacccgtgttgttcttggagcatccagtgtatctgatgaaaaggaagaaaacacctttatcataaaaggcacacaggcatatgttacaaagaagagtgcaaaatttacactcatttttaagaaagagaaagtcatgaagaaatgtgcttgcagccagaggctttggtgtaggaagagccccctggtcatcgctgaggggtcaccaagagcgggcggagctcggtggagtggcaggtaggaacgggagcatggcagagcccatgtgcacccttgtgggtggtgctctctggggaagatgctggaaggcactcagtttgaccaatgccttgaaagagaaaaggaacaccagtgacctcggtggcagtgcatggactgcatctgctaacatttcctggtaaccaaagacaatcggggccggctgctcttggatcagggccgttcagagcagtgaggtttgcacacactcctcttcacagcgtctgatccactaggcacagatgaccttacattgtgacaggatcctgatctcctccagtgctggtcctgctcctcatccacatgaggagagcatggacaatgcagagtggatgtcgcctgctcctgctggccgctttgagtctgagccgagggtgctgcatcttgtgtgcagattcctgggaaacctgctggatgtctggcctggaggcagggatggcacagccccgggatccaggtcctcggccacccctgtgggtcggagtgggtgacccccatgggcaaggtcgtgcctgggagtcacagcttccctgggggaggtggcttttgattaatcttcacagtttttgctgcaaactgatactcgggccagcccatgtccttgagaagcgttgccttgatattgggacagagtagtgctcttgagtgcagtgtttcagcctcaaaggccaggtggacagggggtacggtggggggctgatgaggcattcctggaccctgcatggaaagtcccttgtttctagcatgaatcagcctctgctggacccactggaagacccaggagtgcctcccagggctccagtctccaccagcagggtccctgcctcttccgtcctccaacaggcccctttcccttgaagccagagctggtgttttatttaaaaatagacgcaaagagccctgacctctgcgacagcatgggtgcgccttgagaacattatatggaatggaataagccagacacggaaggacaagcactgtgagatcctacttatagcagcccctagtgttgtcagagtcagcgacagaaagtaggattggtgttgccgggggctggggagtcaacgtaggattgggggtgccaggggctggggagtcagcataggattgggggtgccaggggctggggagtcagcatttacagggaatgaagttcaattttgcaaaatgaaaggagtttgagagacagatggcagtggtggttgtatagtagtgaatgtaatgaatgccacagaattgtatattaaaactgataagatagtaaattttatttatgttatgtgcatcttaccacagttaaaaaaaagtttagttaaaaaaaacaaagcccccaaaatcaatacaaagagaaggccactttgcctgcacagaacccctgacatcggtggtgtggggtgagtgagtccgggggccttgcctggcaggagggcctgggtctgagcttctttctgtgccgctctgccgtgagctctgagctctgcatgggctggctgtggcctcacctggggccctgaagatggctgggctgtcccccagccctgccccaggtgcccaggctgcccagcatgcgtgagatgaaggcagccccagcgttaaccataagctgagcccctctggagtgcccatgccctgtgtgtgcatctgcatgttggtgcatacgtgagacgtgctcaactcacaagaacttggcaggcgctggccgtggggtgaccgggcctcccaggctggtggctggggtcttcaccaaggcaagcatggccagctctgcctaagaccctcagagcacctctgtagtcacccacctgctactcgggagaggtggcgtctgtcccgtggcctcccacgtcaaggtgtggcctgggagggcaacaggcgatgggcttcccagggtgcttcctggctgctggtagggattatcaggaggccccttcttcatggccctatagtcacttagacatcatggcgcctgggacactggggcttgcctccgccatgagccccttaacccggcggctgtgattccagcaccattccgggctgtggtgcccaaaggactctgagagctcagtccgtcctcccctgggagggattccctttgacagtgcaaagctggcacctcgcggaccccgtctccgggcaggcgtgaagctcaagctgctggaagcgctctgtacatccagtggaaggagccgtctctgtccctgtcaccaggagtgtgatgctgataccgaggctccctgatggttcctctcagggaggagacaggccgtgtccagccccttcccccttcctgtcctcatgctcacacccagtcctgcttttctgcatgacccttcacctggctcacgtgtttgtgggccgttggcccagtttttttggtctccagcccttgctggaggtaaattacctcctggaattttgaaagtcctgtaattaagatttgaatttttctttctttctttcttttttttgagacacccaggctggaatgcagtggcgtaatttcggctcactgcaacctctgtctcccaggttcaagcgatcctcttgcttcagcctcctgagtagctgggactacaggcgcgtgccaccgcacccagctaatttttgtattttgagtagagacagggttttgccgtgttggccagaccggtcttgaactcctgacctcaggtgatccgcccacctcagtctcccaaaatgctgggattacaggtgtgagccactgggcctggcaagatttgaaattttgaaggaaacagggacaggattgctgggggtgacagcaactccagagcctcagagaatgtgctggtcacttgctctgtgatttcaccaagacaagactagtggccctcagctcctcatcagccacacggagcggggtgtgaacagccccaccaacgatattccagaatagcgcaaaccctgaggcccgcagacggctgctcagggtggaaaagtgacccacatccatcctggaagggtgcagaaaaggaaaggaaatgtagggacagttctacttgagaatacgagaaaatggtaacaggaataagaaacaggtatttgcagctgctgaggaacgcatgtggcctcccactgcgtcggtctgcagcacaggactggtccctgcatgtgtgacgttctcatttggagggagcttcttacagcttagtggtgagagacacaggcaaactgaaagaatctgttatttgtgcttttctcagatgaagactgggtggatagaggctctgaggttttatatcttctagttccttttagcaaaaaagaaaaaatcagtgaaagccagctaagtccagaaaaacccggtggatgttgaggctggaagtgagagccagctcccaggtgtgtccgagcaggtgccttcctcgccgtgggtggggctgggctggagtcaggaaggacctggagcttccagagggggcctgggaggatgcagatcaccttcccatttctgggcaggagctccagatgcccctctgctccacgtggggctttccacaagaagaaagagtgggtgtgatcacgtgagtgtgagcaccagtgtgggcaggtgtaagtgttagcagaaaactgcaagggaagaaggtggcagcggctttgaaccccaggacaacaggtgccccagacagtgcttctgtgttcactctagagcaggggcacccaatcttttggtatccccgggttacactggaataagaattatcttggaccacacgtaaaatacactcacacagtgatagcttatgagctttaaaaaattgcaaaaaaatctcataattttttttttttttgagacagagtttggttcttgttgcccaggctggagtacaatggtgcgatcttggctcactgcaacctccacgtcccaggttcaagtgattctcctgcttcagcatcccaagtagctgtgattacaggcatgtgccaccacaccaggctaatttttttgtatttttattagagacagggtttcactatgttggccaggctggtctcaaactcctgacctcaagtgatccatccgccttggcctcccaaagtgctgggattacaggcatgagccaccgcacccggccaaaaaatctcataatgttttaagaaagtttatgaatttgtgttgggccacattcagagccatctcgtgggccgtggcctgtgggctggatacgcttgctttagagtcaacgttgccgttcctgtttttgggttcattggcccagtcacaccgggtaatgatagtctgttttggggagaggcagatcatgcgggcagagtgtggactgggttctggcccctcccaggcgggtgtacatatccccctccaccgggtgcactcctgagcgtggggcactcaccgcctcctctgcttccttgcacaactctggtgccgtgcagaggggcagagcccagaggagctttcccggccagttggggctgccctggtttttggaccctttggagggaggaatgcccagtggctcagtccacccacagtgcggagctgcttcttgagggttgccttgtgggcaggggcagcctggtgcagaggcagcttagccgggaggctgacccctttccttgtcctgggctccgagacccagacaagatccggtctcagtagatttttgtgaggaaagagattgactcaactgtgtgtgtattttgacaaactaattttagagggtagatgaaatgtctgatgaaaccttgacatggaattagccaattttaagaacatccacttactacatgttcaacgaggcctcacacataaatttaacgtggttttggaaaatgcagcacttaacataagatcacatttttatctgtatgtcccaaagtgcaaatataatttcaaatgttctgccatcttggtaacagtttttttacattatgcagttaccctcaatgctgtttttgaattacatgccagagtgtttttagttaccacaagaaggaaaacaaagtgcaaaactgaattgagctacgtgtgtggcagacaggcctcctagaaggctctgcaaaatccatccaaggactagaggggcacagccctgctgggaacagccggcggggcggccgttgtgggtggctgagctgatggcggcttccctccgggccttccttcttcccacccaccttcagagcctcggggtggggagggttggaggcaggtgtgtctggcgtattgaacccactaaggtgagctccgtgctcgggggtgctgtctgcagccacatcctcatttctttgggcctcagttttgttgtttgaaaagcgaatggactgaacaagagcagcctttttaaagcagaagaccttttcttcaaatgaaatctgataaaggcattcattaagaaaactgtggctagactattttgaaaataagagtttctaacctttccttattctgacccaacccggcgcatgacattccctgtctttggggtgcggtgaggacgtgggagctgagagctggggctttgtggtctctgcggctcccccatctcctgatgccctttggagctcagaagtccaggcattttgatgtccagtaatgggctggctgttccgtagacagtgggctttggaattccacagcattgccctgacagatgggaaaggaatcctcctctgcaaacagaacccagggacatggacttgctgttgacccacatcaatgtcgtagaaaacttcccttgtgagtatttgacaaactcagaaacaatttaatattagaaggagaggaaaaaattgcttgcagagtttttgacagagagggagctcacttgcttgggttgagcgttgctccgctgggagagggatggacgctgctgcagcctcttcagctacatttaaaaatggcgctgggcacatcccttctgcgctttggttccttctttcccataactgatgcactgaagaattttgcatagctttcttatgtcccagtaagagtaggaaatcaatttaaaaaggccaggcaccgtggctcacgcccgtaatcccatcactttgggaggccgaggtgggcggattgcctgaggttagaagttcgagaccagcctggccaacatggtgaaaccccaactctactaaaaatacaaaaaaattagctgggcatggtggcgtgcgcctgtaatcccatgtactcaggaggctgaggcaggggaattgcttgaacctgggaggcggaagttgcagtgagccgagattgcaccactgcactccaggctgggtgacagagcaagactccatctcaaacaaaaaacacaaaacaacaacaacaaaaaaagaaggggctggtttgaattaatgaaaaatctagaaaactcatggttttattttgttaaagactgtaactcaagccagatagtcacattgtctcttcttccttagggatcttatttgacaaatatatagaaatgttagtaattagcatatcaattggcagtctgttaattcatggttgtaataaagccttgctgttttctgaagtgagctaggccagtttacttcatgaacagacttaacaagcctcatgctagccagttctgagctccctgaattggaagcaggtgtgatgcgcatgcgtggtgctctgcagtctctcagcttccccagcggccttggccccttctcctctgatacttccccttttatgcgtccgcagcccttttgggttctgagctgcggcaagctttaagcaagtgttttaattttctttagttcacttagctaagtcttcaacagattaactaacgttcgtaccttggtagaattatagccagattttgcaaagagcttgtgaaatgacagccagatggctgtggaatctgaatattcactgctgagaaccgaagccagctttcctactatgaagatgttctgtgtgagccacaccttgcccagggtggaagtgatgtttgtttcaggtccacagacgagggagaggacggagccagtggaccctcggtggcagtgtctggtgcagatgtgggcaggtaaccgggtggaataatgcttgctttgctggcattttggccttaattttagaaaacaacaagttaggtttgtagggctcaggacaggtcaaaactcagtgcactaaatgccaccacagcccagagttctgagtgacagttccaagcacgtgctgatgatcaaagccctagagaaaccaaagaatttgaatgtccctttgaaatttacagcaaaaaatttaccctatgtcttcaagacaaacatgagaagcaccgatttatgaggtgccaggcacactagtgtttatgaatacttagatgatttgtggcaaatagaaaggccataggcttcagaatagacctggattcaaatcccagcattgccaattagcacctgtgcagccctgagcagctcacttaacctctccgagcctcagctgcccgtctgcaaaaaagtggattcctatcctgcaggtggtagtagggattaaagaaggtaacttgtgggcagcacctgtgtgcttggcgctcggtaaatactggacacgtggcacacgttgttaccagccactggggcacattggccttggtgacctaatggagaaagccaaaccgaagtgctaaccccacaggtcgatggaggccccgagaacttgttggttcttccacactgaaggaaaagctcatggaattttaagggcagaagagaccttggcggtgggaggtgttagagcttcctccatgcagacacacacggtgggccctggggcgaccccacccctgcccgaagccccagggtcccttgtggtctcgtctggatgtggggtggtgacgctctgctgtccctttggagggtacgcgtgttgggggcatgggtgggagcagagccacctccaaagaaacccccccttggccatgtgctttcctcccatggagcacaggtggggggcccagcctgggctcctcattgccccccgagacccagcacgtcacctccacatttatagactctctagctgggcccagccatggagccccagaggctgggggctgagcttgtgcagccccaggaaccttagctctccagggctcctctggcccgagggaggggctgacagccctttttgttaagggcattgacagtgacttctgggcaggagaccctaatacgcttggagtaaaaagggagggtgatgccttggtgggcccgaggctcctgggagcccccggctgcagagacaagaaccatgaggaaatgcagagtgaggcccttggctagccagggcatgggacccggtccctgcctgtgtgtgactgcaaaggccactcaggcacccgctgcagcagccacgtggggacactgaccagaccacacagcaccagcctgtcccagccagtcccagctccaggctcaccgtatgtccccagccgtcaccagctccaggctcacagtatgtccccagctgtcatcagctccaggttcacagtgcaccgtccggttccagccgtcaccaggtccaggctcacagtatgtccccagctgtcaccagctgcaggctcacagtgcaatgtctggttccagccgtcaccagctccaggctcacagtatgtctccagcagccaccagctccaggctcacagtatgtccccagccgtcaccagctccaggctcacagtgcaccgtccggttccagctgtcatcagctccaggctcacagtatgtccccagccgtcaccaactccaggctcacagtgtgtccctcaggacccgggactcggcgctagacccccagagtgagcatgctccagcgtaaggctccaggcctttccctctcggaagggccaccctttagaagtgcctgctctcatctgtcctggaggttatggctgaacccacaccaggaccgtcactcattcgagctccctgggtttgctccaaggctgtgctgttgagaccacatccaggacaggagtccggtgctgggccagggtcagatgttctgatttgcagggaggagccacttgcatgcatttctctgtggaaacaaaaggcttgtttttgaaggcagcaaccctaaggatgtttaaaaggcaagtggacagttttgggggtaaacctatttaatgaaatgcacacagccaatattgctgtcacttgtgtcttcaggtgcctagagggtgaatgtgatatatagcaactcaatatcttagtgcatttaaatatacattttaaaagattctctgactcattggaattcatagttccatttttagatgaaattgaagacatagttcagggaaaatgggacagttacttgtttgttaccagtgtggtcgttgcaggctgtgctggctgacacggggggcatggcttttccctgaaacaccttggaatctgcagttgtcgttccctccagagcgctgaggggtgaagggaaacccctccattttggatttggagagctgagccctggggggttcgtgctgcctcacttccagcaggtcctgggactgggctgggagtcagaccaccccctgcccacctgtgagtttgggtgggtcgtgtcttcgttccctcatctgtgaagtgggaataaaaagctgagctccggggcctgttgttggggttacgaggctgcgagaatcactggagtcagggccctgcacgaggcaggtgttcacggacctgagttcctcttcccgccccgtggtgccgcctgcttttgggatgaggtagtggctggggtgtccgtagtgcagtgcatgggaaagggctcaaggcagtggaggatgggaggccactgtcaggtgagcgcccacctattctcagtgcctagggcgctgggatgcgtctctgcaggtcccatgggtgggctggggcacttgagacgccatgtgtgacggctgggagaggcacacacgcattatagaagccacagaaatcacgacccacggaggctgcgctttttccttggaaacttgcagccatagccttggtggtaacagggacagaagcagcaagtagacacacgctggaggtcgcctgcgagtggattcccagagggacacgccgcgcaggggtgaggggcagtgctgggaggagaaccactggggttagtgtttgtgagggagcgcagcgtgcgccagtcaccggacgagcaggtctcgaaacactttccgagatgcggtgcacagacctggctgtgggctacgtcgagtatgaaaagtgtccccacattttccagaaacaaagccacttacagggggcccctaaaaaggggcactgattctaaaggtgcacgagctgtgctcttttccgccagcgtccggaagagagctccacagggggaccctctgtccctgtggtggtctactccttccgtgcttggaaagccagattttgcttccaaatctagaagaaatgagtaatgaaaaaaagtaatgttttctctcaccagctctaaagtgatggcttttcagcattttaaaatgcagttctgctactagaatttgaaacaacaaattacatttatgaggtcaaggtgaagctagcaaatattacagggaaaggaacattcataaataaagatgaagtcatttatcagagacctaaataagaaataggctgaaagcgctggtgagataaactggtaatgtaagggtcatttagcctaatgttcacatttatatgcaaggaatcgagtttgcagcacagtccaggctcgttgctgggctggcagatgaggccgggtgctctgcggggtgcccaccctccacgtcctgctctgtgtcccacaggtctgtgggtcctttgacctctgtcctgactcacctgcctctggcccctggtctgctggtcttctctggctgagtggaagggagcgcagcttcagagcaccttttccctgttctgaggcaggagaatggcagagggagctggagcttggatagagacggcatgtggactgcacttcctccctggcgacagcccccgctggcctgtccttgggctgcagctcactgtttcctgacagttgactctcatgcatgactctgcttcctcgtttgggccttgggtgctaacgacgacattactgctgaactagagagcctcttcctgtggttccttatgcctgacccttgcccttgtaagccatccctctccagttatcctaatttggctatgctattcatcatagtccgctcaggatgctataacaaatatgctgcagcctcgggcttaaacaatggatgtttatttttcacatttctggaggctggaagtgtggggtcaaggtgccagcagacttggtgtctgggagcgcctgcttctggtttgcagaggcctgtcttctcactgggacctcacaggggcgagcagagggtgggctcctgagtctcttcctataagggcactaatcccatcctgaggctccaccctgatggcccagtcatgtcccagagggccctcctaacaccatcacgtaggagttttgggaggactcacacattcagtccggggcacagtctgtctccacccgtgtcctactgacagatgtttgctcagttgttttcctgagtcccgtcttattgatggtgggctgggaaggcccttgtgtcttcctgagtcttgtctcagtgatggcaggctgggaaggtcattgtgtcttcctgagtctcgtcttgtcgatggtggactgggaaggcccttgtgtcttcctgagtctcatctcgtcaatggtgggctgggaaggcccttgtgtcttcctgagtcttgttttgtcaatggtgggctgggaaggcccttgtgtcttcctgagtcacatcctggtgatggctgcctgggaaggcccttgtgttttcctgagtcccgtctcggtgatggtgggctgggagggtccttgtgtcttcctgagtcccgtcttgttgatggtgggctgggaaggcccttgtgtcttcctgagtctcatcttgtcaatggcgggctggaaaggcccttgtggggtcttcctgagtcccatctgggttatagtgggctgggaaggcccttgtgtcttcatgtgtgcctggtgcacaatagacaaggcagggcagcacttacttaacttcttattgtttattttcttgaaaacatcatcaagtttatgaaaccaggcaaagtttcaaatctaagacaatcactttcattaggcaagcctctgtctagccctgtctggacccagaggaggaggtgatgattttcagcaaaatttaaagggcatttcagaccttctttattttagttttcatgttttatatttttgaattttaattgatgggcttaatgagatttggggcattgcatcgccaacatccacaacaaaactaaatggaaggtatgggctggagttgtggttgctttgtgtggttgttttgagtgttttgtgtggttatgtgtggggttctggttagtaaggtcccaaccttttggatgtgaactgaaattttatttttcttcatcttatctagtatggaaccagacttttagattactcatttttgaagtacttttgcagattttaaaaataaactggatggaaaacttagacattttatagaaaatgaaagaaaaaatcccaaatataatcaagtatagccgctatattaagatttactgtgtttccttccagtctttttttttaaacactttatgtaaaaacaatcatggttgaggacatatacacactctgtattctgctttgtgttgtgtacacagttgaccaactaactgaaaaaactttattgcctaatttctaatggttgcctattaattgtttttgtatgatttcaatagccacctgaatgctacaagaagtcctcagtgccatggtctgaccccagagaaagccccagccgctccccaggtgctctaacaggcagttgacaaatagtccagccgcagaaagcaggattctgacacagttctgtatcaggagaacgaaaacagcacagattaaatgcaggtaccctcccattgcaggttcttaccatgacccagtgaggtgggcattttaaatccccaatttacagaaaggaaaaacaaggctcagctcatgtaagaaacttacccgaattcacgcagctgaatggggagggagtgagcattgacattaggtgtggttggctcaaagcccacaacttcccttggtactgagtagttaagagtatctgagatcaaagctgctgttttcttcgaccagattgtggaaggaacaagatatgcctttgctacagggtaactcagaacttcaacacttccttagattacatgagtaacagccacagaaaagaataccccatggaatctgagaatctgacattcccaggctgggagatcatttgggaggcaatgcaggaggaacagaggctttggaggtggctggtctctaaagatgttgtgtgaagtgctcctttctgcgagggcatactgaggtgtagttctggggaacactgaaacgcctgcctgctgacgaggctcgaggcaggacttccagacccccacctcactgtctcccgctgcgtttcccaccccgccctccctggctgtgcaggctgcccaacgtgcaggcgtcgtctctgctgatctagcaggatgttatctgtcgatgagctgcctggagccaagaaacatatggagaatgtctcgtcttcagagggtctgcacagccgaggtgaaacatgcccgggcagatggccactgtgtgacgtggtaggctagctttggcctgggtgatggggggagcttcgcagagatgtgtcttcaggagggactgtggtggacaagctgagtggcagctccattgcaagatggatggaggctcttggggtacggcaatgagggcagcagttggggcagagtcgcagttcagacatccagccaggcctgatcccactgcgtttgggaaatgaagagcagcacacagctgtccctgatgaagcctgtggcatgggtggtcacaacctgcacccacagccatccctgacagagcccagggcatgggtggtcacaacctgcacccacagccatccctgacggagcccagggcgtgggtggccacaacctgcacccacagccatccctgacggagcccggggcgtgggtggtcacaacctgcacccacagccatccctgacggagcccggggcgtgggtggtcacaacctgcacccacagccatccctgatggagcccggggggtgggtggtcacaacctgcacccacagccatccctgacggagcccggggtgtgggtggtcacaacctgcacccacagccatccctgacggagcccagggcgtgggtggtcacaacctgcacccacagccatccctgatggagcccggggcatgggtggccacaacctgcacccacagccatccctgatggagcccggggggtgggtggtcacaacctgcactggccagtggaggcccagggagggtagcccctgcatcttcaggcaaggcatccccagcaaaggcagtggtggctggggagagagcagctgtgacggcggcacggagggcctgacgtgcgactttgggatgtacccggagtgggagctgtgttttcatggtgttcattctgcatccacatcttcagaggaaatccccgaggcattgtgagcatgtccatcagggcaccctggaaagcttggtaaatgctgtgtggtggcgaaaggatgtccgttataggtgagagcttcatcgattgatggaagattgacggctcggtgcctcaggctagagcttctgtggtgtccacctggtgcaatgcagagggctggggtcaggacggtctctgcgggacgtcccctctggcccctgggatagggactcctcgtgtgttgcagggagacccatcacgcaggacagggtcctggcggtgcctccgggagtggacataggtctgtctggctcctgatggcttcctagcactccacgttgggccactcagtggaaggcaaaggtgcgatctccttggatggtttgtgtctgggatttgcagccagatgcggagggtcctagaaatctccatttctgagcttcttgctcaacaagtgagtttggcaaagttttgttgggacttaaagtttgcacagattccatctgtgagaggctcactttggtgagtgcagatcttgggcgctgccctgtgagcgagggtgcactgaggaagatgatgttgctgtaattaggacaaatgcactcagcccagtatctccagggatttgagaatcagttcattctgcaagtaacaaaactagggaaggaagtggttttcaagctcccgtggttgttggaggtgagctaattctttgcgagttattaattgctggtctcttggaatggcttgggagcacaaagtgacaggaacccaagtcatttctgttctgtttgcttgtgtttgttttgctttaagttaatcctttggtggttctggggatgaggccttgtccctggcttggtagagagaggccagtcaggagggagcaggtgtggtggagcctggccgtccctgagccatcaagatggtctgcgcgtcagagtgcagcacgggccacattctctctgccatgtgcagagggctcctgcacggaagcctgcacgcatttaacaccagcacgctcaatgtagtcttgtaaggaacaggttgaagtgtgccgtggtgtgtctggaggaagcgcctgttgctggtttttgttgttttgttatgtattttttgccatgttccatgctgttcctctaatcacatcatgtcccgggtttttgaagtttagtgacgtttttggtcttttcttactttttacccatgttttttcctctttgtaggatcaaagtcacatacaatagcaactttattataacgcacggtccaccacgctccaacttccagtgtggaggcatcggtgggggtttgctgaaagtctgagcaaatctcatggctgtctctgctgtctccgtgatgactctgtggggcacgtgactggaatgctctgatgcctgtttgacatctggggcttctcagaagccacaggagccacgctgggggctgacagtttcctctcccaatgtcgcttttgggcatctaagagcctggtcatagagacgtgacgtggcttgagaatggacagaggccaagagcagataacaaagcaaggtcgtgcccgacgagctgaggatctttttacactgggggcatgggcaccacccaggtgctgggccaaccctgaagcggtctgcacctccctccggcacccccttctttagggagcctctgttaatgcaggattaaagtctgtggatggacacgcccctttctgactttgttgtttattcagttttcactgtggcaaaaacctattctaagaataaaataagccggtttatctgacccttcagagggaaggacccacgttgctttgggttttttgccttccgtgtccttgtcagtggaaaccccaaatgcctgggcttctcggcgcacctaagtgtttaggcacgtgtgagtgcagtgatgcgttcagcttccaggtgcctagtaggttggagccagcgtggctgggaggaggcatgtgtttgtgtaaaatatgctcctgttcaccacgttctttctatgagcagagggcaggtggtgggtgagggcgtcgagcctggtgtttggaggttgttttatgtgatacagatttcttaacctttttctctaaaggtgatggtccagtggtgcattggttttgttctttcctgcacttgcttcagcctcctcctctcagctggggtgtttgcatctgctgccttccaggaggctgcgcgtgagatgtgggcatctgtccaccacagcaaacacccgtctgcctcgtgaggaggcctcatggtgccttccccacaggtgggatgagctgagcctggagggggctttgccacagccctgggtcgttctctcagggaacacctgctgtttctgtgccacccctgggctcgcaggcctggatctggatggggttggggccttcctgtggcccccttccccatcagttcatggagggtggcagccgcgggcttgagctcgactctggagagggagatgtgaactgacagccttggcttcccttccctggagcgtttcttggatggcagcatgggacgtgggtaatggggcgtggctgggaagccgttacctgagcgctgtagggtgatgtgtctgtaaatttgctgtgtcaggcatggtttggggcagctgttggccgggctgtaacctaggacattaaattcagttccctcatcgcagcttagggatcctctcgctttgaacacagtctgttgtggtttgtttttgtttgtgtgcacatgctcacccacgcccatgcacatgttcacacacacacccccatgcacatgctcatatacatacatgtggccacacacatccgcatacagatacatccgtacacatgcttacacacacacacgtgtatgttttgagggcacttgatcactagctccccccagcctgccattcccctgctctgctgagtgaacgtccttcctggaacctgcatgggacccacatggcccgacacctcttgcctcgcccctcaggagcaggaaggagtgggttctgctgtgaaacagatcttgggagtgtgcatgtttcttttcctttgccaccagctctttgtggtctgggtctttgcaaccccagcactcactctgtttcatatgttagtgtaaacctgcacacatacacctcacatgggcacacatatatgcacacatgggtgctcacaggcacacgctctcacacgtgtgctgtagctggttccatcgtgggctttctcttcaccttgcccacatggaaccccccccgccttgctctatgtgtttaagtcgtggggtaccagagctccctgtcccagtgcatgaaacctgctccagggagcagagctgagtctgtggcacacggggaggccggcgtgggatgtccaggtccccagcattcccaggagctcctgcagagcctccgcaaattgccaccttccctcattcagtccaattatgcttgttctgttttcctcatgtaccagcatcagtattgaagagaaacaaaaaataattttggattcaatttcattgcttcacttaattattactgtaaagaccttgctttccattgctttttattgcaagcatgtggcatttaaattgtattttggatcgacaggctttgatggactagccagggaaccaaatcactaattccatgttctaaatatctgacgtaattctacttatttttggggtcagcctgtcctaggaatggatctcacttcttttgcattctctctgttttccctcttggttgtgacagaaacttggagctaggccttaagttaggggtgtgcatgtggcatgcgtgtggtgtgtatggcatgtgtggcgtgcatgcttgtgtgtggtatgtgagatacatgtgtgcatgtgtgtggtagcgtgcatatgtgtgctgtgtgtggcacgtgtgtggtgtgcatatgtgtggtgtgtggcatgtgtgatgtacacgtgtgtgtggtgtttgtccatgtgtgtagaggagatgctgagaactcatgctggctggggaggcctggggagactgtgagctggtcctgctcccgcctggccccttctggtgaccgcccctccccacagcccctggggctggtggacacagcccaggtgtggtgagtgtgtgctgtgtccgcagagggaagctgctgtcattcccacactgcatcttcgctgctgattggagcccagactcacacagttgccactctccccacatttgactcattttggtcaaaaatgcacaaaatatctaatacagagcactctgtggttccagaggcagcgatgtgagtttgcagctgtgtgtgagctgtcaccatggctcgtcgttgctggccgtggtcagcagcaccttccctgtccttgggggtgtcctggtgagtccgtcctcctgctggcctcccctgggccttcccaccttcctctgccgacacagccaatgcttgctctggggcgtgtcagcacctgcacagcagagatgccacgcattccaaagcaaaatggagatgattttaaaatgtgaaaatattcagaagtaaatatgcacgcagctgctcctcccatcagcgttagccccaggaccaacagcgacgggtgcttagtgcccaccaggtgctgtgtgagtgctgcgggcattctaatgtcctgtgtcccaggcatcattgttattattgtctgtctgcctgtctgagaaggggattgaggcatttgggtgacttttctcaggctgcagagctgagatttgcccctggctgtgtgatcccaaagccccttggtgggctcgaaggccaggctgactttcgtgagcacacgtttccctcacagggctggccccctgaggagctggtgtttccacccctcatcaccttagactcaggctgtgtaggaaatgttgtgtcttccaattccgggcactttaatccttgtttgcttcctgttgtggactcaccgaggccagtgtccatcgtgcacagttctttttttttttttttccgtttttgagacggagttttgctctgttgcccaggctggagtgcagtgcagtggtgtgatctcggcttactggaagctccgcctcccatgttcatgccactctcctgcctcagcctcccgagtagctggaagtacaggcacccgccaccacacctggctaattttttttttttttgtatttttagtagagacggggtttcaccgtgttagccaggatggtctcaatctcctgacctcttgatccgtccccctcagcctcccaaagtgctgggattacaggtgtgagccaccgagcctggcccagcatgcgtggttctaaatcagctgaaatgtaggcattcacaggtctgagacagcaagtgaacctgttcctgatacaccaggtgacgctttgtaaatgtgcatttcacagggcaagagacggctgaccggctctggggagtgattgagtggcctgttttgggacgtcacctggcgttcataccccatggcaaacctcagcagcatctggaggctgcccaggcgggtgcccccgcctgtcctgcacccaagcacgggtacccccaccacactgtatgagtgcaccttctcgggagcctcttgtttaggctgatgcctctggagctctgtggaaacatgatgtgttacttggcagctgttacacagccagttgctagcagcttcactgcttagtacacaccaacttcctccatgtgctcacacaacacaggaacacccaggagcagctcctcggctgtccctgcctgccccctaccctgtcgtttagactgagtgtcctgctgagtccctgctgtgtgtcgggcgggatcagagatgggctttaaaccaacagacatagcacaagcaacacaggtaggtggtccctgctacacaggaaggtggttgagacagcagcaccgaggcgcagcttgtggggcaggtgagatgtggctggtgctgatgaatctgggatacggggcaggaagaccaggggagcctggggtgagagctggcggaggacagcctggccccagccccatgtacacagacaattctactctctgcagaggtcacggtgagggaatggccagctctgtgtggctgctgtgagacccccccacagagtggagcccacacctcggagccctgccctgtgcacaacccccacatggctgagcagtgggccgccaggtgttaggaaggaccagcggcctgggagggacactgaccgtagtccctgtaaacaggcaaacacaatcccaactccacggtattctcagaaggaggaaatggagaggccagcccatggcctggggctggtgaggcctccatggcactgaagcaggaggtcagacatgttccttcacctgctcatcacatgtgtcttggcagacactcgctgaggatttagcacgtccaaggactggacacggagacgcaggctggccctgtcttcagggagctgtggccagggaaggcagtgaagtggctccggtggcggggggcatggccggggtcagggaggcccaggacgcgccttgtggggaggaggcctggggagctggtggagaagctgggtgtggggtggggggaggtgagggccaggcccacggtgcgggaaggacacagctgcatttgctccgaggacgggaaggctgtgggggatcctcggagggatgctcctcggagggatgctctcccaggcctgagccaggttggcttgtgcagtttctgcgcacgtctcgactctgcttggggcttctggtgatatttgtcacaaaccataacttgtgttgttacaagttatgcctttatgaaggtttgaggaggtcaccaactctatcttcattgtgttagaaagaaagtggcggaatccactgtatgaattggctcagtctccctaacaaacccccacaaaccaggcggcttagcaaacaacagacatttctgagtcctggaggccgaaagtccaagatgagagcacggcagggcaggttcccccagaggcctctccccttggctggcagatgccgtctcctccctgtgccccacagggttgtccatctgtgcgtgtctgtgtcctcacctcctcctccataaggacccagtcagcctggatccgggcccatccggcgacctcgttttactgaaatcacctctttcaagacccatctccaaatacagtcccattctgaggtcctgggggtcaggacttcagtgtatgaactttggggtgcacaactcagccatcacacccacaaacaggaaatgggatcaggaatggagaacaaccgagtcagtttcccaagccacagtccagcatgtcggaattccgaggccgtgaccagcggagagacctccagaccctgtgtttgtgggaacgtggttgcctgtgccccgtcctagctcagagtggctggtggttctcgtgagcgtggctctacctggttatctctgcagcgtcccacgggagagatgcagccctgccgagctcaccgggaaggagtggtgtcagttcccttcgccgccacaggtgggcagggagggcctgagcctgcacgaggggtgaccccttcgccacacaagtgaatcctgccctggattccgccggcaccctgccaacaccaggagccgtgtgtctgcctgatgtggctccccccagagcgggccctttcagaagctgtaggaagtcatcatctcctcagggactgggcagatagtcccccttcccacacagcgctgctgaggaaggaaggactgcacaatgccagccagaggggagagtaggggctgggctgcaggtctgcaggtctgcagagagccgagtcaatgggggggcattgtcggcttgggatgttgagaccctaaggcttcaggagagcttgggtcttcctgtcagggctctgggacaggtctgaggtctgtgaggggaggcgtcttcaccctgtatcatcggggctttcctcttgctgaagcgggagcttccacactgtgtgagcacagcagagagaggtggctgtggagcaggtgccgtggagagagaccagcagagatgtcctgggagatgggggcatctgcccccgagggctgcttgggaatgaggagggcacattagataaatactcattgtgcatgaaaggatctttaaaaatccccgtaatatgtgtgattatgctgaataataattaaacacggcactattaatactccatcccgtaggacctctcaggaggaagggaggagatacagtgagcgcctgttctgggccagggaggctggggtggccccagctcaggatttctgcagagcctgtgtccagctgtagagcgaggggtgcggagcggctcagccttggtcccactttccgtccttaagtctggatggggctggcaggctggaaacctggcccgtgcgtagcccatggcccctggggcctagcatcctgcccgtgctaccttctgctgcagcttctgctcgggtctcacggttttgttgcacattagggggccgtgtgttctccttggcagatgcccagtttccaaaatagagaaactttcacctctggactacttgccagaggtgcttttccttccagagcggtcagggcctgcctcacgctgtgctctgcagccggctccagagcctggagctgggaagtccagcactgtgcagggcctgggacgcagcatttcttcgcatggagggccagcttgagggttcagtcagagccttgcatcctgagccacagtcttccaagggctgtcttttcggagggtgcaggagaccgctgctggggccacacttcgaagggcagtgatgctggcacaggtggtgttggctgtgctggaggagcccccagtggcctcatcggaactacagtgggccctgggacaacatgggtctgaactcatttattcatggatctttccaaccaaatatggatcaaaaatgcagtatttgagggctgtgaaagccaagtgtacagaagctgactttttgtgtatgcagattccgtggggcagctgcaggacttcagtgtgtgaagattttggcgtaagtgggggtcctgggaccaatccccactccatgctgagggttaacgccaatttttcctgcaaaaacctgatttccaaacgcagtcaccttctgaggcactgggctggggacatccatctacgagttctggggcttgaccataacaaccaacagctttcctcgcactcctcagcgatctggcttcacttccctccactccagggcagactccactccagggcagactccactccagggcagacgactccactccagggcagactccgctccagggcagactccgctccagggcagactccgctccagggtagacgactccactccagggcagactccgctccagggcagacgactccactccagggcagactccactccagggcagatgactccactccagggtagacgactccactccagggcagactccactccagggccgactccactccagggcagacgactccacaccagggcagactccgctccagggcagatgactccactccagggcagactccactccagggtagacgactccactccagggtagacgactccactccagggtagacgactccactccagggcagactccactccagggcagatgactccactccagggcagactccactccagggtagacgactccactccagggtagatgactccactccagggcagacgactccactccagggcagactccactccagggcagacgactccactccagggtagacgactccactccagggcagactccactccagggccgactccactccagggcagacgactccacaccagggcagactccgctccagggcagatgactccactccagggcagactccactccagggtagacgactccactccagggtagacgactccactccagggtagacgactccactccagggcagactccactccagggcagacgactccactccagggcagactccactccagggtagacgactccactccagggcagacgactccactccagggcagactccactccagggcagacgactccactccagggcagacgactccgctccagggcagacgactccactccagggcagactccgctccagggcagatgactccactccagggcagactctgctccagggcagatgactccactccagggcagacgactccactccagggcagaggactccattccagggcagactctgctccagggcagacgactccactccagggcagacgactccactccagggcagaggactccactccagggcagacgactccgctccagggcagactccgcttcagggcagactccgctccagggcagatgactccgctccagggcagacgactccactccagggcagactccacttcagggcagactcgctgtcggcagcatggtggctgctcctttggctaatctcttgtccgcaccagccctcaccgtgggacgtgtctgcaccactctggctgctgaggctcacccaccacccccgcccctggtcacactggggctccccagaccccaacctggctgcaacccgtctggcccctccaacttgtgcttcctgtgatgtcccctcctggaccccaagagtcacaccctggcctcctgcgctcttatcttgttcttctgagaccccattttccagttttcaagatgtcagcagccacggtgatgctgacaatccctaaatctaagtgtcagctcatcctctgttgaagcccttggctattcttgaaattcccatttttgggtaacttttgttcatctcagtcccagcaagttctgggtgatctttgctgccctctcccttctcacggcaggtctgttctctccagctccacatctgccacacacagaagcaagtgtgtggaaatgaagacttgggctgttggaagaactcgtgatggtgagctgctctcaagacaaggaaagccaatgtccacgtgagaaccaggggagacgctgagccctgcagactgtgccaacccctgggctggctccggtggtccgagtgcctcacggactccagaccatgctgatgccctcacttcaccttaatctgtgtccacagactgcatctagccgcagcaaggtgcatgttgtaagtgcatctggtcaccaggggccaggttacagagagcgattcgctgtacacacacagtggtgccagaacacaccctgcacatgcaccatcctggacagtccattctgacgtggaccttcctcttaaaacagtccaccattctgacgtggacctttctcctaaacagtctaccattccgatgtggaccttccccctgagccagcacctggacagtccaccattgtgacgtggacctccctcccgagccagcacctggacagtccaccattgtgacgtggacctccctcccgagccactacccggacagtccaccattgtgacgtggacctccctcccgagccagcacctggacagtccaccattgtgacgtggacctccctcctgagccactacctggacagtccaccattgtgacgtggacctccctcccgagccagtacccggacagtccaccattgtgacgtggacctccctcctgagccagcacctggacagtccaccattgtgacgtggacctccctcctgagccagcacctggacagtccaccattgtgacgtggacctcccccctgagccactacccggacagtccaccattgtgacgtggacctccctcccgagccagcacccggacagtccaccattgtgacgtggacctccctcccgagccagtacccggacagtccaccattgtgacgtggacctccctcctgagccagtacctggacagtccaccattgtgacgtggacctccctcccgagccactacccggacagtccaccattgtgacgtggacctccctcccgagccagcacctggacagtccaccattgtgacgtggacctccctcccgagccactacccggacagtccaccattgtgacgtggacctccctcctgagccactacctggacagtccaccattgtgacgtggacctccctcccgagccagcacctggacagtccaccattgtgacgtggacctccctcctgagccactacctggacagtccaccattgtgacgtggacctcccccctgagccagtacctggacagtccaccattccgatgcggaccttcctcctgagccagcacccagcgtgctgctcctgagaaatcattcgtcaactgattttggagttactgcttcagcatcttgctgattactaatagatttcctcattgttaaatttagatgcagggagaaaaaacaatttccagaaataattcaccctgttgggaagccagacacctagtactgtctctaactcagcaactaactgtgtggtttcgggtgaatcacacagtcctgtgcgttggtctagatgttttctcaggtccctttgggcaagaatacagccagccctgcataccctcaggttctgcctgagtcgaccaacagaggattgaaagtactggggaaaaaaatataaaataacaatacaacaataaaaataatacaaataaaattatagtatgactacgcagacagcattccagctggggcaggaagtcactgcgtctgcaggactgagcgcctcgcacagagggaagtcatggaataaggtcctggctgcagcacttggaatcctgctgtgggagagataagagggacgtggctgaaatctcctgttccttggctggctgagatctcggccaggccctcatggcctgcagggtgcctgtggtttgcccagcgtatccatgtgtatcctcctgctgaatctttgctgcaccctcatgagagtgaagaggctggggttaccgatctggtgctcagacatggaaaccaggacgtgctcactgtgacctggctgggcatggctgaggcagggattaggattttctgataagcagccacccgatcgttcttcgtatgtttgtttctattggtaatatggttgaaaaaaatccaggagttatagtcttttctaaaaaaccatgtaagtgctactttaaatggaattatcaccacccacaaaacagtggaaggccgcccagagcttggaagtcggggttggagccactgttgctcctgacggaagggagccttctctggagatcctgctctggggagtgtttctccaggggcctcgagctgagctgaaggtggagaacctgcttcaaacatccaggaaagactcgtctagaaactgtctaccgaagggcatgaactgttttaaattgtagtggcagtaaacatagaaacaccatctagatggacataaataataattttcaggaaaaataagttctcagagtccgtttcattgctgaagggggaatttcacaatagtggaattttactctcctttccacaccttcctgctctagaagggacggtgtgagacccaggctgccaatgcaccttgttcaagatcccaaactctgtttttcttaggggatggaagtccttctgcctccgtgtcagggctccctcttggaaggggagctgaagggcccactctgtggccagaaaatgctttcctttcttggcattgccgttgttttgttaaaagaaatgacaagtttgagtgggggacatccctgggatttaaaaaatcattctgtgttgcactggaaaagctcattaaatcgaaatgtttcccatggcacatgtcctgttcagaacttgtgtgtttggcagagtagtcattgcactgaacaggaaagcttggtttcaggctaatgatagtaaagttggaaaatgtaaggagaacagatgggtgttgcttgcagagtgtgaccgtgctggcgttgtggggaaaatggagaatttccatgccatgggggaggcattgggtaacccttcttccctttttcttctttctgaggtgagtcacttctttcccttggctgcttgggatgggagaaagtccttatatgatgggaaacagcatcagcagcattggagaaaaagggcccctttctcccttggggatgttgtatggccactagattcttgagtatctttagaatgaaggtccagagtcacccagatcaacatggagagtgcaggagagtgctggagaatgtcagaaaatgccagagagtgctggagaatgccagcccattccatcaccttcagagccacccatgcaaagcaaaggctcaaacacagcttggtcccccatgccctgagagccacctgcagatcgggcagggaaggagcttgaggtggaatcggcacttctgactcagccctagcacctctttacttatttatagactaattctgttctcggtatgaaaaagtaatttaactgtcatggccaactgagtgtctcacacagatagctgggatgagtccgacttcataaaatgaggagatgtgctggctggcaggacagtgtcagcactaagggacttcttttaatgttttctccctcttcccacttagatgccaaaatagccccaaagtttgaaatgacttttcagccaaggaagttcttggaaacagtgacgacgcctgtgtactgtgtggcctgagatgctgcacggctgttctctgctgcagtgctttggggatcctgagcctgttggcataaagggagctcagtgcaaactgctgcaggatgatgggcatcctggagcccaagtattgtttttttgtttgtttgtttagagacagagttgttttgctttgtcacccaggctggagtgcagtggcgtaatctcagctcactgcaacctccacctcccagattcaagtgattctcctgcctcagcctcccgagtacctgggattacaggcacccagcaacatgcccagctaatttttgtactttttatagagacggggtttcgccatgttgcccaggctggtcttgaactcctgagctcaagcaattcacctgtttcagcctcccaaagtgctgggattacaggcatgaaccaccgcgcctggcctcaagtaacatttttaatcagctcgaatgtttgacccttagccttggggaaggttcgtccttccctcttgtcctgctgtggcctcctcaagtgggtccttcctctatggtcatgccgtcctggtaatctgtttatatcctctgttgatctcagtcctaccctcttttaaaggtggagcttgagccgtatcctttagcctctgtggacgttctggcccggcttggctgtgcattttcttcacttctggcttacttggcacctgagctactgagtatggcctttgctaagtccagaaaggacaagcgctgatgtccctgtgtgttcatatccttctcccaccccgtgaaatccgtatcatctctattaatgttcatatccttctcccaccccgtgaaatccgtatcgtctctattaatgttcatatccttctcccaccctgtgaaatccatatcgtctctattaatgttcatatcctcccaccccatgaaatccgtatcgtctctattaattaattgatagattgattcagtaagaactattgggctctaactattttatagacaccatggcagtaactgagataaacccactcttgccctcctggagtctattttcttttaagggaggagcaagttcttaagtaatcacaatgcagttggcgagagctgggccagggagagtccagggagctgggagaatgttgcaggggtgccccgcccggtcaggaattagggagccctcttggaggaagcaaggtgcaacttggtacctgaaaaatgagtggactctagtcagactgggggggagggaaggtttttctgcagtggcatgttagtgaaggcctggtgggaacaaaccggggtgtgtgggatgtgtgacgaaggggatggaggtgcctggggaggcctgcctggctgtggtggggatgagtctggaggcatctggaggcctgcctggctatggtggggatgagtctggaagcgcctggaggcctgcctggctatggtggggaagagtctggagacgctgtccatgaggctggcttggactccaccctaaaggcaggggactgcctgagggcattgcagctcaggagcaatatgacctttgcattttgtaaagatgatcctggcggctgttggaggagattgcagaggggcagcgaggccagtgaggaggtggaacggggctcaggctggggggcggtggggctgaggcagagtcaggccccttaagagatgtctgggaaggactgagggagacttgggaactgcagggatttaggtacagggtcacgttctggaattccccatatgtggcccaccccatcagcccacagtgcgcctgtggtgggcggtgataggtgtcgttgctgcggttctgtgagggggcgctgcccgcactctgcctcctccaaggctgtgggctgtttggtcttgcaggcttgcacccccgaagtgaggaggaagcctgtggggcagccctcaactgtgggacaggaatgggggtcaatgccacccgccctgtcttcagtgaggaccacactgtggaaccagcgttgtactgttctgtcctgctggcctttgtcaagtggtgtttggatgaatcgtgttgtgcccagtccaaaatcagtgaggcaccatgctggggcccaaggtgccccaggtctagtggtttggaaggaatcacaggactcacgagtggttctgctgggctacggtttactagagaggactttccatggtgtagtgtggagaaaagccttgcaggttacaggaatagcagaaacaccaagaacagcaccaggaacaataggcagaagcaccaagaacagcaccaagaacaataggcagaagcaccaagaacggcaccaagaacaataggcaagagcaccaagaaaagcaccaagagcaataggcaggagcaccaagaacagtaccaggaacaaaaggcagaagcaccaagaacagcaccaggaacaaaaggcagaagcaccaagaacagcaccaggaacaataggcaggagcaccaagaacagcaccaagaacaataggcaggagcaccaagaacagcaccaggaacaataggcaggagcaccaagaacagcacgaagaacaataggcaggagcaccaagaacagcaccaagaactataggcagaagcaccaagaacagcaccaagaacaataggcagaaagcaccaagaatgtggctgcctagggctgggtgcaaggcaggctgggagggggctggggagttgagggcatgggaaggaacaaggggaaagcacctttgtgccttgtaaggaagttttggcttcatacagaagaggctgcatgttattggaggattttcatttattttttaaaatttaaattatgtgttttttagaaacagggtctcactttgttgcccaggctggtctctaactcctgggctcaagtgatccttccacctcagccttccaaagccctgggattacaggtgtgtgagccactgcgctggctggaatgattcacttttaattgtaggagagaggagaatgaattggaaggtaaattacttaatgctatggagactccttaggaggcctttgaggcaagagatggccaggcggccggggcgtggggagaagcccagagaggcttctgtgaggtgcaatcaccagcgtgtctgtggatatcatggtaggtggggagggggacagtgaaaaggggctcagccttagagtatcaagtatgaaatgtttgtgtgatagaggttacaacgtccagaaagactggactatgaaggtggaactcttggaaaaagtgtggaaacgtatttaggaatcattcctgactacagccatggctgtggagagacgaccagacagaggatgaagcgtgggaggtgtcgatagtgaaaatttggtagacgctggtatttcagtggcacgtgggtgaaaacaagccaaggaaaggaatcaggagaggaggatggagagtagggaaacaggaaggaactgggaagagggattgcagaggccgatggggaagccttgagcatgtaacagatgatgtagaaaggcgagcatggaatgaggtggaaaaagcccctgggactcgcctcccattgggagcagtgggtgatgcagccaaattgagtgagaagggaaactggtctgtaaagttcttcctgatgttgagatgctggattttaaaaattacattcgcacggctgggcatggtggctcacgcttgtaatcccagcactttgggaggctgaggcgggctgatcacctgaggttgggagtttgagactagcctgaccaacatggagaaaccccatctctactgaaaataaaaaaattagccaggcatggtggcacgtgcctgtaatcccagctactcgggagactgaggcaggagaatcacttgaacccaggaggcagaggttgcggtgagcagagaacatgccattgcactccagcctgggcaacaagagggaaacactgcctcaaaaaaaaaaaaaaaatacactcactgagagggaaacaccagctggtgcacgcggccgctttgtgtgcccggggctgcccctttctctccgcatcccagttctcctcgccatagtgcaaccttgttctgcctgctgttttcggatcatcgtctttgtcatcgtaaatgttcggcacaaattaggcaagaaacagtactgtggagataaaataagagtggtcacggaatcctcttcttcagatgattttctttcctctggctctgcagaggcctcatgatgatgcccctgagagagcgggtccaggagcagcaaaccacacacgtgccagtgactttgaggcaggcggatggtgacagttctggaagtcagccatggctgttacatctgcgagatgttttcctgttaaccaaatggatggggcaggttcatcctcttatgttttattttcataaatatcttccaaatgacctcattagcttaagtaacgaaaaagcaaattccagtaaacagctgcatgcatgttgatggatgatgtgtttggaaagtaggtatccttcttttgtttctctttgacgcacccgtgagcactgaggaagaggtggggttgctgcacacatggatcctttttgccagtgggaggcatcgccatcacctggggtgcagggatgtgtcgtgtctcacagggacaccctaagtggacacagctgagatccttctctttcatggaccacagaggtttaattgcatcacaaacatctgaggaacacccctgccaggcccatgcttgttcagggactgggcagcccacgtcattctgaggaatgccctttgctgccatcctggggtcatctccatgcagctgtgcattctccgtcactccctctctccagccgctccccttcgtggccatccctcctcattgataaacgaggagaatgtactgctgtgttttcaggggctctccacaaacagccagaggtataccaggtatacctgtgatgaggtaagaccatcctcagcagacagaagagaaagattagggccccctgaataatccttctatgtcagtcctggacgaaacagcaagctgttactgattgagggttgtaggcttccatccgcctcatttgatgcccgtggtgttgatgcagagtgctgggtgctttagagctaagacagacctgtgcagtcatcgtgcgttgataaagcctgtagtgagagggcttcaaaatcacaccctttgaaatatcaacttagtgtatcagtggcttttactgagctttgaataacccataacttgtataatttttcataatgggttaaaaagatgttaacatgttccttgaagaaaatgtgaaacacagataagcagaaaaggaagatcaaaggccaaaacattcccgctgcccggcacaaatgaccactggtaagtttcggggctgccttttctatcttccacatttacatcttgttttttaaaacttaatgtagcataaacctatttctgtgttaagaagtattaacctatagcattttgatggcttcatatattctaccatgtggctatttctctctctgtctataataaactatttttcaggacagttttagatttactaaaataactgaaggtagaacagagagttctcatatcttcacatccagtttcccaattaacttcctacattagtacacagtttgtcataattaaggaaccaatgactgttatgtgactgttaactaaattccctactttatttagatttccttagttttcacctaatgaagtttctctgtcccaggatctcatccaggattctaccatacatttcgtggtcgtgtctcctggggtcctcttggctatcacattttctcagactttccttggctttgaggaccctgacagttttgaggaggcctggtcagtctgtagaatgtcccctggcctggatttgtctgatgtgtttgagttctggggaggaagattggggtgaagtgccttctcatcacatcagatcaaagccacacactcagtgtgcgccatcatggtggataccaactgtgctcagtggcttggtggggagggttgcggcttctccccctcaccccgcttccctctttccctgctgcactctctgagggaaggcacagtgtaaacccacactcgtgagtgacgcgtcatgctctgcttccttgaaggcagaggatagacagaaattgtttggaattctgcacaggagatttgtctctttcttcccatttatttattcaacactttatgttatattttgggctataacataacacttttcattttgtttgctcacattgttccagcttcggctgccggcagcccgttccgtggcctcacacaaactgtccctttgaatacgtccatctttatggctttttgaaaacacttccttcctttctgacactacaagaggctttaggctcatcttgtgtatttcctgtctcagtcttagaattagccatttctccaagcagtcccagtcccttctatctgagaatggttttggaaatcaagtgctgggcgtggtgtgtgctcattactgcggggatgtccttgcctgtaggacatgtcagctgacggagcgagaagatgtgtgtgtgtgtgtgtgactatgcatgtgtgtgagtgtgtgcatgtgggtgtgactgtgagatctaggaatatacacatatttataaatatttctgttaccatctgtatctataccaagctaaccatgagctcttattcacgtctccaactccaggctcttaccatgtggattattccagacgctgcctcctgcttacctgtaacctccactccaatagggagaacttcctcctgccacctgccagctgttaacctcattgttcactttgcatgcatgtgtggtagagtcagaattgctagctggtacctcttgggaaacaagtttatcagctagagcacagtgcttatagacaggatcttttcctttcagttttacaggctctgctcgtttccagagctatgtaggtcagcactttttctcctgccccgttggtgtcagtggcttcacacatctgtgatgctgcaggattctgtcatcaccgtctgcatggcattctgtcccgggatctgaagcatccttgattttttttgttaaacttgcataaattaaggctcctctttgtgctgtgaagttcagtgggctttgataaatgcatgtcatttatccacagttacagtaacatagaaatagcctcactgccctaaaaaaatcatctatttcacatactcacatctcccttcctctcccggaatccttgacaaccactgatcttttaaatgtctctatagttttgccttttccaggattttcagactggctgctttcacttagcaatgtgcatgtgggaaccctggctctttccggcctctgtgagaacaacccgtttgtacccaaggagctgtgagcatgctgcctcccaccgtgtcttgcactggtgcccaggggtgtgcggggacatgacgcttagccggaaacatgggtgaagctgatgtgtgcgattgtgtgagaggcaaagctgtgcggccagggttgcctggagaagtttccattttccaagcaaggcacagagcatgtctacagagacaggtatgggagggatggcaccagcctgtgtggatggcctcctttttcgtgttgggacccttgttctttgttctacaagatgtggatggtttaggagaactaggaggaaaaagcccctctgtgagccgtgggttctcccttccaagttctgcacaggttgatgtgatgtgcacgttcgcatttccatagtctctgtccgatccacttaataacatcacaaaccacactgctctttaggtcttggcccaggacccaggatagggggtaaaacttgaagtgcaaatagcattgcgtagccatcctgaccacaccagcgcatccagctgcctctcgacattttgaggtgaggagggaaaggaaaaggtaagagcatgaagggtagacacggaggaggtttcactgccatcttatctcagaggtgcagggtcaaaggtgccagaaaatttcatctggcatttcttgccgtcaactcctgaccaactgttttcaatattttaacttgagaaaaacaaattcaaatcacctattgatgatagttctattactcaaggaaggttctttgccaaccccatgtgacctcacatgggtggcaggaatcccctgtgggaggctgggaaggtacattccttgggcctcctcgacgacagccctcccactgctgggaactcgacacatgtcgtttcccagcaagcggccctgagaagaatgtgatcctgcaaaacgccctcagtgtcctgtcggcttattctttacattcacatccgacctgtcggcttattctttacattcacatccgacctactcatagttttctctttctcttcttttcctcagtttttaaagaacatggctgtttctcttacatggaattacagtattttttatcaaataggagaatttctgatatctgtgaattattttgtgattacaatatgaaaataaaagagaacagggttaggaatagaagagggagttcaaaaggatgcaaagaagggtagaatctttttaagaaatgaaatcttggaaaagataaaaactgaagagagtgagatggtcttagcctggactctgggtgagagagagagagagagagagagagagagagagagtaaacacacacacttagtgtgaatgaggtttttgtggggtgcgaatttgagaaagcgtcattaattcactcatttctttagcagctgtctatgagcacctggtgtgggtgccgtgggctgagttggtgaaatgtttcctcggagcaccctgggcttctaagttgttctgtcattggggctcccccagaacccaagagggagaagccgaggatgccaagttgtaacattgaaactatgttaaatattccctgatagaaccgggcccagctaaatgtgtccccgcacaccaggaaacaggtttaggggtgtggccttgaaatctggaaagtacaggctctgaggtgtctctctcagggtgtctccactgatccaagatctgcgaacactgtctccttagcagctctggggaatgggcagcttggttgtgtgtgcctgttcttctctgccgagagaatggctttttaaggcttgacttgtgtctcgtcctctatcttcgtgctcccctcatagcctggcctcaagtgtacatttgagggccatgaacatccttgagttggtgcttgccgggtggaatgactatctaagatgcaccaaatcacttacagccctctcggccatggaacagagcactgcaagtcaccatcctctgtgtgcatgccagccctccactgccactctgcccgtgtggcctcaggcctgggcaaaggacaggccctgctcccctgggccacctgcctgtgggcgctgacagacgtgtggtctcttctgctagtgtgttgtcagtagagcccatgacagagatggaaatgaggctgggggatcccggaacaaagcagatgggctttggggtgactacgcatctgtgctattctgattttggctgctaagctctggttctgtgtcaccttgatctttaacttgggtttctagaaagaagagatgaggactggacaccaagtcccagtgtggcctgaatggcagacttgatgccaggatgctgagctctttcctgcagggtgggtgcatggcttggagaggcctttagatgtgctgcctgagacagccccgctggccctgactgcagggtggaggggtctccggctccagccccgattgcacgttagggatcagggagcactattcattcttccgatgctgtgactgacgggccggcaaggaaaggaagtggatggtgcatttgctgccgcctttgagcaaggaccctgtgagctgcagcctgtccactggtcccgcctgctgggtggaggctgcgtggaggctgtgtgtggcgcctctctcttcaacagaagctcatccttctgctctctctctccctctcccctcccagtccccatcttcttcctccccttcttatctttagaaaccacccacctccacccgcatcagcttccacctctgaagagatcttgcaatccgaccccttgtgagctcagcttcctgcgtgctgaggccccctcctgagcatcccacgttgccctgacacccacaggagcagagccacttccgcacctgctccgagcgtcccacgttgccccgacacccacaggagcggagccacttccgcacctgctccgagcgtcccacgttgccccgacacccacaggagcagagccacttccgcacctgctccgagcgtcccacgttgccccgacacccacaggagcagagccacttccgcacctgctccgagcgtcccacgttgccccgacacccacaggagcagagccacttccgcacctgctccgagcgtcccacgttgccccgacacccacaggagcggagccacttccgcacctgctccgagcgtcccacgttgccccgacacccacaggagcggagccacttccgcacctgctcctctccagctccccacaggctgccttcaccacacccctggagctgggtagctcctgtgttctttcagttgctgagtcacggccacaccctcgtcctgaccctgacttcccctgttcctcctctgtcatcctggccctgatgatccatgcatcctcctcactcctgactctccttgttctaatcagcttggacaggtgccacatacaccttctcagatgtcccctcactgctcagcagcctgtggaagcccccgctgactggttcaattcatagtcctgccgaccatcgaaagctttcggatgaccacagtgtcatctcctgccccctgcccagcgtggggctgtcccctggacggtcctcactgacctccatgcctgtggtctcctgccgcctgcccacctgccttctgcccaccgtggggctgtcccttggatggtcctcactgacctccgtgtatgtgatttcctgcccagagcagggctgtcccctggatgttcctcactgaccttcgtaacactgtagcgctgtcccctggacggtcctcactgacctctgtgtatgcaatttcctgcctagcacggggctgttccccggatggtcctcactgacctccatgtgtgtgatttcctgcccagcgcagggctgtcccctggatggtcctcactgatcttcatgtgtgcagtctcctgcacactgcagcgctatcccctgggcagtcctcactgacctccgtgcatgcggtctcctgtccactgcctgttgcagaggctgttccctggatggtcctcactgacctctgtgtgtgcaatttcctgcctagcatggggctgtcccctggatattcctcactcaccttcatgtgtgtgatttcccgcccagcgcagggctgtcccctggatgttcctcactgaccttcatgtgtgtgatttcctgcccagagcagggctgtcccctggatgttcctcactgaccttcgtgtgtgcaatttcctgcctagcacggggctgtcccctggatattcctcactcaccttcatgtgtgtgatttcccgcccagcgcagggctgtcccctggatgttcctcactgaccttcatgtgtgtgatttcctgcccagcacagggctgtcccctggatggtcctcactgacctctgtttgtgcaatttcctgcctagtgcggggctgtcccctggatggtcctcactgacctccatgtgtgtgatttcctgcccagcgcagggctatcccctggatggtcctcactgaccttcttgtgtgcagtctcctgcacactgcagcgctatcccctggacagtcctcactgacctctctgtgtgcaatttcctgcctagtgcagggctgtcccctggacggtcctcactgacatccatgtgtgcagtccttgccccacatccaagccctgggtcctgagagatcctcatggatgcctgttctgacccatagcttacccacccctctccctgcctctccacccttcaaacctagctcagagcccattccccccagtaacctcctgatgttcctcagctgaccatgctggggcctctctagtcaggttggaatccctggtattggccagccatcaaaccaccccgaaccagagcggtgtccttcatgattggttgtggctgctccgggctgggctggccctagtgtctctgcccatgcacctgccatcctgctcttgcaaccatcgggctggcccaggtgtgtccttcctatggcgatggcggaggggcgggggagtgaggagacacccaggccttcggaggcccccggcatccgccttgtcatgtcacagctagccagtggccaagcctgggtggaggtggggttgggggaggatcggggcccttcctgccagtagccacactcctccgtggctgtcaccatcatcacaccactgccttggtggccaaaagtccactgttcatggggctcctgtagaccccgggcctgtagggctcccattcaaggagaagacggatgttaagcaaaataaatgaagtgtgggtattagatgcagtaggtgctaggcgggaggtggcctgggtgggttcctctcccgtgtgcttggctcaggaagcctctgaagtgctttgctctgcacaattgccaccacacctgtgtggccggtgtcacttagtcattctactgaaggaggacaaagctgggctcaaactcaggttcaatcctcagcctcactgtggagcccgcagccttggccatgttcttcatgattgctgccagtggcagccccacctgagtctggcacctccggggagaggggacttccttgtgtgtgtctcactttcctgtgttctcctaatggcccgcctgttccactggggttgtccgacgccgaagcctcccatggagcctctgctttctctgtgcttccccacagaactcgccctctcccagctgcacagtgtctcagcaccggccttgtgtgccctgtaccagagcacgtcccaagccctctggaaattccagctctttgccctcctcaccctctgcagccctgaggtggcccctcggccatcacatgtgaggacgcgcggtgggctctgtgcttcctgctgtacccggtgcagcgtctgacccactgtagctgccaggtggtactcagtgtgttgttaacagccaccacttgggattactggatgcctgcttatggcaggcactatttgggctcatgttatttagcaccacattgaaccccttaaggacgcagggcatggtgatggcatacacgtgtacggtggaagaatcagggttccaggagtgaggcgcgtgctcaggtcaccccacccccctcccaccccggctcctccgttccctcctacttcacactccttttcttcctcttcctctccccattccctcttctcactgtccagggcagaatgaagtcctctaaaccaaaaggcagaggcagaaatacatgctttcaaattaaatgtgcctttgtgttacagctcaggattttaaaactattgttatttaaccttaggagcctgttgacagccctgcattaatttttctctggtagtgaacgggggacttggacaccacacaggtgttccattgtgcatgattagatgtcacctttgtagagaaggaatggcctgggaaccagccaacagagagaattctgcacgctcatggagcacacacagctgcacatggaacgaaaagcttttactccgtcttggtggttctggaggtggcagcaaatcgcatcagcaggtcccaaagcatggccttgcctggaggcttcattttgccagaagtgtcccatgggtttatattattttatttcatttatgcatttttttgactaacagtggttcagacttatgcctcagtgatatagtgggaaaaaagaggcaggtccctgagtgatttatgatgcgatgataatcctacctgcatcagagttcatgttttaacttttgttagagccttggattttcccggcaaccctatagggtgaggaggggaacatagtttgcattttaacaaattaagaagctgaggtttcaaggttcactcatattctgttggtgacagggcaatttggcaagatattttgaaagtcttacatatatacctttaaaatatctagaattctttttatgggaatgtatcctaagaggaaaaaatcagagatctctccaaggacttacaatcaagattgcgtattgcagtattatttttaatgggaaatattggaaacaatgtaaagtttcttcaagagggaattggttagctagatgatgtgcatgtgtagaaatagttattaagcagtgattaaaattcatgatgagaaatactaaggacagggaattgttcacaatgtgttataagtaaaaagtgcaggttataaagttgtgtgtacacaacagcagagacatggaaccaacctaaatgcccatcagtgagggactggataaagaaagtgtggtacatacgtacacaccatggactactatgcagccgtagaaaagagtgagatcatgtcctttgcagggacatggatggagcgggaagctgttatcctcggcaaactaacacaggaacagaaaaccaaacactgcatgttctcacttataagtgggagctgaatgacgggagcacatggacacatggggggggaacgacacagactgggcacctgttgtgggggtgggcagggagagcacaggaataattgctaatggacgctggcctaaatacccaggtgaggggatgctctgtgcaggaaaccaccatggcacacacttacctatgtgacaaacctgcacatcctggacatggaccccaggatgtataagttggacaaaaattaaaggtgtgtgtacagtatgaccccaggtctttcatatatgcaaagaaaagtagctgaaaaccaaaatattaacaaggaatttatctctaggtaatgagttaactggtattgtattattctttgagattttctgcattttcttaattttctaggcttttatgatataaaacaattcccaataattttttttccatttttttttttttgagacagtctcactcttgtcccccaggctggagtgtggctcactgcaacctccgactcccgggttcaagcgattctcctgccttggccccccaagtagctgggattataggcacacaccaccacgcctggctaatttttgtatttttagtagagacagggtttctccacgttggccaggctggtctacaactcctgccctcaaatgatctgcctgcctcggcctcccaaagtgctgggattacaggcgtgagccaccgtggctggccagttcccaataatgtttcaagtgaacaggtgcagacagagtgagtgatttgtccatggtaacatgactaatatctgtaactttttgttcgtaaccaggagctctttccattctctcagtagaatcatcagtgttcggtactgttacttccaagtcctccattcttgtggtgccggctctgcctcttcagagatgtgcaatgaacggatgcttccagtttgggaaacctggtggggagacaggccgggggaggaaggggtgccatccttccatccacctcttctgctttcttttttcctacttgtttcagtgagtcagatgaagacatcaaggacctgttgattaaacctgcacatggtacacagctgtgagggtagagagaagctggtattgtgacattagagtccagaaaggtttagactgggtatctgagtcaaatgtgagtttggaattacacatggatgagaagagagtcccatcctggagtcaaggggccagtggtgaaagtcatatggacacagtggctgatggacacagtagttgatggacacagtggctgatggacacagtagttgatggacacagtggcttatggacacagtggctgatggacacagtagttgatggacacagtggctgatggacacagtagttgatggacacagtggctgatggacacagtagttgatggacacagtagttgatggacacagtggctgatggacacagtggctgatggacacagtggctgatggacacagtagttgatggacacagtggctgatggacacagtagttgatggacacagtggctgatggacacagtggctgatggacacagtagttgatggacacagtggctgatggacacagtggctgatggacacagtagttgatggacacagtagttgatggacacagtggctgatggacacagtagttgatggacacagtggctgggggtgagggaaaagtggctcagcgtgaatttgacaagaaaagaatctattttctattgtaaaatcaggctgtggaatcaacagcgtggtgtgtggtgacgtccaggtttgggtgtgtccacctagcctcgctgtgtgaactgggggatgtgagaccacttgacacagccttttccgtgctccaggggactcggcaagtgcagccgggaggaaggcgtcccgaggagcaggggtggggctggtggccatggacccctgaggggtggctgtgtccagggctggtccagatgtgatggtgctgtgtggttgtgacagtgttctggtgggcacctgtcttgtttcctgcccatttctccaagtcagttttctaaccttcttttgatcttgtgaagaacctgatctccttctaataaatcaagagttggctaagtttttttgtaaaaattgtttcctttcaggccagtctctgtcacaactattgaattattataggacaaaagtggccataggcaatctgtaagcaagtgggcgtggctgtgtttccataaaactttattaatacagaaacatatggcagtggcagaccatggtttgcctaccccagagcaagccagttcttcttgtgcttgaagctgctgagatcaatttctctcacttttctcccggccctgggatggaatcaagctctagggagaggagcagagagtcggaacgaggagaggatggtgcgttttactccgtgacggctttatcactcctgaggctttgtgttcagtgctgacactcgcctcaccttaaggcagttcggacatcgcaggcatccgcagagctaggaggatggtgacgcggttagaagccacgatgtgagctgggcgcggtgctggtggctcaggctgtctcactttcaggggtagaacttgactctatgacactaagtagatcgataatgaaagctccaggcgggtcaacatatcctcaataaataaaacttcaaaaaatccagggctgccgaaacacgcgttggcctccttggtgacttttctgcctggctacacagaaaaggccgctgtgacagcgcctttggtggtctctgactccaacacagggtggccggggctctggcactgcccctccctctgctgtgctgtctggaggcaggaggtccccccctgcgactgctgacagagctgtcttcttggatctgcctcccagactggggacagggttggaagattcacaagaaggcagcctcagcctcagcctggcgttgtgtcggggatgggaacagggcttcccagcagaaggcaggctgttctcccgttcaggattggcccattgatcacgtcctgggtgcaggaatgcgagcactggggcctcctgaactggggcgctccatctgctgaaatcggggggtacagaggctctgagacccttggagtccctgggcagtgctctgtttgcttggctgtagccccgggcggggagagggtctgaggataacttaaaacacaagagatgataaaactcatctttccttccaggaaggagtgatgatttcccctctgcggctccgcaagtgggttgttgctgctttgcctgggaaggcacgaaaatgtcatagttaaaaaagctttaacataatgaaaatagaaaagcaccagacttcataaagctgataacattcccattaccggaagggcgccctgagtgctccgagcctcacacatttggactccgagcgggaggcgggaagccgcagagcccagctcccagcggacgtggcccggagcctgtcacaccctcgcgtgtgcaagccgcttgcctgacccgccgcgtgaggagcgcggcccagcagcaccggccttgcctgggaactggttagatatgcaggttctctggcctgctccggacgcattaggtcagaaactcggggactgggccccgcagctttgttctaacaggccctgcaggggcttaagagcgaaaaccgttgggctggatggcgtttaacagccctggtcacgtctttcaacttcagttctgttgtctggtttgctgcgccccagtgagaggcagcgggtggacgtttttgtggctggggcgtttggcagcgtctgcaggatccttcctgggaagccagcgtggccctttggaatagtgaaggttcggagttccacagagaagagtgtgtgaaacttcaactcacatttttcaaatgtttttgagcccaagcctggttttgttaacgacccacagcacctgtgccctccagagctgccaccagctgagacttgctaattccctgggggacttttacagagttttaagtagtttttcttctttgttctgtgtcaattaacctgtatctacagtggacggtagtaattcccagcacactggaaatgtagcgagctcaagaggaagataaaaagaaattatttttcaaattcacctcagactatcctcctaaagtgtcagtcccatcctctgataaggtctcacgtggcatatccagttgcctgtagcaaatatcagggttaaaaggggaaactgtagtaacaattggatctaatttgtcttttcattattgtaagtgcagattcctctcacccacaatgcgagtggtgtttgtggacaggtgtctaaaggagcagaaggcaatattctttcctatctcatcacttaaaaataaagttttcaaaataaaccttttttttttttttttttagctcaagtgtaagagttctaatcatcagggccaggaagcagtttttgtcttttaaatcttaattaaattacaatgtatatttaaatatacatccagtcttaaaactgaacctaatacatttgtaaaaattagttgatgtatgattttccccacataattaatttaaaattatacacacacacacacacatacacacactggagggtgtgtgtatatatatatatacacacacacacacacacacacatacacacatatatttgagatggagtcttgctccgtcacccaggctggagtgcagtggcacattcttggctcactgaaacctccacctcccaggttcaagtgattctcctgcttcagcctcccaagtagctgggattataggcatgcaccaccatgcccagctaattttgtattttttagtagagactaaacaccatgttggccaagctggtcttgaactcctgacctctaggcctcccagtgtgttgggattatagacgtgagccactgggcctggcctaaaataatttgtataaggccaatcatttgttatccgggtgatgaagaatttggatccagaaaacaaattgtaaagagtttgttaaatttacttttaacaatttttataatgtgctgacccaagttttcaatttacggatgatttctacatgtgatgcccttgcttctcagtgtggtgggcagcccagcggacgagtcaccagggagtgctttggaaatgctgaatctttggctccgtcccaggcccagggaatagaaatactcatttaacagggcccagctggttcacatgcacatcaaagtgtgggagaggctgtttccatgatgatgatgatgatgataatgatgatataactcacatttcctaagggggtcttgagatgataaggtctttttgttagagggctttggtgctttaacaatgactgagaaactatgaactggatttttcctctttcatcagagactacaactaagtcagcccagtactgctaaaaagcttgtttaccttttaaattatgtgtctgaagtaccacatgtctaaagttcacgtttacagcagggtaggctgtgtggttcacgtgtgccatgtctcagcaatcctgagcaatacatctacctttcttcactttattctcacttttggtactgttctttcatgggtcatactatattttaatccagcacatgagagttaccggttgaagttctctgagattagcttaaccatttcatccccggcatagcctggctacctgcacctgcagtatttaatgttcaaggattttcatcagatactttttcaaagcttgtctttaactttttatctgtgaaagcaaggttagaaatgttttcttagtcccgaagaatgactcagcaaacatccttcttttgaaggtattatcccatttcaggaaatcgaggacaaaaaaccagagccgattaaaaaccaagagctgattaaaaccacgtgccatttagaataaatatagttgaggttgctgctcttaatgtcttcaaacgaatgaaggaggaatgtgtagcatggagagcgcggttcccaaaaagtaactcctggactttaaaaataaaacaaacaattctggtaggtatcctgaatttggtacaatttcttactcttaagagagtttaaataaatctgtgcaattaggaacctgaaataaggaaattaatcaaagtaagaggttttgtttttcctaaaaataaatgacaggacttgatggttgtcctggtacccagctcgctgcccttcttccagggtggagtgagctggttctttttctgtgggaagctgattttgtgaacaggaggatctgaaatcaggaactgccttagaattgtggccccagcttcaaacaagaactgactttacagaagccaaagacgtgaggaggaccttggccatttcagcctctgctgagcacacacatcaccgttgtgatggagcggactgaccaggcgtatggggtggaggtgaattggaggggcctgagccccaaggatccacctttgcagtaaggcacggtcactcatccatgtttgtgtgtgccctcccagctcctgctcatgtgtgacatctgtgcccggcagaacaggcccagcatggaaggagtgtgagcctcaggcccctcctcccagcacaggggacggacaggtgtccccgcaggaacagggcccagaggctgtgcagggggcaggccctcatgcctgcaggagaaaccttggcctgaacttgccagcggtcagctcccatcgttcatggcaattgagtgtgcagcggcgcagagaacatgccacttaataactgttttggggtcctgccttgtaggtctaagatccaggccaccgtgcagtcctcaggatggggcacccatcttcctgctctctgaggcattgaggctgaagtttccagaatcttctgggtgattatccctcctcctgctaccaatttggctgtggaccctcctctgcgaggaatgcagccatgtgtgtcaacctccagaaatgccctgcgctgagagtgtggccaaggcaaggaagggacgggtccccaaaacgctgggctggggctgtgattgaaagcctcagaattggggaggacttactggggggctccatactctggatcggcaggtgaaggggactgagcaacacccacccctacgtgcagtgggcagggtggggctgggtcacctggccaaggtggggctgcatgtcacccaacggagccccttgcttggcagcccagggaagggggaggggcgcagggaacaaggaaggggcacagggaagggggaaggggtacagggaagggggagggggctcagggaaggggagggggcgcagggaaggaggagagggagcagggaagggggagggggcgcagggaaggggagggggcgcagggaagggagagggggtgcagggaaggggagggggcacaaggaagggggagagggcgcagggaagggggagagggcgcagggaagggggagggggcgcagggaagggggagggggcgcagggaagggagaggctgcagagaaggggagggggtgcagggaagggggatgcttcagggaagggggaggcctgcaggaaagggggagggggcacagggaaggggagggggtgcagggaagagcaaggggtgcagggaaggggaggggaggctgcagggaagggggagggggcgtggggaaggggagcagggaaggggaggggggcacagggaaggtggagggggtgcaaggaaggggaggggaggctgcagggaagggggaggggtgcagggaagggggaagggggaaggggagcagggaaggggagggcggctcagggaaggtggagggggcgcagggaaggggaggggcgcagggaagggggatgctgcagggaagggggaggcctgcagggaaggggagggggcgcagggaagaggaaggggtgcagggaaggggaggggaggctgcagggaaggtggggcgcagggaagggggaaggggagcagggaaggggagggcggctcagggaaggtggagggggcgcagggaagggggaggctgcagggaaggggagggggctcagaaggggggcgcagggaagggggaaggggcgtggggaaggggcgcagggaagggggcacagggaaggggaggggccacaggaaagggggacgctgcagggaagggagagggggcacagggaaggggagggggtgcagggaagatgaaggggtgcagggaaggggagggaaggctgaagggaagggggaggctgcagggaagggggacactgcaggggttgtccccagactgggactgggctttcagggaagcagtcagtccctctcatgtggaggtgggctggcttccgtccaggccgctgccaggtcccttggtcataggctctcagcagaggggctgagcgctgtctcctgctgccccctgctgccccccaagccctgtccgcaagccacagtcagggatgggcaatcaggcctggcaggagctgccagggctgcctccctcttgtcagagacagatctgggaggagccttcctcctccctctctccctcttccttttgtctttgaaattgcaatcacagctttcatttgagccttgggccacagaagccagatgccctgaccgcagggctgcctgagatgagggtctgggggtctctgtcctcccacgcccagcctggcagaggcagccccgcctccgggctgaggcgctttaatctctcacttttcaggctgattcctagaataggggttcttaatgtggaaatggctttctattcctgcctggatgccgccctggtttaacacgttgttttcgatccgatggaaacatttagaaaacctcagtggggtgtggggactccttggtcccaagggtctgtgctgccaggaggggatgctgagattggggggtagctatggcccaggcaatgcccacctgccagcaggcaggcgcttcactcttaccccccctgcagtgggcagggcgcatcctcatttacatctgagaatgcaagggagaagggaggctttgccaggtgcatggctttgtgtttgctgcagaggaggtggggttggagcctgggcaccctgctctctctccagaatgttaaaaatgaggatgatgtttaaaaagagcatctcttcaaacactgcaccttccttttctatgatgatgcgttcgttcctaggaaaaaatgtgatttaacataaccccagagcctcaggctgtcgtaagccctagcgttttctgcagggagaggtgggaaacatggctttgacaggaatcacatctgggatgggctctggcattgaaacccacggtggtgagactgccactgctgcaggtgacatctgtcatcaaaggacctgctccaggcagtagggactggggttcctggggtgctggcatggttttttttaaggctgtagagggggacaggacaaagacacagagtgactgacagtaacagggtcggattgggcgtggagtctgtgagctctgaagagcgggggaggctggcggggccagggaggaaaaggctgggtatagattacttcactctgcttcgttatattttttagatgaggaaatctgtgtgtgttccttgtaccaagtgagtggtgctgacacaggtgaagcccccgcatccccttctcaggggctgtcccagttcaggttcagcaacttccccaacagacctgcatctccatgtttgcacagccacggggtcctggcgttcccgttgctgtgtgtgttggtgctgtctgggaagatgctttcctgtttgcagttggatcccagggccttggtcattccagcctcaaagcagggtcttcagtgagcccctctcaggaagggtgattagtgagtggccagcagctcacaggcttctgaggagtcctgtctgcagcttggaggcaacaggtgccggtgctgagcctgctgtccaggaacctcccctcctccctctttggttcctgctgtgggatgccagctcacatcagctggattttatgggcctcagtggaaagtgtagcacacatttcagaaggcgtgtgcatcctgctgctgatgacagcctttctctgccctcatggcagtcaggcgagaagcctgaacccaggaagggccttccacggtggtggtagagacagggttgggcaggggccatggatttttaggccatgtctgccttggccacagcgacgcccagagatgggaggaagcagagcaggtgcatgtggtacaggatgtgccgagcttcctcccagccagtgagagaggtggtgggctctgttcacatttactgtatttccacaatgaacaacaaactctccataaacatctcttaggagtgattggggtaagagaggcagatccagcctgactccttgcaaaactggatccattttcatcttgagaagggtaagaaaaaaggggcaccacaatggtgacaagatactgcttagagttctgaggacacagtagggaagcagaatcagaacaagatcagcatgcatgagtgtacccatgtacgtgtgcatacgtgcacccatgtacgtgcatgcatatgtgtacgtgtctgcaggtgtatgctcacatgtatgagtgtgtgcatgtgtgtatgcatgcaggtgtgcgtgtatgtgtgcaggcatgagtgtgcctgtgaatgggcatgactgcatgcatgcatgagtgtacccatgtacgtgtgtgcatacgtgtacgtgtctgcaggtgtatgctcacatgtatgagtgtgtgcatgtgtgtatgcatgcaggtgtgcgtgtgtgtatgtgtgcaggcatgagtgtgcctgtgaatgggcatgactgcatgcatgcatgagtgtacccatgtacgtgtgtgcatacgtgtacgtgtctgcaggtgtatgctcacatgtatgagtgtgtgcatgtgtgtatgcatgcaggtgtgcgtgtgtgtatgtgtgcaggcatgagtgtgcctgtgaatgggcatgactgcatgcatgcatgagtgtacccatgtacgtgtgtgcatacgtgtacgtgtctgcaggtgtatgctcacatgtatgagtgtgtgcatgtgtgtatgcatgcaggtgtgcgtgtgtgtatgtgtgcaggcatgagtgtgcctgtgaatgggcatgactgcatgcatgtatgagtgtgcatgtgtgtatgtatatgtgtgcacatgcttgtgggtgcatgtgtgtatatgtgtgcacatgcattcatgactggatgtgcttgtctctgtgctgaagcaggagggataccctgtgaatacagagtgaggaggaacccctgagcaccacagccctgctatagggttcagcagaggagcaatttgagaatttggggaatgtcacatgttttcatgcaaaagggtggataatacattgaagtgaaggaattccagttttaagtgctgggcacacaaggttaagggccccacaggccgctgttggctttccttgtggatttagcttcttggcctcagaatgacatctggaccttagtgtatgcagtctgtgagccgacagggtacacaagtccaggatgccacttgccgccacatggcgggtgtggagcccactcgaggaaggcgtgtgcccgaggcgcctgggctgggttgaaccagtgtctgccagagaaaatgtcttttctctggatgatttatggtcataattactattagtaggtggctgatacttaaaatgaaatttgctctttcgtaattttagaacaaataacttagcagtcaaattagcatatccactggctgggtgaaatatgcataacatttgcagctctggtaatcatgtgaaatgctgctgctgtgtttgcctctcaccaaggagtgctgcaggttttccactgtcacttctcatcagtcctctggagtaacgaatcaggttgggcacatgccagtaacaggtggttttccaaggtcaggatccaagagatcatttgatgcacatctcattcagatcacatctaactgtcagccacgattaaggcagagatgggaagaaaacaggggctttcttcccggtgcctctcctagcagagctccgtcatctgccatttccacgtgacaaacatggagttagaacgtgagctgtgtctgcagcatccctgcatctgccttcccccaaggtctctgttcctccacgctggagatgcaccctagaatcctgagcagagtcctgcagctcctgccagagccgggaccagggacgttccacgacatcggactaacctccagcacatctccggtgtggtcacatccttactgctcccagctccttctctgtgcgcctctgtgtgcctggggcgggaggggccctcacagctgaggctctccctctgggaggcagtgaggggagccttggaggtcactgcgtgaggatctgagaggacctctaacctccatgctgaccttttcaaggtcactgcttttgtggggagtggtgtctgcctctcctcctgctgttcaagtgccaggtgtgtgtctctcagaacgttccctgccacgctcctgtaggccgttcacctcctctgcctggctcagacacttgttgaatgaagaaataatgcagagaatgcagactgaatgtggggttagctgatgggtaaatgggattaagaaatgaaatgctggccaggcgcggtggctcacgcctgtaatcccagcactttgggaggccgaggcaggtggatcacttgaggtcaggagttcgagaccagcctggccaacatggtgaaatcccgtctctactaaaaatacaaaaattagttgggtatgctggcgcacgcctgtagtcccagccacttgggaggctgaggcagggggattgcttgaacctgggaggcagaggtcgcagtgagccaagatcactccattgcactccagcctgggtgataagagcaagactccatcaaaaaaaaaaatctgtttttcatgagattgttatttcaaaacaaaacaaacaaaaactcccccaaaccaaaaacaatctctgcttggattggaggctcccgtcaatgggtggggtgtccacccgcctgtgactgctggcaggcgatggtggtgggcactgggctgggcaggcactggctgggcaggccagggctgcacctaggccacctcctgggaggaagcagatcccagccaggggccgccctgcaactgtggaaggctcgtgaagctgttgtgagacgagcgaggctgcctcctcctgtgaactcccagcgttgggtcctgctaggctctgtgctgccttaggtctggaatgacgtttagttttaaagcctccgcacgtgctggtttaaggcaaccaagggcttcctctgtaagggttttaggccagctccctcatgaggaagtagtgactggaaactttaacgtgaccctgggggtgaatccctcagtaattcataactttctccagattcctcagtttctttgttcacccatttgctcctgggcacctgccctgtgccagacacacagagggcatgggaggaaacagtagagggtggaaacaggcgtgtgcccggctcctgaactccaggagagggaaatacacactcaatccacagtcactgcacagtgtggcgagtcccgaaaaggacgcctgggcagccccgggagagtctggggcttccacagggatcttagcggatgaacaggcgtttgtcggctggtgaagcagcattgaaggcactgtgctttgcaggaatgagtgaaagacactgcgcgttcacaccacacctggcctttgctggcggtgcgactcccgcctagtggccctggggccctcccggttctggtgtccagggtgctcacgccctcgcgggagccgctccctagcggggtggtgctttctggacccatctctctgtgtttaagacaggcgtggacgtggagccgaacgccaacctttgccagcctgctcggccgcgggggatgcgtggcttggggtcgcctggccacccaggcaccgcggagcttctggagccccttcctgggtggggactgaggcgctgcctctgccccgcgtctcctccagggcctggcccagccgcgctggcctttcctgcccgtcttcgtctctgctgcctccgctgcctcctttcctctcccgaccctctcctgcgtctcttgtctgtggccacggacgccacggtttgcttcccacgcagccgggctccccgcggagctcgttacctccctggaagcctccgctccccggcgcccggcagccttgcttccagggacgcggtgcgtgcggtgagcacccggtccaggggaggcgccgggcccaggggaggcctcaaggggaggccccggccccgctgctgctcccgcggccagagagtctcctgtgatgacgccggcttgaccctcagcccagagctgtgggcctggtccaggtgagagctgggctccgggactaggccaggaggcctcgcacgtggccgggtcaggggcgcagcgttctggcttcagaataatcggccccatctcggaaaagccgggtcggaggagcctgcttgaccggcggtttctctgaaattcaccagggggccaggaaggcagcctcgggggcacccccctcctcccctccagctgaccgcgtctcttctctgtttccccgcaggctgcctgctcgaggagggcctctgcggagcgtccgaggcctgtgtgaacggtgagtgtggggtcctggctgctgcgccctggtctgcccctctcctgcccgccgtgcgcagcgcccagcctggtgagccccgccgctggcctggagctggggccgcccggggcgcgctgccgagaggaggcggatggaaccccggagccatgggctgcggcctcggtgggtggggagaagaggttgcccgggttctgggcgcccatcgctcgcaccaacccttgctttctgattttgttttgctctgtccttcggcaagtttttcatccttttttaaaaaatttttttgagacagagtctcgctctgtcgcccaggctggagggcagcggggctatctcctctcactgcaaccttcgcctcctgggctcaagcgattctcctgcctcagcctcctgagtagctgggattacaggcgtgcgccactgcacccggctaattttttgtatttttagtagagacagggtttcaccatgttggccaggctggtctcgaactcctgacttcaggtgatccacccgcctcggcctcccaaactgctgggattacaggcgtgagtcaccgcgcccggccaggtttttcgtcctttaagccactgattttcctctcttatcaggcggataagaaaacagtgcaaacgctgtgttttcaggttgggctgaaagcccatgaggacggcagttattatgaaatacggcgagcagcgggtcctgcagagccccttccctccagcgcggtcaggcagagggcatctcccagggcagacgccacccgggcctgtcatgctggtgaactgggcgctgtgcgctctgaacgcgcaggggagggttaaactccagtatcctcagaaaagcgctgggcggagccgcctttctccaagtcaggggctgcgtgtgggcccggggcgcactgagcgaggccttctctttccccagctccctgcgcatctgtcctcagactgtgggcaggagcggatttaatcctagcgaggatggcggggcctgcccagaggcccctcgcacccactaatctctgcacagacgtgggtgccggcgggggactgaggtgcagggcagggcgctggcctggggtgccgccctcctggggcctttcaggacaggcctcccctgcactggtgcatccagggggagccgaggtgaatgcctctgagggtctgagaagcgaaaccgaggagctcgtgcgccctgaggtgggaccagccctgggttccggatggaattttggggctgggggcacctctgtgtctgtgcctaggcagcttctggggtcgggaagggaagccacggtggaggcgccaagaggagagcaggtcctcagcggcggcagcttctgctgttttctcttctttcgggagattcctgtgccgagtgtgacaagtgggaaccggcagctcgtggggtgcagtgtgggtggtgggtgaggttctggcccagcctaggaccccctggggctccctggcatctactccgtgcagctttaatttggaggcagccttaagaaaaatagcgatattgaaaatcctacgtcgtctgcctggactcaacagcttttgatgataatggaagcaggtgtgtgtgtttaatttaattggagccgtaagtagccccagcagaataaaagccgaggctgtctccccggctccttgacaaaggccggcctgggtgtccgactgtgatcattctcagacatttttctcctcaaccttgacttgcctcccagacatagagtcgtctcaacatcatatccagataatgactgtggattccttggaaaggaaaagcaatttaaatgtaaatacacatattcaggccttgatttgtagaaacagatgatatttgattttttttttttatgatgcactgaaggtctaggaaacagcgaagccagtggtgcccagtcttagaaaactgcgctttgcgaggctgacggggagcgataggagaagtggttcctgtgctggctcagatttatggttgccatggtgactggtttagcccgaggctggcgggccaggggtgcggcagcccagggtgcggtggggggcggctgcgagtctagaacattctgtcaccagccgcagggtctctttctctccctctggctcactctctctctttccccctctcttttcttaaggtacgtgtaggaatatataatcttatcaagcttggatatgttttttaaaagcccaacagaggttattaataaaaagaaagtcaaaagataaacataccacctcacacccattaggatggctagtattaaaaaacccctgaaaatcggtgttggtgagaatgtggagaaattgaacacttgtgcgctgctgatgggaatgtaaaatggcgtcgttgctgagggaaacagtatggtggtttcctaaaaaattaaaaatagagtttttaatttgcctcagcaaccccacttctgggtacgtaccccataacacaggaagcagagacttgaagagctgtttgcacacccatattcatagcagttaatgcacaacagccaaaggcgaaagcagcccagtgtccactgatgggcgaatggacaagtgaaacgtggtccatccacatgatggaatagtacgcagccttgaagaggaagtgagtgctgacactcgctgaaacatggggggagcttgaggctgttatgctgagtgaaataagccagtcacaaaaggacaaatactgaatgattccacgcatgtgacgtactaaagatagtcaagttcatagagacagaaggtagagtgatggggccaggggctgggggacagttggggtgtcagtgtttaattggtggagtttcagtttgggacgatggaagagttctgggaatagacggtggtgatgactgatcaacagtgtgaatgtaattaacaccaccgaactgtacacttaagaatggctaagatggtaaattttaatgtgacgtatattttaccacaatatgcaattggaactatgaaactgcagcctctgcacatgctcatttaacgtaatcgaatgcttcagctgtaagggttttaggccagctccctcaggaggaagtcgtgattggaaactttaaagtgaccctgggggtcaattccttggtaattcataactctggagtaactttggttattatagaaaaaactgtaagggttctggaagagaaagcttaagataaagcaatcacataatcctggaacagcttgtagaaaagagagtttagatgctgttacatgggcatcctaaatatgaggaaaacaggtttcaaagaatttttaaagcggatttgatttcatggttgataactttaaatgggacacatccaaacacaggtggtatgtcctaaacattctaaaggcataataatcaactactccacaatagaaaaaaggaaaacaaatctatgaagattaaaatagatcacgcttatgtcgggaagtgagctggtcgctttcacgccctgctggtgggagcatggcctgacgtgatcgtgatggacgctgactggccagcacgttcacgccacataagggaggtggcccgtgacccggcaatctgatgtgtgagaatatgccccaataaaataatccattacccaaaatactaaagaaaacttgaagcacaaagctgctctctgcagtggtgtttgtattaattttaaaacagtagacaaatcattaatattaaacaaaggagaatgcttctttaaagctatgttatggtcacatgattcaaatgttaagcagacattaaaagagaagtgttcaaaaagttgttaataacgtcggaaaatgcaggtgggagaaagtaaatgaaaaactcaggatccaaaactgagcatctaatacgatgacagccgtgcgaaaatgtggatagcagaaaaagctcaaagaaatacaccacactgtgaatagtggctctctctgggtagtgacttttattttcttcatatttctctggttttccagtttttcacgtgagcatgttcctgctaaaaggacaagagaggtgggaaggaggcacatgaaggaaccaccattccctttgagctcagaaaggaggagaggcctgtgcaggaggggtgcagagaggggtggccgagcaggcggggcgcagagaggggtggccgagcaggaggggcgcagagaggggtggccgagcaggaggggcgcagagaggggtggccgagcaggaggggcgcagagaggggtggccgagcaggaggggcgcagagaggggtggccgagcaggaggggcgcagagaggggtggccgagcaggagaggcgcagaggggtggccgagcaggaggggcgcagagaggggtggccgagcaggaggggcgcagagaggggtggccgagcaggaggggcgcagaggggtggccgagcttctaagagtgcgtcaggacgaccacaccatagcgctggagcccaggggcggaaatcccggacgtccaggagggcaagaggagcaagtcgcgctctccgtttggagggaggtggaagaatggtgactgacaggtgggggaggatggctcagctacacacctgtcggctccgtgtctcgtggctcaaggctgaattatgctgtgacgacccacaagccctgcgctcggtggcccaggtgacacgggcctgcgggccgttgcagggtgtctgccttccctccgcaggtgccctcccgggacgctggcggccggggccacagcaacagcggctgggaggggtgcccttgcgctcgtggctcactccgccggccacgctgatggtggggaggctcctcctgcagccgactccccgtggcggcgtcacagccacagccttcacgtctccaactgcagcttcttctattccaagccctttctccactgaagagggcagaaaaccaccaggaaccgaggacgtctgtgatggtggagtgctgtccggccgtggaaagggaggcaggaagcaccggcacactgacgcggaggaacctgggaatcgccgtgctcagaggaagaaaccgagtcacaaaagtcacgggggacatgatttcatttatacaaaatgtccaggaggccagggcggaggctcaccctgtaatcccagcacttcaggaggccgaggcgggcagatcacttgagatcaggagttcacggccagcctggccaacatggtgaaaccccgtctccactaaaaatacaaaaattagctgggcgtggtggcgcgtgcctgtgatcccagctactctggaggctgaggcaggagaatcgcttgaacctgggaggtggaggttacggtgagccgagttcacaccattgcactccagtctgagcaacagagtgagactctgtctctaaataaataaataagtaaataaataagtaaataagtccaggagaggtaagtcggtagagacagaaagtaggttgtggccgtgtagggctggggaaagtgttgggggcatgggaagtgatggcagaggggcaggttccctttggtggtactgagaggctctgaggtggacggtgaggtggtcacggaactctgaacattcagaaaaccgttgactcttacagttttttgttttttttaagacaagcacttgttctgtcgccaaggttggcgtgcagtggtgcaatcctagcctaacgcagccttgaactcctagtctcaagtaatcctctcacctcagcctccctagtagctgggactacaagcacacaccatcatgcctggctatttaaaaaaaattttttttttgcagtgatggagtctcactatgtttcccaggctagtcttgaactcgtgacctcaagtggtcctcccaccttgacctcccgaagtgctgggattacaggcatgagccattgcgcccggccaactcctatactttaaaaggctgagttatgtggtatatgaattatgtttcaataaagctgttttttaaaagaaagaaaaaagaactgaggatacagttaggcaaggaggtaagcatagtgaaggatatagccagagaattgcatttctttaataaggggttacttccctgaccccagacagatgggctccctcccaggacattcaacccaacacaaaacaagatggttgaaaatgctggctccaccatctgggcacaaagcagaacaataagcttgtccctctcagatttgggagtttttccagcaaacaatcacctcccattgcaacttaggtactaaaagcactagcgttgtccccaaagtggaagactttagaatattcaaatccagagtgtctccctaattctttgaagctatgtgattaaccctatttggattttcggccacagcaagcagcaaaggctatcagtgggaaattatttattgagtgagtggatacaagaataaatgaatcatgctttcatggcacaagagacacccccatagccctcaaataaaagatttatataccatagtggggaaaaagtaatttctcacccctctccaggttcatggctgagacttgtaacaaaagacagattaataagagaaaaccctacccacttatttaataccggttttctatgtcacatgggagccttcagaaatgaagacccaggaaacagggaagcctgtttttatggacagttgtgcagaagtgtgatcggagggcaaagggcgtgctctgatgtcataggctgaagggctcagcaaggcctgtctggagtcttctagctgcttctgtgtcttcggagataaggacattcccctctgggcatagggaggcccctctggaatgagggtcttatgacctgcctccgaggagaaggggctgggggaattctggtttctgtggtctgcttctgccgttttctcgagggccaccctgccatattttgaggtagcgtgttctgaatccagtctatataaacattgcatatcaattcccaaaagtgtgcttcagaaattgcccaagaaaaactagtgaatgggctcatttgtgaatataaaaaaaaccactgatttagcatctacaggcagacctcggagatattgtgggttcaattccagggcactgcaataaagcaaatatgacgataaagtgagtcacacagattttctagttttccagtgcatataaaagttacattttactaggctgtggtctattaagtgtgtaatagcactatgtctaaaaaacaatgtacaggccttcattaaaaatgtttttgctaaaaatgctaatgatcacctgagctttcagcaagttgtaatcttcctgcgggtggagggtcttgccgcagtgttaatggctgctgattgatcagggccgtggttgcttgaagcttggggcaactgtgttaatttcttaaaataagacaaataaaattgactgcatcagttgactcttccttcatgaaagatttctttgcagaacgcaatgctgtttggtagcattttacccgcagtagaacatttttcaaaattaagagtcaatcctttcaacccctgccactgccttatcaaataagttgatgtgatattctgaatcctttgttctgattttcacaatgctcacagcatcttcaccaggagtagattccatctccagaaaccactttctttgctcgtccctaggaagcaactcctcacctgttaaagttttatcatgagattgtggcaatttggtcacatcttcaggcagctctgctaatgctggttcccttgctgttcccaccacatctgcagttccttcctctactgaagtcctgaatccctgaaagtcatgcatgagggttggactcagcctcttccaaactcctgtgaatgttgctattttgacctccctccatgaatcgcaagtgttctcaatggcatctagaacggtgaattttttccaggaggttttcaatttactttacccagatcagtcagaggaatcactatctatggcagctgtcatcttacaaagtgtgtttctaaaatataagtcttggctgggtgcagtggctcatgtctgtaatcccagcactttgggaggccgacgcaggtggatcacaaggtcaggagttcaagaccagcctggccaagatggtgaaaccctgtctctactaaaaatacaaaaattagccgggcatggtggcatgtgcctgtaatcccagctatgcgggaggctgaggcaaggaattgcttgaacctgggaggcggaggttgtagtgagccgagatcgcaccactgcactccagcttgggcgacagagcaagactctacctcaaaatatttgtatatatgtcttgaaatggaaattattttttgatccctgggctgcagaatggacgaggtgtcagcaggcatggaaacaacacccacctccttgtacagctgcatcacagctcttgggtgactggtgcactgctgatgagcagccatattttgaaaggaatcttttttgagcagtaggtctcaatagtgggcttaaaatattcagtaaaccatgctgtaaacagatgtgctgtcatccagctttgttccagtgacagagcacaggcagccatagatttagcatgattcttaagggccctcggatgaacaagcattggctttgacttaaagtcctcagctgcatcagctcctcacaagagagccagcctgtgctttgaagctttgaagtcaggcgctgtcttctctctagctatggaagtcctagatggcatcttcttcaatgtaaggctgtttcatctacattgaaaatctgttgttagagcagccaccttcgtcactgatctcagccagatcttctggagagcttgctgcagcttctccatcagcacttgctgctgcaccttacactgttatgttatggagatgactcctttccttcaacctcatgaaccaacctctgcgagcttcagagttttcttctgcagcttcctcacttctctcagccttcatggaattgaagagtgagggccttgctctggattaggctctggcttaagggaatattgtggctggcttggtctatccagaccactcagactttctcaatatgagcagtaaggctgtttcactttctcgttttctggagtagcacttttaattttctccaagaacttttcctttacattcacaacttggctaactgttttacacgagaggcctcatttttggcctattcttggctttcggcatggcttcctcactaagtttaatcatttctagcttctgatttaaagtgagagaggtgcggctctttctttcacatgaacacttagaggccactgtagggttgctaattagcctaatttcaatattgttgtgtctcagggaatagggaggctggaggagagggagcgagatgggagaatggctggtcagttacgcagtcagaacacacacagcattgatcagttatgctcactgtcttctatgggcacggttcatggtgccccaaaacaatgacagtaacaccaaagatcacggatcacagctcagggatccaacactgtggaaattaccaaaaggtagcacagagacaggcgatgagcacgtgctgctgggaaaatggtgccgatggactcctccatagggttgccacaaggcttcagggtgagacgcaacccccgcgacgtggaacaaagctggaacgtgctcctaggaaggtcgtgctcctcagactctttatttaggtttgatcaagcagtgaattcaatttgtgctgcagaaacagttgccagaccctaccttcttggaatctagaatcccaattgggaaattcctgccaagtagagaaccagtggctcagttgttgcatggtgctgctgtcattacccaaacagcagtcgatctccagagcaggagcccccgctcccacagcagcgaggatgacgcccactgcgccgcagagctggcttgcgcccgccaccccgtagtaccctgtgagctctccgagaatcagccttcgggcactggagggtccgggaatgcaaggctcattctgcccacccccacaggcagcagccaggacctggtctctccgccatgtggcctcagcatttccaggctctctgagtggtttgtgattcacagagcgtagatctctcagttgctacctcatctgtttttcaaacccattgtgcttttccgcagcctcccaggtgtcaaaagttattattctattttttgccagttccataaaacagaacagctctgcgtctcagagttgctgctgcactctgggtgtcccccagatcacagcaggagctggcagacgcagcctgtgattgctaatcatgaaaatggagaggaaaaaaagttctgagctcatccaacggaagcgttcactctgcttcctccagacttcaagaaggctttagtcaggaaagaagagcggaggagagagggagggaggctgtcggcgagtgggtcaccattcgggagctccaggccgcttgcagcaacgtccaggctgttttgtattgagcgctcacagaaagtccaggctgagtacctcctgtgccacgccgccccactcacattgagtaacatgagccccattcacagccttagggtgaggaaattggaattcagaagagttcggtgacttgttctaggccgcagctctcaggcagccactttgcacctcggtctgtctgcatctccggcctctgttctttacctcttctgcccccgaaacactcactcgtgggtcctgtcctgtggcatgtccacagctgagaaacacgggagccactgcccccaacaatgtgggtattgttagatgtgtgtttccccagtgactgtcgcggtgacacgtgttttcatgtcctgtggggccactttcacctctgcttctgtaagttactgctcccatctttgccccattcccactgagttttgtctttttcttggactgtgtaggagctccttgtcattgagaatatgaacgtgtctgccacacaagttgctaattaaacagccactgaattacatctctgtacggcgtgtacacaagtcagagcccacttttataagttgtgtttctcgtctgccccccacagtcatcctgatatgaaaccttcagtggctccctctttcccacagaatcaagtcaaaactgaagggcagccttggggtgtgtggtccttctccatgtgggtccagctcagggatgcgttgaaagcagcttccttatcaggttaattttggcgttattcccactccactttctttcccatgcccttgtcacggctccgcatcccacccgttctttgagacgcagagcgggcctctgcctcctcattcgttaccgacgtgctgagccttcctttcccactcttccccagtggcgtccattgctcaccctacgcacagcaccgaatgccaggagaatgatcaagaccttgtgctttcacgccccttccagtctgcagttttccgagtgtctgtacggcgctgctttccctcctctagccgtccactgcagtgcacctgcaggagtgctggctgatttctggacagtttgggtcctggggaccagacgtagcagtcatgggctgagccttcttcattcaagcagcacctggggccgcggctcccgtgctgtgtgatgacccactcagcccactctctttgccgccgtgcctgtcccacgctccgtggtgactctgcagcatggcctgcctaccaccccttggctcttcccactcggtttcctgccccacaggctctcggtcctgtccctgctccgctgaccagcgctctctccccttctctgtcttcaggtgcctccctctttcctggccaagggtggatgtgtggaggcagagttgtggacaccgcctgtgcttcctgcctgttggggcagcttggtccccatgggggctgaaaagagcaacctggccgtggcttggctgagctttcagttgctttttccagaaaggcagcagggggcctatccacatcccaggccaggctgaaaacctggggtgaggggtgggtgatgctgccttggaaatagacatggatttcttgaacttacaggaagcatacactattggggtgtcaaagagttttttgctttaatagaaaattcagcacattctttaaaatcaaattctcggttgcctctcttgacccacttcggtattattttaatagtggatgatggcagcaaagtctgattttatgaaaagggaagatgttggccattacagtattacccacttttctctttcaggtgtgtcaattaaaatcaattaaaaaatgaattatacgtatatggatatattcaaaatgaacagtttggaactatctagaataaaaagtaaaaattccttttgtgtcccttcaccaaatctcactcccactcggaggtaacagacatttcctgtttgctgtgtgccctgttttctgtgcgtgttaaaatgtcagacaggactgcatgatatgtgcttaatgaagaaaatctagcagccagggccctgaaatggtctaaccatctttgcattattggttagtaatgaaccggaccatctaagatgtcccagccaccttgtgggcagggccccgccccttcatcctctcagaggggctgaggcaacgggaagacccacagctgtgagacacgagaccgcatcactccgtgtgactggcagtctcattgcactcccaaattccaatgaataaaacctaaaaggagatggaaacgaatgactgaattgaactatgtgaagctcagccttatttggtgtattaacagaaaaagtgacgtgatattgagacttcagattagtgacttgaggtgagttaaaatcagttcagctcagtttgggtctcacacacatgtgagctcagatgtatgcatgtgaccccacccaatggctctgaagatgcggttcgctcctcaaactttccagacttttctctcctcagaagtttgctgggaggaaggagaagcgggaggaacagaaccagattgacgttctcgcgtctcttcttacttgggcgtatttatagcatccccgctaaggacgccctcgttttagaggaacatgttttacattttttttccagcctccaggctgcctggcagcctcaggcggagaagcagattgactcggtgtcagggtcacactctcaggccccttggcggcacagacagggtgagggtgcctgctggggcccctctctctcctctccctcccgagcggcgtctgtgctgtgaattttcacggagacacaggctgatccttcgtgcgtccttggctggcagttgttggtgacttacagtcattcatgtgctggcaacggatggccctgctgtcttgtgttgggacagctgtgcgcatcggcgtcattgatatgatttgaatttggtgctatctggtgtggctttgtaactaaagtcataaatagtggagaaacgatgtgtctggttctaaattaacagtgggactgggtgcagtggctcacgcctgtaatcccagcactgtgggaggccaaggcaggcgaattgcttgagctcaggagttcaagaccagcctggcaacatggtgaaaccccttctctacaaaaagtacaaaaatcagccaggtgtggtggcatgtgcctgtggtctcagctactcgggaggctgaggtgggaggatcacttgagcccaggaagaggaggttgcagtgattaagcctttgcactccagcctgggcaacagagccagactctgtctcaaaaacaaaccaacaaacaaatggcgggaggaacacaaatcgtagtaagtatgatatgcaggtttccgagcccagatgtgcagccctggattttcaagtcttccctcaagtcaggactttaaggaaagaactctgggttttgtgtttctgcacaatgaagttctaatatctgactcccaaacttcttccccgtgagactgccttaatgatgcttatgtagactggactggaatccccactaagagaataaattacccgttaaccaagacggtctccaggtgtgtgtgtgccttggcttggaagttcaatttcacagtagttagaatagctgcttgaccccacaggcctgagaggggaggtaggattcaaggaagctggagagtgagcccagcaggggcatgtcctaaaaaccccgagaaggtattggagtgcccggctggggtgtgggtgtcagctgggggtggaggcgggcgtgccctcccgagggtgttttgctgggggttcctctgctgagtgggcccgtccttggtgattgtccctggtgcacggctggcttgttaagcaggggcgaagcgtgcacaaggtcacctttctccagcatcctcatcttcatggtctcgctgggagagtggccgggggtgcctgaatcaagggaactagaacaggtgctgaagctgttcccactcgcaggaggaagagcagcatctggccccagacagggggagctggggagtcctcagggcccttcggggcctccctagacaggggaagccggggagtcctcggggcccttcggggcctccccagaactgtgctcgttggtggcatccacaggctgctcctctgggagcttgttgcttttcgggtcctgagccctcccgcctgccaccgtggcgtcagggaaactggtgcctcccaagcacccccagctcttctgcatgagaaggttggagactgtgctgcagccggggttcttatgatcaccttcctccctcgccagcatctgccctggagctgaacgaggaccaccaggctcctcagggcctgtctccgtggggcaccaggaggcgcaaatgccagtttgcatcattgccctgttttcagctgtccaggatgcccatgtctgcagaacgcagtgtgcacagtcccacagggcaccccgtggcatcacccggcctctctctttgacttctctcccgctgaacagcgagtgcttccccaaagccatgggcagccccactcccgactccctcagtggtcagacggtcacccgcctcttagccgaccttgggaagagggtccctctcagatgggcacccgcctcttagctgaccttgggaaaagggtccctctcagacgggcacccgcctcttagctgaccttgggaagagggtccctctcggaggaggggtgcccacattctgctgggcggttgactctggtggaggtggcccgtagtttgggcgggcacatgggcatgctctgtgcaacctgcagcatttactaagatgctcttgaaagaccgttttcccttttatctgctgggttgactttcccatttatcaaattaactttctaaacccttaaatttcagagatttgagaggataaggaattgtttagtagatgaaactcattttcatatttccagaggcatgtccaaaaactaaatggggttgagcatttctcagggaaaagttgactcggggtgccagttacacgcagtgttttccagaggtcctggggtccaaggccttcccatggctgaatctcccggtttactccgctttttgatgaaggagcaagttttgaatgtggagtcctgtagagttcgctgtgcctcttgggttggcctggcttagctgtggctgatgaccagctgtgaggggacacagtggggccgcacgggggctgggccagtgctgcacccgcccagcgccagggctgacctcatttgcttatagcctgcttttgcttttggtctcctaagcgcgagatcttgatgtctacctagaaatgtcactgacgtaggagaaagggattttttttttgcttttaccatgaagggttgtcatgggcctgtgtgaaagacattaagtaaattagatatcagccccaaggaatgttaatatctgagatttatactggagtagttttcgcttcccaatttattttcttttaaatacttaaaacatttggtttttaagctatttatagccaacctttttttaaaaattaatgtttaaaatgtttttttccccccaatctatcatggttgactgttagacagttggatggctgtgtggttttcaaagctgaggtcaagtttgaatgagctcatttcagatcactctagattttctgaggctgacagtgtccttgggacaccatgtttggggaatgtgtttttgcagtttacgaagcacccgctgctcagagagccgggaaacctttccttctcttttcttggagtctagttgccatggagattgtcactaaattatggacgagggagaggcgagccggcacttggaggtctctgatacgcaggcttctcaatcagggtgcacagacacagcagaggccgtgcagaggctgcagcttgccctcccggctgtcctgggcgtggatgtagcctcccgaaacagctcgtcagaggggtttattcagagaacggaagtgtgcttatggcaggaagagcttcaagggttctcacatatgtttacagctgctctttctccttagcaggactctgagtggctgcagtgtttagagaaatctgccaaatcctgatttaattttggttcatttgctaacaggattggaggagataggaaattgatcttggggaccgtgaagctgctgaggttcagccacgaccaggagtttggagggataatgtctgtgcgtggccataccattttgaaaagcacaaaaccttttatcattaaagcagaaatatcgaaccaaacgtggattctaaagattatgcatacaacaaacacatgtctttcggtgcgtgggtaaaacccataactaatttcaggcctaatctcagtggctcagcagtgcagtgtgggcaaatgcttaaccaccagcatttgcagcatttgggacctgatttgcagccgggttctctagtgtaaggcccccgccccgccgccactgctgcctcccagttactgacgcagtgtcactgaaggtggagttgggaggaaatgtggacggccagctctcgggcccttgcatgcaacggccttgttattttagaggcgccgtctaatcattcttgggacgttggtctgctctgtcttttgaggcagtttccatagaggtggggtctgtgttaagagtgcattgaagggtgagtgatttccctctaactgatgggtgatgttcatggtctgagtctgtgtgcaaagcttagcctggggctgctttggaacctgctctctctattccaggcctgggtgctttgagatattcttgagctggaataacacccagcacctgctcttgtgactgaaatggcgtaaagtaataatagtgcactgcatgggggttaatgcctttctgagtgttttatatgttatcgtgttagatttctgcaccgtcactgacaataacagggcatgtatttttgttctcatttaacagatgacaaacttggtcccttagtgttaaatgtgggtgacacacaggcagaatctgatctggaaccacactgatcgggcgtcttcccatccttcctccaatcagctcacccttcggcttctcaaaggcccacggaatttatggtggttcatcgttctttgccttaagatgcaggttctagatttgctactgggacccacggtgactttgatttgtctcttgtgaactctctatgatgctggcaaaagagaggaaatggtcacgtattggtcagatgaatgttgcagggaagaataattgcattacatgaaatgcctgcaggaaccgtggtgggaatggaaccgtggtggggcaggaaccgtggcgaggccggaaccgtggcggggccggaaccgtggcggggccggaagcatgattggagtcaggtgggccacatttcctggctgtcccatgtcttctctttgccctgacagtggtctcagccgacagaacgggcaacagacacgcacccagcctgagaggggccctggggccggggcgcccgccaattgtcagagtcttcttggttgcttttcaattcagaaatcagagaaatgatttgtagagagttttccttttctttattcatttagcttgaaatcaattttgttagtaaggttttttttttgtttgtttgtttttgtttttttgagacggagtctcgctctgtcccccaggctggagtgcagtggcgcaatctcagctcgccacaacttctgactcccgggttcaagcgattctcctgcctcagcctccctagtagctgggactacaggcacctgccaccacacccagctaatttttgtatttttagtagagacagggtttcaccatgttggccaggttggtctcgatctcctgaccttgtgatccacccgcgtcggcctcccaaagtgctgggattacaggtgtgagccactgcgcccagccattagtaaggttttaaacttgtcctcagaattagaagaaatcccagagactggagaccagcagtgctgtgtgtgggtgagaccctgttgaagatcccttggtaagtccagtgggcgtggtccataggagggggaggcgggaggggagctggctcaggagaggctggctttgcctccaaagaagagccccaccctcttgtgctggcctctcgtgctggccttttcctattgtccttcagagaggaggaagctttgctcagcttctcaccaattaaaagagcactgtgaggttggacaggagtgcaatttatgaaaacaaaacaaaaaaaacctttgacatggtgaaaccccgtctccactaaaaatatggtgaaaccctgtctccactaaaaatataaaaatacagaattagtcgggcatggtggtgcacgcacgtaatcccagctacttgggaggttgaggcaggagaatcgcttgaaccttggaggcagagtttgcagtgagctgagatctcaccaccgcactccagcctgggtgacagagcaagacctcatctaaaaaaaaaaaaaatccatgtgatctataaaatctcacggaaacacacacctaaggtcacgcatttcactgtaacatgagcgggaagatgtactgagcctgttctccacctcggtgaatgctccgaccccctcttgcctcacctcccactgtatacatttgttcctttttaattttttgaagactggtcaagtgcagtagagagaaggcggaaagggtacaacaaggagctagattgggaactgactgagcagccggtcggggtgacgcaacgctaccttcctacccccaccctttgctcctgttgtcgctgagtcgtgctccgtcgagggacacaccacgtcttgcttgtacccacacaggttgttcccagcatttggctgctgtgagcatcctcgcgtgaaccttttcaggagctgagctcttagaggagaaggcagcgctgtgttgagcacccaccgggagaagttccgtcaaatccagggtacttgagattctggaaagatgcagaaatgtaaaaaataaaaacaagcaacaagcggtttatcccacaagtcactaggaaaatgtattgttgtctctctaacagtcaaatcctattggtcggccttagtttttctgcaaaacagaataaattttatgtttttttccccagttgttgaaataaaatgctataaccatatttgcttataaactatgtccaaatgagattcttttatttctacttgacgattttccaccatgtcaggccctgttatgatggcagcccgttgtgatgcactaggacagatcccagctcccaattcttttatgaggcactaggacaaatcccagctcccaattcttttatgaggcactaggacaaattccagctcccaattcttttatgatgcactaggacaaatcccagctcctgttatggcaacagcccgttatgatgcaataggacaaatcccagctcccaattcttttatgatgcactaggacaaatcccagctcctgttatggcgacagcccattgtgatgcaataggacagatcccagctcccaattcttttatgatggcactagaacaaatcccagctcccaattctttgcatttttttttttttttttttggccaggttttctctctcacttgctggggcacgaacagatgctctttggtgtttttaatgattgaggagcatcttgctgttgtcgttctcatttgttttcaaggaacagaaacgctctcgagcgagtgctcggtggagctgggcaagctgctgaccacaggggaagatgactcaacaattgggattttgcttcttctttctttaaaaagatgcaaaagaactagacccacactttacacatttttttggtgtgttcattgtggactagtgttgttgttgttgttgttgagacaggggagatggtctccctctgttgcccaggctggagtgcagtggtgctatcttggctcactgcaacctccccctcctggggttcaaacgattctgctccctcagcttcctgagtagctgggattacaagtgcctgccaccaccactggctcatttttgtattttagtagagacaggatttcaccatgttggccaggctggtctcaaactcctgacctcaaatgatccacctgccttggcctccctaagtgctggggttacaggtgtgagccactgtgcacagccaaaaacagtgttttcctttcctcagtctgaaagcctgacactgttgatccaccaggagtgtgcatgggtgtgcatagtgttgatccaccaggagtgtgtgtgggtgtgcatagtgttgatccacccggagtgtgtgtgggtgtgcatagtgttgatccaccgggagtgtgcatgggtgtgcatagtgttgatccacccggagtgtgtgtgggtgtgcctactgttgatccaccaggagtgtgcctgggtgtgcacactgttgattgaccaggagtgtgtgtgggtgtgcatactcttgatcgattgggagtgtgtgggtgtgcacattgttgatcgggagtgtgcgtgggtgtgcacgctgttgctccaccgggagtgtgtgtgggtggggggtgtgcatgcctgtatgcacaatagagtctcgatctttgtgggacaagcataggggactgggcatcagtcaggaagcttgggcttgtcttgccctgccaccaccctgcgcacccctctctattcaagccacagctctgtgcacgttggatttcttacgtgcaaaacaagggggtcagccatgccggtggtaacacctggaaacacctggaagctttgaaaaatagtgatgcccagacataaactggcgccagtgaatcagaatgtcagctgagggcggcgaggggcggggtgggggcgggacccaggctttgccgtcctttctttttctctgaagcttcccgaggtgactgtaatgtgctatcagagttgaggatctctgggcaagacgatcctgatgaaaccctcccaccctgaaacgccagctgtgctttgtgtaacaaagccaaaggtgcggtgagggaattcagtttcctcattattacttctatggtttgttagcaaaaacataattagcatgaaagatatttctctgtggacatgcaaatcaatgcaaatgactaatttgccatttaagaatttgcaaattgcaatgcaaaattgtcttaggtaaataaccctagtctaattgagtgacaatattctgtgttttgttattaaggctattagctgaagatgtaggaagactgtaaaaatgccacaatttttgcttatacatgcagtgtgagttataatttacgggagattttatgcacattgtttcacttgagccccacaattccagttgcatcctagactagctactgtaaagtagcacagggtaaatgggtggcggtgaaagcaagaatttgaacagcttgccacagtgtaacaaacgcaacagcaacagaaacatcaacagggccttccccgggggctcccaggtctttggcagcagaattacccaagttttggccagtgacttaaacacacgccatgtaaaaggatgagatgggaacagaacaaagagcccagaaataaacctgaccatatatggtcaactaggtgtgaagcagactctggggtaagagccgtctctttaaatggtttcggggaaactggacatccacactcaaaagaatgaaatgggaccttaccttacaccgttctcaaaaatctgcccaaaattggttaaagacccaaacacaagatctgaaactgtaaaactctgaaaacatacaggaagagctccttgacattggtctcggcaagaagttttggacaagacccaaaaacacaggcaacaaaagcaaaataaatgagtgggactatatcaaactgaaaagctgccgtgcggtaaaggaaaccatcaaaatgaaaaggcagcctacagggcgggagaaaatgttgaaaaaccatagatctataaggtgttaatatctaaaatatataaggaactcactcaactcaatagcaaaacaaacaaacaaacaacacacaaaaaaaacccaaaagccaaaaaacccccaaaccctccaattttaaaaagggcaaagaacctgaatagaacatttttccaaagaggacatacagatggctgacaggtatgggaaaggtgctgagcatcactaatcattggaaacgcacatcagagccccagtgacttaccctctcacacctgtgagaatggcttttatcaaaaagacagaagataacaagtgttggcaagtgtgtagagaaaagggacacttggatgctttgtttgagacagtctcgctctgtcctacagtggcacgatctcagctcactgcaacctctgcctcctgggttcaagtgattctcctgcctcagcctcccgagtagctgggattacagacatgtgccaccatgcctagctaatttttatatttttagtagagatggggtttcaccgtgttggccaggctggtcttgagctcctgacctcaagtgatccacccgcctcagcctcccaaaattctgggattacaggcgtgagccactgcacctggccaacttgcacactgtttatggaaacagtgtgtaggttcctcaagaaattaaaaacagtgctaccatcaacgcctcttttggttatagatccagaagaaattaaatgggcagaagaggtgtctgcaccctgatgctcattgcagcactattcaccagggcatggagacagtacaggtgtttctgatggatgaatggatagagcaattgtggtatacatacacaatggatactattcagccttaaaaaaggagatcctgtcattttcaaaacatggatgaacctggaggacatgatgttgtaaatagtgtgaagtaagtgaaataagccaggcacagaaaggcagatactgcatgatctcacacatatgtagaatcttaaaaaaaaaagttgactacatagaaacagagagtggaaagctggttatggtttggggggtgggagtggcgaggaatgagaagatgtggatgagagggtaggaagctgcagttttgtgggaggagtgagcccaggggcctaatgcacagcgtgaggactgtatgtagtaacaacattggattgtttactggtaatttgcccagagggtgcctctaggagagggtggaggcagaggtgttaactcttgaccacagtggccacctcagtatgcatgtatgtatccaacatcatgttgcacgcctcaaatgtacatccaaaaattttacaaaatgatgagttggattttgttatctgctttaaggatgtccattttattactgcatggatgcatcatgcaacaggaagtggggtgtgtgaggcgtgaggcagggatctgggttcaaggcctgaaagtatgtaaagctgctcagcacgtgtgactgcgggtccccaggcaaagtagcttagcccacatgactgcacccataactgctggctttctgggttctaggcttacgtgatcagagaccaggtttgtttttgcccagcccaagtccagcacacatgtggcaggtagctggcttttcccaagcatccactggaggcccctggatcaatgcattcagggcagtgtcttgggaaggatataaactgtgcagtggttaaacagctggtacttggactgtgagagctgagcctttcagtgcttccaagtactgactctttctaagcctcagtttgcttgtctctaaagtaagcatagcaataatgccttctttgtagtaagatttaatgtgatactgcaaataaaatatttagtacagtatctactaaagattagatggcatagattagatgctcaggaatgttagtgaaaacagttatcataatgaaaaaatgccctcatgagcttctgtctactgcagggataaagtggtaaataaatgatgtgtacaggagatacagtaagggagtaaggggtgtggtatgaatgaagaaccaagaaagcattttaagaattcaaaggggtcacggggtgggaaagaagagacatccagtgggagaatcaagacagtctctgggggagtaatcatgatggatcttgataggactggatttgaaggctggagagccaccagagtgtcacttcgcacaaactctgcaagatgggcactcttagtatctccacatacaaggcccaggagaggaggcccagcatgctttaggaaatgtccacagccacacagctgattggtgctggaatctggacttgtatctcagcagcttagctccagtctgcgataagaacaccatagcctctgtaactagctgtgttatcctaagaaaattacttagcctttctgaacttcaactcccttatctctaaaatggggataatacattgatctgaaggtcaatgataatgagcataagggtgtagcacagaatctggcactggtgatatttactcattggcatggcaatgatagcgatggtaaggatgatgatggtgatgatgaagtgattgtttactaaatggcatgccaatgatggcgatggtaaggatgatgatggtgatgatgaaggattatttactaaatggcatggcaatgatggcgatggtaaggatgatgacggtggtgatgaaggattatttactaaatggcatggcaatgatggtgatggtaaggatgatgatggtgacgatgaagtgattgtttactaaatggcatggcaatgatggtgacggtatggatgatgacggtgatgatgaagtgattacttactaaatggcatggcaatgatggcgatggtaaggatgatgatggtgatgatgaaggattatttattaaatggcatggcaatgatggcgatggtaaggatgatgacggtggtgatgaaggattatttactaaatggcatggcaatgatggcgatggtaaggatgatgatggtgatgatgaaggattatttactaaatggcatggcaatgatggcgatggtaaggatgatgacggtggtgatgaaggattatttactaaatggcatggcaatgatggcgatggtaaggatgatgatggtgatgatgaaggattatttactaaatggcatggcaatgatggcgatggtaaggatgatgatggtgatgatgaaggattatttactaaatggcatggcaatgatggtgatggtaaggatgatgacggtggtgatgaaggattatttactaaatggcatggcaatgatggcgatggtaaggatgatgacggtggtgatgaaggattatttactaaatggcatggcaatgatggcgatggtaaggatgatgatggtgatgatgaaggattatttactaaatggcatggcaatgatggcgatggtaaggatgatgacggtgatgatgaagtgattacttactaaatggcatggcaatgatggcgatggtaaggatgatgacggtgatgatgaagtgattacttactaaatggcatggcaatgatggtgatggtaaggatgatgatggtgatgatgaaggattatttattaaatggcatggcaatgatggcgatggtaaggatgatgacggtgatgatgaagtgattgtttactaaatggcatggcaatgatggcgatggtaaggatgatgatggtgatgatgatggtgaagatagtgatgatatggtgatgacgatgatggtgatgatgatgatggtgttgatgataacaatgatggtgataacaatgatgatggtgacggtgatattgacaacaatgatgatgacaatgaggatggtgataacaatgatgatgatatggtgatgacaatgatggtgatgatggtggtgatggtaatggtaatgatgatggtgatgatggtggtaatgataatgacaacatgatggtgatgacaatgatggtgatggtgatgatgacaacaatgatggtcgtgatggtaatgataatgatgatgagatgctgatggtgatggtgatgatagtaatgatgctgatggtgatggtgatgatagtaatgatgatgatggtgacaatggtgatgatttggggtgggggacagaaatgagaaaagatggagttaggggatgatgggctcacctgcccttttggccctccagttctgtacttgcatattgaggggcttggtctacctggtgttgcccaaatgactagaaccatgtaggaagcttataaaagtacacagatccagatcctataccagactgaccaagtcggcatctcccatctggggctttggggtttatggttttagtacagttgactgtaatgtgcagccaggctggggaaacatgaaactaatgatctgagttcaaatcatcactgctaaaatgagcacaagggaatagaaccagttattcgtgctgaataaaataaatgtaacccccaagttgttgcactgctatttgaaataatttatgttattgattttcttcaataaaactgagctgtgtgtggatttgcctgaaggggtctgtgtcccaaccttcaactcatcctctgttttcctggatccccacacaatcgtaggcagcttagcttgtagttttgcggactgtgagctggacatccttcctgtgtttgaaaatgaacctgtcatcagcacaggttttacgtgagaaacacagggcctgaggcagctatatgacacgtctcagggtggaaggaggggagaggaattcattgaggaaccactcctttttgtcttagttttaaggcagtaaatgacttgtcatcctcaggaaagctaacaggcaggtgttccctctttctctaccaccattttcatggccgagacaggaccaggcaccccttaattttcacatatcatctctaggactctgtgtgttttctgtcaaatgcaagtacggtatcgcatcatgtgagagcagaaggtgtgacagaggccgggtgtggtatagatgatgccagcacaccagacaaatgccagatagtagaagccacaggggcctccggtgcatggcgtctgagggtctttatgggcctgctgggagggaggtggtcaggagcatcagcccgctgtatgaggatctgcactgcctttgagaagtgacatcctgggataaacaagctcacccaaactcctccagaaagaacccaacaatttatttttatttggagatatagggcgagtgttgggatcaaagcctggggcaagatggtcccagagaggggccctggtgtgtggacctagaaagcagagcagcacagggcgtgggcggaagcacagggggtctgaaagcatggaaggagaagtacgaaccgaagcacccaggcggttctatccaaggacgggaggcgttcacccaagcgccggctcctgcagcaaggcagggattctctgccatggggtgagtatgggttgtttccttggaagtcacaaatatgccagtgtctttaggctcagtaactcagactgtaggaacccacactaaagacgtgtttttaaaatgtgggtgaaaaataattgaaagcacgtttgttacagctttatttataatgttgaaaaactttaaaacaacccatatgaccaagcatagcagggaacagtgcagtcagcctctacagcaggtggccaagaggctctttccatggttccgggaaatgctcgcgtgtagtacccagtgggagtggcaggagacagccccgaggctacagaatgaatttgagtgctttggaaaaagtacgtaattatgctttggaaaacactggaagaaaatgcacctagaatgatattttttttcaccattttctgtatgcttcagtttttatgctgtaagatttttttttttttttgagacggagtctcgctctgttgcccaggctggagtgcagtggcaccatctcagctcactgcaagctctgcctcccgggtttatgccattctcctgcctcagcctcccgagtagctgggactacaggcgcctgccaccacgcccggttaatttttttgtatttttagtagagacggggtttcactgtgttagccaggatggtcttgatctcttgacctcgtgatccacccccttcggcctcccaaagtgctgggattacaggcatgagccaccgcgcccggcctttatgctgtaagattttattgttcatagaaccaagaaaaaaatgaaagactgggaatttggaaatttgaggtttcttctatgcttcttgaccaggtcacttctgatcttaagtgaagccacatgactgtcgggcagaatcctccatagtagaaaggaagagctgttatttctctgcagtgtgtcttgggtttgaggatgttgtagtttgtgcaatgatggtctgcatctctagaagatttttcctaaccaactttatgtggatcagctgacttttcagctagctgccagcgtgcacacgtttctctctgtaatgtcttctattttgaggtactctgtgctttactggaactactatctgttcttgtatatttctaggcaggctttgccagccaaaggtgggtggaacatttcttgcatcaacatcagaataagctcgatcatgaacgatggttgaggaagggagctggggccatggcttgactttcccatgggaccgtgcaggacagagcagatgaattctcatcagatggcactgcgtatgcttggtgactgtgagttttcatttccggacagctggatgaccctcctgtgctgacggcacacagcccccgtagcaggaacatgtagatagagtcccatcctggagctggatgaccctcctgtggtctcggcacacagcccccgtaggaggagcatgtagatagagtcccattctgcagctggatgaccctcctgtggtcttggcacacagaccctctagcaggaacttgtagatagagtcccatcctgtagctggatgaccctcctgtgctcatggcacacagcccctgtagcaggaacatgtagatagagtccgatcctacagttgaatgaccctcctgtgctcttggcacacagaccctgtagcaggaacttgtagatagagtcccattctgcagctggatgaccctcctgtgctgacggcacacaggcactgtagcaggaacttgtagatagagtcccatcctgcagctggatgaccctcctgtgctcacggcacacagcccctctaggaggagcatgtagatagagtcccatcctgcagctggatgaccctcctgtgctgacggcacacaggcactgtagcaggaacttgtagatagagtcccatcctgcagctggatgaccctcctgtgctcacggcacacagcccctctaggaggagcatgtagatagagtcccatcctgcagctggatgaccctcctgtgctgacggcacacaggcactgtagcaggaacttgtagatagagtcccatcctgtagctggatgaccctcctgtgctctcggcacacagaccctctagcaggaacttgtagatagagtcccatcctgtagctggatgaccctcctgtgctcacggtacacagcccctctaggaggagcatgtagatagggccccatcctggagactgtggatgttgccatgctcctgggtttctcggttgcctcttggtggttctatgatggagaaacggcagggcccagcaccatgatgtgggcagccacagcggctggacaggggccactggacatttagggagatcctgtgacacacaggctgtggcctttctccgagtcatgtgtgtgtggccctcagggtagtgggagaaagagaagctatgacatttggactgaggcgtgcatgggtttgcggctcagtatagagtaataggtaggggtggtgcagagccgacgtccttttgcgggcccctggagcccgttcgtcccaggcaggggctctggattctggatcccgttcgtcccaggcgagggctctggattctggagcccgttcgtcccaagcggggcctctggattctggagcctgttcgtcccaggcgggtgctctggattctggagcccattcatcccaggcagtgggggctctggattctggagcccattcatcccaggcagtgggggctctggattctcatctgggtgttgtggtgcagcatgcatgtgtgcttgtgcaactgtgtgcacttggagccacagcctcaagccttggtgtcttcctctggacagtggagacatcagcacgtgtggtcccaaagtcctcgtggccctgtgtgtgcagcaagtccagcccagggcagccacaccaaggctccggtgtcaccctgtgatggccgcggcaccctgtcctctctctcctgtgcccccacagatgttgccgtctcctgcctctcgtgtcttccccacatgtgtcctttgccagtgctccctgcagtttcccttgtctggcctgtgctgcgtggagggtgcacctctgaagatcacgcagtcctcagggggccctgggatcaaaggtgtgtccacggttagtgtgctgaggtctcactctgtgcttgttgctgggactagaaggggaaatgaggcagagtctctgctcttaggcagcgtggagcccgcccagcctggtgttatgggggtaccggcttcacagtaggatttggatttgaatcccaaatctactcagtaaataactgtgcaactttcagctctccgaggtgtgcagtggggacgatcatggttctggctctgcagggctgttgggagaccgcacgagagggtgatgctggtgtcagggctccggcggtcgacttcgtgggacatcatggggctgttgggtgggggcgtggttttgcattttgctgactattagagcttttaaaaaccgggggagctttaaaagatccgggtggtcaggccacacctcttgacaaatcagaattcagggaatgaggccagtgtcaatatttctaagacatggcagcttttcccccaggtggccgtggtaagctttgggagctgggggccgagcttctcagcctgtgtcagcatctcctggacatcccgatggactgcagatcactcgcccggcccacttcctggtgcactggtctgagcattgtcctttgaaaaccaccagatgtcggggaaataacgtttgctgtggcgtctggggcaggaaaggaggaagcggagcacaggccaagctcggaggatgggggattttgctagaagggtatttaataaggtttgctgtgtttcacactgagggacgcataatggaaccctgggcactgcagagctgtgaagtgcccaggagacaccaaattaactttctcttagagctttcacctcagttttcaaccacgtcttctcactcccaatttctaaaactcccaggagacccggaacccttccaaatggatgaaaattcagtcagaggtgtgaagttttggccctgctgagaacactcagggtgtaaataatgaacttggaaggagttttgacggtggctttactgcgactctccccaggccaggctcgccctggagggggaggtctggtgttaacgcccctcaccgtgcgctgactggggccgcgcatccgctgtgttcccgcaggccgaggtagcacctttgctaatgaacttggaaggagttttgacggtggctttactgtgactccccccaggccaggctcgccctggagcgggagttttggtgttaacgcccctcaccgtgtgctgactggggccgcgcatccgctgtggtcccgcaggccgaggtagcacctttgctaatgaacttggaaggagttttgacggtggctttactgtgactccccccaggccaggctcgccctggagagggaggtttggtggtaacgcccctcaccgtgtgctgactggggccgcgcatccgctgtggtcccgcaggccgaggtagcacctttgctttcagggctagtggtgtctgcttatcaaggccagggtagacacctgcccgctggaagtgtccagagacattgcacccgagatgctgaggagccctgggagggacacggtttcttctcattggggattctggggatgttcattggagttaggaggaatgcagagcgtggatactgtgcaaacagataaggacgctttcaggaaataagcatcaggaaaggggtcagaagactcagcctggattcttggtggctcatcagattcatagcaaaccacaaacactgaatccaccctgcgtgcgccattgctgtgtagacgtatgatggaccctccttggatattaattcaaacaaattaactacaagatgactttttttttaattaatggaatttagcactgaccggatactagaacattattaaagaccagttgctgttaactaatgttgctggtgtgatactgggtttgtgatgacattttttaaagccctcatgtgggtgagttgtggtgatcctggtgctgtgggagatggaggcgggggaatcattgagcccaggaggtggaggctgcagtgagtcgtgattgtgtcaccgccgtccagcctgggcaacagagtaagaccccgtctcccctaaataaaataaaatgagataagtcctcatttgctagagatacacagaatatggtgtagtagattttctctaactgactccaccctcaaccctggaaaacagggaggggtggcaggggagacggatggagtgaaacatgagccactgcagagtgatgggtggccatggccgatggcgtccgtgccgttatcttctctgcggagcaatggggggccgtggccgatggcatccgtgccgttatgttctccgcagagcgatggggggccatggccgatggcatccgtgccgttatgttctctgcagagcaatggggggccattgccgatggcgtccgtgccattatgttctctgcagagcgatggggggccgtggccgatggcgtccgtgctgttatgttctctgcagagcaatgggtggctgtggccaatggcgtccatgctgttatcttctctgcagagcgatgggtggctgtggctgatggcatccgtgccattatcttctctgtggagcaatggggggccgtggccgatggcatccgtgccgttacgttctctgcagagcgatggggggccattgccaatggcgtccgtgccattatgttctctgcagagtgatggggggctgtggctgatggcgtccatgccgttatcttctctgaagagtgatgggtggctgttgtcttctccgcagattgatggggggccgtggccgatggcgtccatgtcgttgtcttctctgcagagcgatggggggctgtggctgatggcgtccatgctgttatgttctctgcagagcaatgggtggccgtggccgatggcgtccatgccgttatcttctttgtagagcgatgggtggccatggccaatggcgtccatgctgttatgttctctgcagagcaatgggtggccatggccgatggcatccgtgctgttatgttctctgcagagcaatgggtggccgtggccgatggcatctgtgccgttatgttctctgcagagtaatgggtggccatggccgatggcgtccatgccgttgtcttctctgcagagcgatgggtggccatggccgatggcgtccatgccgttgtcttctctgcagagcgatgggtggccgtggccgatggcgtccgtgccgttgtcttctctgcagagcgatgggtggccgtggccgatggcgtccgtgccgttgtcttctctgcagagcgatgggtggccgtggccgatggcgtccgtgccgttgtcttctctgcagagcgatgggtggccgtggccgatggcgtccgtgccgttgtcttctctgcagagcgatgggtggccgtggccgatggcgtccgtgccgttgtcttctctgcagagcgatgggtggccgtggccgatggcgtccgtgccgttgtcttctctgcagagcgatgggtggccgtggccgatggcgtccgtgccgttgtcttctctgcagagcgatgggtggccgtggccgatggcgtccgtgccgttgtcttctctgcagagcgatgggtggccgtggccgatggcgtccgtgccgttgtcttctctgcagagcgatgggtggccgtggccgatggcgtccgtgccgttatcttctctgctttcgtgtatgtttgaacatttctataataaaaacttaagtgaaaagcttactgtgctggctgcctggaggtgtggtgtttctgttcattttgtttttagggtgggaagtagtgggattgggggtccatgggggccatttcttgggttttcctgaagtgggttctgtgcttggcatcatgaagcaagtggagcgtgtgtttgctccatgcctgtgggctgcgtggaggcagcctgacaaacacatttcgaggggcccccggggggtcgctgaggctgtgtatgtctgttccatgcaacagccgtcatctctgtttttgaacacattgacagtgtgtagtctgcttggggggatgttcgaggtcaacagagtggccaaaagaggctctctcgtcattgcaatgatccacactccactctgctgtcactgaacctgcccccaagcctgcaccctcttcatctcttctttgtctatagcaaccatccccaatcctgacatcagtgattgtgtgtgttgtgtcttgtctgtcctccatagcaaccatccccaatcctgacattggtgattgtgtgcgttgtgtcttgtctgtcctctgtagcaaccgtccccaatcctcacatcagtgattgtgtgtgttgtgtcttgtctgtcctccataacaactgtccccaatcctcacatcagtgattgtgtgtgttgtatcttgtctgtcctctgtagcaaccgtccccaatcctcacatcagtgattgtgtgtgttgtgtcttgtctgtcctccataacaactgtccccaatcctcacatcagtgattgtgtgtgttgtgtcttgtctgtcctctgtagcaaccgtccccaatcctcacatcagtgattgtgtgtgttgtgtcttgtctgtcctccataacaactgtccccaatcctcacatcagtgattgtgtgcgttgtgtcttgtctgtcctctgtagcaaccatccccaatcctcacatcagtgattgtgtgcgttgtgtcttgtctgtcctccatagcaaccatccccaatcctgacatcggtgattgtgtgcgttgtgtcttgtctgtcctccatagcaaccatccccaatcctgacatcggtgattgtgtgcgttgtgtcttgtctgtcctccatagcaaccatccccaatcctgacatcggtgattgtgtgcgttgtgtcttgtctgtcctccatagcaaccgtccccagtcctgacatcggtgattgtgtgtgtcttgtctgtcctccatagcaaccgtccccaatcctgacatcggtgattgtgtgcattgtgtcttgtctgtccccacctagaatgtgagtttcataggaggagacttgtctgctttgctgagtttctaagtgtctccgtcggttccctgcacatggtcagtgcacaacaaatgtcagttgaatgcttagtacttaggagacatgaggctttcaattttcctcagttaatttgtgtgacagtaatgcatatatatggttcacttaaaagccgagtaatatagggcttaaaataagaagcaacagatcctgcccctctttcctgagctcacccaggggcaacagtagcctctcccacgttgaggtcctgcggcagctgccacttttccatatggttccacaccatctcatcaggagttgactcagtcctcctctgtgtagcccctgtggtgccccctgcactgtagggtgaggactgttctctttcaattcccctatgtccaggctgtgttagccaaccctgtggtgccccctgcaccgtacggtgaggactgtcctctttcaattcccctacatccaggctgtgttagccaaccctgtggtgccccctgcaccatacggtgaggactgtcctctttcaattcccctacgtccaggctgtgttagccaaccctgtggtgccccctgcaccgtacggtgaggactgtcctctttcaattcccctacgtccaggctgtgttagccaaccctgtggtgccccctgcaccgtacggtgaggactgtcctctttcaattcccctatgtccaggctgtgttagccaaccctgtggtgccccctgcaccgtacggtgaggactgtcctctttcaattcccctacgtccaggctgtgttagccaacatttagttttcacactgtcaagttaaaagcatcatgcccagccctgcagctgcagtgatgggtggatcctcggggtgctccctgtgttgcagctgtaccagcgttgattgcagacaagccgagtggggccctctgtgcccctgagccacggggcaacagagtaagaccccgtgttactctggaggagaagactctttgtgcagttccaagagatgctcctgcttcatcctgcaacagccgccccaaatgtgccacttctaactgtggtgttgggactttctcttcttgcatagtttttctttgtgtttcccaaaggttctggtcacttcctttcctttgtgtctccctcctcatcccctcctgacctcactcactccacctgtcttatcgagccccccaagcccagaggtgtccgctggaatcctggctctccagcccaaggtcaccttgagatgccacagtctgtgagtgggaggggaaatcggtggggtggcaggaggccgcccgggacaaggttgcaggggcaggtgcgtggcgtgctcagagctcctgggtgaaccagggagaatggggaaggccttgaggagcctggcgacggtgaacccggcaggtccatggtctccactgggagatggggaggacccgctgggcaggggagacagtgcttctgggtgagaaggtttaattctgtaaggatatgaattctctctgaataaacctatacatgtaagttatcacaacagcatattaacaattttttttgaaattaaacgaactagctttaaagtccaggttcagacacaaacatgagactaaacagaaaagttatgaaaaagaaagttgtgtgtggggcgttgagtcttgcacactcagtgctttgcagtgatgggacacttaagccagagtggggaacagacgggcagattgaagggaaagaatagaaagtctagaaatagacccaaatgcgtatgggtatttggtatatgataatgatgacattttaaatcggtggggaaaagatgtattattcagtaatgatttggggacaactggccagacatttggaaaatacatagctgggtccctcccaaactccttaccccaaaataaaatccagatggcacagagacttaaaaatataatggaattttacaagtactggaagaaaacgtgggggaatttttaataattttgcgatggaattaatttttttaaggaagacagcccaatatctaaggaaattaaaattcacataactttaactcaccagcctgactcctgggaagttatgtgatggatgttcaggcctgggtgtaaagaaccaaatgcgcaatgattctgtgaaacattatcataggaaaaaaccgcgagcgttctaaacacccttcaagttgtggttcatcttcaagacggagttaggtagatgggctgacacagaaggacctcaagacattttgaaataaaaaaggaagatgagaacagctggaatccatattagaagaagatgaacctggaccgaatttctttcggagacaccaactcctgtgctcatgggtgtgaaaggcaagactataaaggttttcaactgagaatataatgtttcatgactttagggcggagaggaaggttttgagacaggacacaaagagtgctaattgcaaaggaaattactgataatttcaactatattaaaatcaagaataactcttagtaaaaaagacaccgtaaagagaattaattaaaagacaagccacagaatgggagacaatattttcaacacatgtaaatgacatgtaaccgacaaagatctcacgttcaaaacagagaggaccctgacaaatcactgagaacaaggcaacgaaggaaacatttgcaaaacatttcagaagttctaaggagaaaattcaaatgactgagaaatacgtaaaatggtcttcaacctaattattaaattggagtgatgaagacggaagccgtatgaaattcagcagctcccctactagacgggcaaaaaccggaagcaccagctccaggtgcagctgcgacgtggggcggggagttcctggaagcacctggctgtgatacacaacctctgagctcctcgggggcttggacagcaggtgggcaggtgtgctggaatgtggagaggtgtgtttgctgcggctgaggtttcgctccttgccctccacgcagcagaagcacacgtacgcctggtcagggagatgcgcaaggaagcgcgtaggtggcatcgtttacagtctccccaggctggacgtgacccacatgcactttggtggtggaggagaggaagattattttattttcatacaatggaacagtggaatttagccatgacggggcgactcggatcatctcacagacatgaagctgagtgaaagaaggaaggtgtgaaagacgacaggccctgtgaatctggtgcagaggcaggcgcggccgtgagcacagcttccatcaagtcggcggtggctccccatgaaggtgcagcaggggtgggggttccagctgctggcgggactatttcttgagtgctgtttggatgaatattcacttaatattgtttgctatacgatgcgtttttgtgcgcatttctctattatatctatgaggttaaaaaaagcaagaatgaatctcagttgtgtttcaccagtgtgtgtgtatgtgtccttgtgtgtgggaagacattctctgaggcagcggttatggactgaatgtgtctcattgaactcagtgtgtagaaggccaaacccccaggggatggtgctgggaggagaggcctttgggccgtgattgagttagatcacccgtgagggtggggctcccacgatgggataggtggcctttgggcggtgattgggttagatggggtcttgagggcagggcttccgtgaagggaccagtgctctcgtaagaagaggaagagtcctctctcctccatgtaaggacgcggtgagaagccaggcggaggccatcaccagagcagactgtgctggcacccccatcccagacttccagcctccagaccatgaggacgtttctgtgtgagtcacccagtctgtggcaccacggcatcctcaccaggttcatctgtgctgtggccaccttggattcgtctgtactacagcaacgttttgtgttgtagctttgcctttgcttaactttgtaaaccaaatattttaggaagaaaaagaggtttagtgttcctgtttgccaggaaaatcacaagggattatgcgattgtgaatgaactaagggtcaccagtgcaggggctgcgggaaactgatgtgtgacatgctctccactcatcctggctccattaccacactgaagtggcatccatgagtttggaaatcactaaggcaaagaagtaagggctgaactcctccaaatgttcctgactatgaattaagcctcacgggttcacttctgcctgttggtgtttggtctcggcccgcgctatgtgtcttgcttctgcctgttggtgtttgtttggactcggcccgcgctgtgtgtcttgcttctgcctattggtgtttgtttggactcagactgcgctgtgtgtcttgctgttgtgggaatctgtgcatcgtcctctcttggtgactcctgagccaaggctgacactccactcttcgagcaaactgaactatagcatgattgtatctgctgctgctccgggagggccctgtgggccgaccaccctcacctgcccttgggccagcccttgcttcctctggaagcttcttgagcttgagttgtgggattgacatgtacctggaattgttggttttggtatctgtcattggagacaccatccctaccccacgcatgacctgggagaaaacggactttgacgtttgattgttttcagtgttcactgggagggaagagaagtcaggattacttttcctctggtgtgaaagtccctggaccctaaacacaccctgttgtccacaggtggtgccgagtcccacaaaggaacctggaatccagctgagtgggcacgtgctgcctgtcacggcccttcatgtcctgaacatctgttgagaggaggcgggggtgtcaccttaattccatcttggacaccacagtgacacaaagtgcaaagtgccgtgcccctcatccccacagatatgtggcatcccactggtctcctaaccacccaacgccgttgctcctgaccattggaaacgctggtggggctggagcacctggacagtccagtctcgttctagtggctggactggagtggggttgccttgaacccgtcttaggctggaaatgcccccagcagcagtgccaggggaactctcactggggcctgccctgggagccccggggaacacttgtcagttcagctctgaccttaaggtgggactgccccatgcccttggcccaggagtgggagctgcaggaggagcccctcatgctacggccctcccgctgaggggctcccctgggggcctcaaattcagcatcaggcgccagtgaagactcagctcctctggaggggaccccctccccaccccaccctcctgcactgcagcgctgcccagacctgggtctgcggagacttctgtttgcctctggcctgatgaaagcagtgtggaaaccaacctccctcctcctccccagatctcttctctttttggggggttttcatgctaacttactattttctctaattaagaagcaatacatggctattatgaaacatttagaaaatgtataataaatactaaaataatgttaccgttctgatttatatccttccaagtccacttctctctgtgttctaaggatgattctcagacacccagcctgctcctgtgtctgggccactctgctgggggcatgttgttgccgacctggcctgtggccttccctgtgagattcatcctgggagtggtcccagaaagcagccctggcggtggagtggctggagtggggcacgccatgctgggcttggcttcaccctcagcagtgaggccctcttgctgccctgctgagtcggcacctggcctggcccagcatcctcgggctgacgatgatgccgggctgagggcctgtgtcctgctggcatttgccctgtgccgtgtggctgggtagcatggccaggagccggggtggggcaagaccgtggcttgtcatttccaaccctctgaggcccctttgtggatggcagcaggggcttcagcactgcccccgctctcggctctgctggtgctcgtaccccggcacctgcgcagagaggtcagctccctggctacggggcagccttcgtcttcactgcccgcttggctaacagcttgacgcagcccaccactggcccaggccttggagggatgtttgctttccaggggcctggcaggacgcaaggcaggccgggtacccgtgcaggtggctttgtttcctggagaggtggggaagaggctctggcagcgggagcaagctgggcgggtcggccttatcgggccgcgtgggcagcatgtgtggctgagccaccgggctccctggggccctgctgcttctgggctgcccagctgggcaggtggtgccgccctggcctgagtccgtcagggcctaattatggagacgggtcttgtgctctgtagtggttattagctgccttcctctttttttttggtgccaaagaattccatttggggaatttatacagccaattaggtatttagctcaaggcaattaatggctggaatgcaagcattagctaaaacctaaattggaattcatacatccacgcttttgcttaacggtggaggctgcagggaggcaccgagtgttgtctggggagctaggagaggctgcccaggcccagagaggaactccagattggctgtggattcatggctctgtccttgcttgggaaggaatgtttcagtgtttcagagcaaaaattttaaatctgtttgacaatcagaggccatcctggtcctgcctggagctgctgttggcctgccccacctggcatcctagctgcgtccttactgggcacgtatgtcaccgccttcatctctttcaaagccacccgtgggcttctggtcatattgtgatgaccctcgaaagtgacggatgccgtgaggccgtgggaacaggagctaggaggctgcaggccggccgccttcagtccacagaagccagatttgaggtgggttccggatgtcatgggtgccctggacaggtggctgtgtgacagcccagcgtgcctgatggtggacagaggctggggctgccatggggctgggcttctccccagacagggagcagtggagaattctcaccaaaaatccagatagatgaaaccaaacaacaaaacttactgcttttctcatcaaccaagtaatctctgaggaaattacaccagggaccattggattttcaagctgctccgtgtgtccatggcagcccaggcagggtccaggtggggtctgcccgccgggggcggctgtggcccaggcagagtccgggtggggtctgcccgctgggggtggctgtggctcgggtgggtctccgtgtgtccattgcagagcctgggtggggcctgcctgccgggggcagctgtggcttgggtggggctccagctctcacgacagactccatcgtgagtgggcccagcgtggtccgaccacagcaacacctcatactggcctgggaatttccacattaaaatatagttgaaagtattcaatttaatgtaaaattaaaatgtactttttcttacctatagcttatagattgggggtaatttttctctgtctctcacacattcaggcacacacccaccccataaacagtccctcaacctctaagtggtttgcaaggacagaatgtgcccaggaagacctggggcgagctgggaatccggactttgggcaactgtgtgttggtgggctgggtggggcaggagcctggggtgctggggcaccagggtttacctgcccacgctgagtgtcctgggttctcacgtgtcctgagttctcacgtggggtggtccgaaggctcacctgggcgcccgggtttacctgctcatgctgagtgtcctggcttctcacatgcggtggtccgagggctcacctgggcgccggggtttaccttctcacatggggtggtctgagggctgacccggaggcttctgagcactgacatggtcttgccagtgtccactgatgatgcgtctgctgctctgtggctcacggggacaggaggaggtgggagcaggagccatctggggcaaaggagggacaggctgacttggggcagagcgccctctcagggtctcctggccccaccaggcagcatagaccccaagatgcggcaggaagctgttcccttgatgagcagcaggcggctgtctgcgttcagccctgcacctttgcccactcattgttggaggacggccccgttatgggctggggcagaggcgaggggtgggtggagattagggccagacgaacctgaaggccctccagagcctctgacctgttcccgagaggccgcggggtcactggtccggctcaggctctgccaaggagcctccttggggtttctggcgcctgcactcagggacggcaccacctgcgatggaggctgctgtgcagtgtagagtgtggtggaaactccctgcctgggttgcagacggggggatttaattagggaagggatccagggtgaggacagtcagggcagaggtgagcaggtgggggcgcttggctcttcctttggtggtgagaacaagctcagggccgagtcagccacacaaggcttcaggctgtgcagataaggaagggctggccagcctcggggacagggcagtggggctgaggggctgtgtcacccagggcctgccccctctggagacaaagccctgaggctgggacatgcctgggaggaggctcttgcccagcgagggtgaagggcatccagctctccccagccctcctggttaagcccagctcaggcccttttggggagaagtcacggtggcaggtctcacggtccacacgctgtggtgggcttgctgctgtgcagagggccgtggtctggcatggtgccccgccgggtgcggccgcgttttcaagaggatgcagggggagaattgttgatgaaagagagcgggccctgagcaatgaacttggggtgtaagctgcacagcagtgaggggacactgggggctttcttgggatcccaaaaatggccgtaggagaggacctggcttctgtgcatgtgacgcaggccctgtgggtcttggggtctgtgaggagcactgaggacgaggaaagggagacaggctgaggccatctcggttggattccacaggaaaggccgcagccagttttcctgagacgttctggcgagcagctgcacggtccgaggctttcacttgcttttcattttaggctcactctgggtctaggggggtcttggtgctgtgtctaagctgctctaacagggttttggcctgggactctgaggctcggcctcttctcacacaggtggtagagagattcctgcccccagccgggagggcagcgtcaggtttatcaaactgacgtttgcagcaggtgtggagattttgagtgaagtcaaatcaggttttcagggagaaacaaacactggccgtgggtggggacttggggacccagtggggctgcaacaggggaggaggcgcctgggcgctggggctcacggccggctggggctcacctcagcttcccgagcacagtctgtgatggcactggcgtggcctggcctctccaggacctgttaggaggtgacggtggacaggcctgtgaacattccgctcttgctggagccaggcgaggctgccggaggggtgctgggctgcagcatccctggggcaggtgcctgtctccctgcctgttggaggggtgagtggcagtgcccacaggccccctcccttctctagcacctccccgtgcagtgggagagggcaggaccctgactgaacagggccatcctgaaaggaggagaaggtgctgctggaatgacacccagagacgggtatgagcccagacacccaggacttggggtaggccagagatgggtgtgagcccagacacccaggactcggggtagggtgccacatgggagcagctctgcccctggccgtcccaggcagccccgttgctggtggccaacagtccactctgacaccgtcacccagacaaggacccccagagcctcacatggtagaggaagctcctgtgtgattcacctgctggccacaggccttggaaccctccctgctgagtcttacttttaggaaggacctcatgggcacccctggtaggaagaggtggctcgcccaggtggggacaagcagctcgcacgcttggcaggaagatttgccccacgccgctcccccatcaggaagatttgctccacgctgctccccctgttgggaggagtcgccccacgccgctcctcctgcttcctcccctccctgaggcatcctggtagccagggcagcccaggattcaacctaagagctgcatagcgtgactgaccaggcggcgggcagcccccaactcttacagacccgtcagtggggaaacagtctcgtcagttctccgttgattcattttagcctttacccagaagtcaagtttgtctgctgatttgatataaacctacccttggatttccggcaactcaggcaagaggtggcaacttcggagccttctgtgccttcggggagaagccatgcctggcgctgccctggagccgcgggagccgctgggctgagccacggaagatgggcttggagcgtcctccgcagcctccgctcctgcctctgcccacaaagacccgctcgcccagtgacctgtggccacctagtgggaacaagacatttgcaatgtgcttgttgaccaggttaagagtcattctggtttaaagggaacaaaaaaggtgtttttttgcttttttttttttttttaatacttatttgtgttcctgaaaaggcttctgtctgctttagtaccgtctttctaggccaaagactatgctctagatttataaatatttcttttaactcactaatgtgctcatttgcttggaggccctgtcctcctcttgtccgtaaggcaagaatggtggcaggagataaaatctgttttaacttctccaaaaatggaaacgtgtcattttattttctgacaaaaaaggaaacatacattcccttccgtgcctttttcatatgcatgtttcctgtaactagaattaaagcacacaggagaaaaggaagcaggcggaacgctgcatggctgggtggtgcagaagggtacaagccacaaaatcagaatcacctccttacgatcctaaagccccaaaataatcatggtgaagaacattcgggtaaatgtctgtttagatgctcttctgggcacacacataacaaaaatggaatcctgtagttctgcaaatttttcttatcacttaccaaatctcttactcctgaatgctgagtgggcttccactgttgaatactgatacgtagcatccatggcatgcaggtgccattatctagtgaaccaaccctctagtggagaaaaggtaggttgcagtgtttcttcatcatgcagatgataaccatgaataggtaactggtcactttcagctctcgtacgtttgcacatagagaataccatgcatttcagggttctcaggctcagcttctttacacattgtatgatgacattctcagctcatctttgctctcagatttttaaccatgtcaggtaatcagagaatgatttccttgctgccaccatcaccactgccatgaccattactatcaccatcaccaccactgccaccattgccatcaccatcaccaccactgccaccaccatcactatcaccaccaccaccactgccgtgaccatcactatcaccatcaccaccactgccaccactgccatcaccatcaccaccactgtcaccaccatcactatcaccatcactatcaccaccactgccatgaccatcactatcaccaccaccaccactgccatgaccatcactatcactatcaccaccaccactgccatgaccatcactatcaccatcaccaccactgccatgaccatcactatcactatcaccaccactgccatgaccatcactatcaccatcaccaccactgccatgaccatcactatcaccatcaccaccactgccatgaccatcactatcaccatcaccaccactgccatgaccatcactatcactatcaccaccactgccatcaccatcgctatcaccatcaccaccactgccaccattgccatcaccaccaccatcactgatcaccatcaccatcaccatcaccaccattgccatcaccatcactatcaccaccaccaccactgccatcaccatcactatcaccaccaccaccactgccatcaccatcactatcactatcactgccatcaccatcactattaccatcaccaccactgccaccactgccatcaccatcactatcaccatcaccaccactgccatgaccatcactatcaccaccactgccaccactgccatcaccatcactatcaccatcaccaccactaccatgaccatcattatcaccaccaccaccactgccaccactgccatcaccatcaccaccatcactgatcaccatcaccatcaccttcattgccatcaccattactatcaccatcaccaccaccaccatcaccatcactatcaccatcaccatcaccatcaccttcattgccatcaccattactatcaccatcaccaccaccaccatcaccatcactatcaccaccactgccaccactgctatcaccatcactatcaccaccatcactaccactgccatcaccactatcaccatcaccatcactaccacccctatcactaccaccagcaccaccatcactaccacccccatcactaccaccatcactactaccactgtcaccaccaccacgactaccaccacccccatcactgccatcaccaccaccactaccaccaacaccactactaccccatcaccatcatcaccaccaccatcaccactatcactaccatcatcatcaccgtcaccaccaccaccttcaccaccaccaccaataccactgcccccaccaccacccccgtcactgccatcaccaccaccaccactactactaccaccatcaccactaccacccccatcaccatcaccactatcactaacatcaccaccaccactgtcaccaccactgtcatcatcaccaccaccttcaccactactatccacccctatcaccatcaccaccaccaccaccctgtcactatcactaccaccatcactactgccaccatcatcaccacgaccacctccatcaccagtattaccaccatcaccaccaccattgttaccactatcattatcaccaccaccgccgccactgccaccaccaccatcattaccacatcaccactatcacccctattaccatcactaccatcaccaccatcatcaccaccacacccatagctactaccattaccaccatcatcaccaccaccactgctttcactatcaccaccaccactaccatcaccatcactgttgttgaggaagtctgcctgaagctgtgctagaaccctactgcaccagtcctgagataccacagccaccacagcctctgatttgaagcccgaatggaacggacaatccatctagcttttgggagctggacctggagcatttggtatctgaatgtcaagtctttggagggtgtgttcgaggtggcgactttgcctaccagaaggcagctttgagcatgagtctctacctttatgggctgtggccacacaccatctgttgttgcaactgaatttgggagaaatgtccactcagaaatgaggactcattagggtgagaggccaggaggttgtcaggacccagtaagactcatgtgaggatagggaaattaagatattttctaactgatttagtacagtgtgataggaaatgcagatgcctcaacatgatgtcacagaaccccaaaccaatgcctccctgggtttctcatcaataaatcagtcagccccaggcctcagtatttccacgttgcaaaattatttccacattgcagaattatttccaaaagatctagcttccttgtgggcactacgaggtgcaccccgtaaataagcctggagctccacagactgggccatcttgttggtcgttcagagacttgtcttacaatcagtacaaactgattttcatatctttactttctatgtctatggaagatgcatttaatatgcaatctttatattaatacacatcatgacttgatatttaaaagaattagagatggtcatgaacttgagttggcaagctttatctgtaaaggaccaaatgataaatatcttggctttgaaagccacaaagattactgtttcctcctcctcatcttactccttctcctcttcttcttctcttccttctcctcctttcttctctcttccccacttcttctctgtccctgtctccatctcatttttcctacaacccttaaaaaaatataaaaaccattcttagctcaaaggcttgtgagcacaaaatatctgagaaaggtctcagtcaatttagaaagtattttggcaaggtgaaggatgcatccatgatacagcctcaggaagtcctgagacttgtgcctgaggtggtcgggggctgaggcatgcgcaggaggtggacgggggcctgaggcatgtgcccgaggtggtcgggggcacagtttgcttttatacattttagggagacatgagacgtcaatcaatatgtgtaagacatactttggttcagtccagtaaggcgggatgactggaaatggcggcttccaggttagaaatagataagagacaaaagtttgcattcttttgagtccttgaccagccttccagtgaatacacaattgagcctggctcagtgaatctgcatttttacataagcaataggggagagggagcaatgagatgcatttgtctcagggcagcctcagaggggtgactttgaacagaatgggaggcaggtttgccctgagcagttcccagcttgacttttccctttagcctggagattttggagtcccaaggtttgttttcctttcccaggccctacatgaaaagacaggtggggtaggtcccggggctctggtttgctgacccctggtcagagtgtctttgaggaagtcactatcagtggaaatgtcactaaaccctatatgctaatcagctgggcatcagcctaaagtgtattttcacacagcacgattcatcattagcaaattccaggaaaatcaacaacgatcagaactgaccttctcttggctataatgatctgtttgcatcggatcagatttcctgtggggaacaactagaagtgctgggtaaaatccacagaatgcctgctttggggagctgcggaggcaaccgggatttgagaggccaagatcctgttaattagcctgttttgatgattccacaatgtatatatgtgttgaaacatcacaccgtagcccataaatatgtacaattatttgtcaattaaaaataaaataaaactttttcttttttttttttgagatggagtcccactctgttgcccaggttggagtgcagtggcactgcaacttctgcctcccaggttcaagcaattctcctgcctcagcctcccagtagctgggattacaggcatgcaccaccacgcctggctaatttttgtatttttagtagagacggggtttcaccatgttggccaggctggtctcaaattcctgacctcaggtgatccgcccacctcagcctcccaaagtgctgggatgacaggtgtgagccacagcccctggccaaaaaaacttaaaaaagacccatcggaggggcactgttagggagcccactccctgcgggctgcctgtctcctgggggcatttgtgattcctgtcgaaagaggctgagaaaccaggcaagggctgtggagaagaggcagtgaaacccacagagcacttggcaacctcatagggtcatcaacacacaaatagatgtttgcattgcaaaggttaccaggccctgaggagactggatcccaaagagaaagtaggtacagaggcaatcagcacctgtggctttcacctctgacacatttgccaaattcttgagttgaatcagaggctgatcagaaagctatggaaaagcagagcaggatttctggcagtctcataatgctgaagagatgaaactggaattcaggaacttctaagaaagaggggccatcgcacacatcccaggtcccagccccggatgggtcatgccataggtgtgaggataaaccccaggtgactgagccttccaagaatgatgggtctgtcttcttgtctcaggcctcccttgagttaaggggatctaccctcgatctggctgtctagtgaggaggaaggtaagaagatagactcacccagagtctctgcagtttcatatgtaatgtctgaatttcagttgtcaagaagcaagaccaagacacaaaaacagatgacaacagtacacccacagatagttattatacttgttgcagtcaaattttaaaataactgtggttgatatgttcaagaaaataaagggtaagtggaaaatttcaccagaaaaattgattctataaacaaagtaatcaaatggaaattctagagctgaatctaataactcaatagatgggcatcacaaaacattgagtatgaaggaagagcagatgagtgagctggaagaaggtccctgggaaataatgaggcagagtaacagatcaaaactgagagaaagtacaggacggagtgtatgaggcagaggagatctgttggaaaggtctatatgtgtaggtggagtcccagaagaggagaaggaaaacagcttagaagcaatgtttgaggcgatgagagctatgatttttttcaaacctgaagaaagacaccaaagcttggattttaaaaaatctattatatagctattttaaaggtaaacaacagttgaatattggcagttttgtgtggttagttcaacctcacagaatgaacacaaagaaaaccctacctctgaacatcactctaaaattagtaaaaaccaaagtttaagagaaaatctggaaagcaagcagagaaaaatcataggaaattaatctctattgatgaattgtttcaccagaaaccatggagaccagaagtgtgatgaacctcgcatgtgatggaagaaaacaccccatcaattcaagttctctactccctggaaatgtttctcaggtataaagatgaaatcaagacgtgaccagacagacagaacttgagagactccatcaacagatgactcttaggaaaagacagacagaactcgagagactccatcaacagatgactcttaggaaaagacagacagaactcgagagactccatcaacagatgactcttaggaaaagacagacagaactcgagagactccatcaacagatgactcttaggaaaagacagacagaactcgagagactccatcaacagatgactcttaggaaaagacagacagaactcgagagactccatcaacagatgactcctacgaaaagacagacagaactcgagagactccatcaacagatgactcttgggaaaagactgcaggggcttctggcaggaggaaagtaaacccacatggaaaccaggaaacaaggcaggcagggatagcagtgggaactatcaatgggttggtaaatcaacacgaatattggtggcacagaaggtaaaggagttagtgttctcaggttttggcattatccaggatgcgataatgcgtgttacactaataagtcagggatccatgtccttttttgtggaaagaacatataacatgagatccaccctcttaacattttaagtgcatggcacagtattgttgatgacagccatgatctgtaccgcagatctctagcactcgttcatcctgcagaactaaaacttgatacccattgattagcaatacctcaccctgccccgacccagcccctggaaaccaccattcttctctctgggtctacgcattggactattttagatgcctcgtctaagtgaaatcatcagtgttatcttttctgtgcctggattacttcgctcagctcatgtcttccaggttcatctatgctgtcacttacagcaggattttcttcttttttaaggctgagtaatgtttcattgtctagatataccacatgtaaaacatccatccatctgttgatggacatttgggttgtggccacatcttggatattgcaaataatgccacagttagtgtgggaatgcaagtatctctttggagatcttgattttgactcttttgggtaaaaacccagagtggggttgctggatcaaatagtagttctatttttaattttttgaggaacctgtatactgttttccataaggaccttttgcattcccacaacagtatacagtcttcaccaatactcatcttttttttttctgataataggtatcctaacaagtttgatatgatagctcattgtagtgctgatttagattttgctggcgattagtgatgtcgagcatttttgttgtatacctgcagtccatttgtatttcttcttgtgagaaatgtctatttaggtccttttgcccgtttaaaaaatcaggttattttgtttttggttattgggttgcagcagttccttatacattttggacattaaccttttaaaaagttatacgatttgcaagtattttatcctgttctgtagattgccttttcactgttgattgtttcttttgcagaaactttagtttgatgtagtctcccttgtctgtttctgcttttgttgcctgagcttttggtgtcatatccaaaaaataattgctaagaccaatgtcatgaaggttttttcctatatttccttctaggcggtttacaggttcaggtgttatgtttaaggcatgaatccatttttagttgatttgtgtgtgtgtatggtataaggtaacggtccaattttgttatgtgcatgtgtgtatccagtttttctgacaccatgtgggatgtgatgtgtgttgcaccatgataaatcaaggtcccgtgttattatttctagaatagccacaaaaagaatagctaacaagctaagaaagggaatcaaaataataataaaaatactccatccagaagaaagcaataaaggataaaaggaaaaataaaacagatgagacaaataaaaaaacaaggtaagatagtcgatataaatcccaatatattagtaatttcattgtaaataaatgagataaatactccactcaaaaattaaagattgtcactaaaaaacaaaaccacactgcttgcaagggaccaccttcaatgttgagatataaaagtttgaaacgctggaagagaatacaatgaaaacactaccctaaagaaagctggtatatctaaactaatatacaaagtagatgttaaggcaggaagcattttccgagataaaaagggccataataaatataagggttggtctatcaggaacacacagtaattataaatttgatgcacctgatataattttcaaatgtataaagcaaatattgagataattaccggagagaataatgcacatttttatgcatgtttgtttttattattggtgtgtgtgtcctgtcatgtatttagagagacatgctgaagcaggtctgaagaacgggattaatggccttgatctaatggacacactgcaactatcaaaatagaacctgtgttcttttccagtgcacacagcatacatattgaaaatgaccatctattagacggaaatgttttgatcagataaacaaatcttaacatattgctaaagattgaaatcattcggagtatttctttggccaaagaaattaagctaaaaacaaatggaaaaaaaaatccctagaaaatctaaatgtttggaaattaagcagtactcttctaaataccccatttgtcaaagaagaaatgtcaatagaaatctgaaaatattgtgaactgaactataataaaaatacaatattaaacaattttgggaattttgggatcaagttaaagctatggttagaaataaattataaccttagatgcttttattagaaaagaagaaaaggtgaaaatgacatatgtctaaagagtgtagaaaaagaacagaaaattgaagttaaagaaatataagaatataataaaaagaaaaataatgtaatagaaaacaaatgtacggtagagagaatgaacaaaaccaatcattgcttctttaaaagatgtgaatatacacttctggcaaggctgatcaagaaaaacagaaggaaggaccaacttaccagtgccaggaatgaaaagtggacatcgctatcaatccgtatcatcagcagcttttgcctgtaaacttcagaataaagtgacaaatgtagctatgtattttttttaccctgtgatcaaataatagcactcctagatacatgtattcccaacagaaatgcagactgaggtatgcaaaggacatgtacaagaatgtgcctagcagcttggttcgtatctgtggaagctgaatatatctgtcttttatggtctagtaatcccactcctatgagtacatacccaatagaaatgcatccttaaatatacaaaaaggcctaagaatgttcccagcagcttgatttataacagcttacaactgaaataacttacacgtctatgcacaggggaatgtagaaataactgtgggatgttccatgcaattaaatactacagagcaataaaaaaccaccagctactgttgtacagagccacacaggtgactctcacaaatgggatattgcgcaaagaagccggattcaggagagcagagagtgtgattccacggacctacagttcaaacaggcaaagctgacgttcagcctggaatttagaatgatggtgactgagaggatgggggcggggcttgtgggttatgaatctatgtctgggtgggagtgtttgttctgtaaacatttgtcagggcgcggggcctcttcccccttcctcgttcctgttttcactccaggtcagtcaccaggtgtttcttttgtagcaggagtgtaagccattctagtgagggtgaggttgtcttaagctctgttttatgggggttgcatctgttctgagctggccttgctcctggaaatcccgggccaggctgcgtcttcaggcagcaccaagctgtgtacttctcactggtgaacgctttggaatgcatagtatctcaacaaaaagtttgtaaagtgatatttctaatagctgttgtttgtttgcataatactttaaacatattccaggagcttgaaaacatattatctttactgatagtctcagaaaaccttcgcaggaggctgcaggcgtttaagtgatgtttgccttccctggtagaggtggggcctgggccagagcttgcaccctccccctcctgaacactgttccaagacgacacagaggttacattttcatgaacaaaacgtttgaaatccgctatctgagctctgtgttacaggactttgtcgtttgtagtcagccctagcttgagaggtttggatgcttgttcagggaaggagcctgggatcctggagcgcccggtgctttcgccctggctcaaggccccgccgctcctcatgagtcactgtgtgtggttcccctgaggatctggggaaaacctgtgacgtctccctgaccgtgtcgtgtttctcttctccctcacacgtcattaaaggtccagcgagaactctgagtcctccccgccctggacaaggcatcccgtgagtcagccagaatgttccgtggtcctggctgcagtgattggctcaggaggggtcatgtgaccaaaggggatcctgttagagtggattggactctgaggatgctggacgagaatctgcatttctgctcaggtgggcttgtcactgctggcacttgagggctggtgttggtgtccagcaggcaggtcagagagagggacgagcaggtcccggataacatgatggagcactcagacacagcttcccctggcaccagcctgtccctcgggtgggtggctgtaagccagtgtgtgcccagtgtgtgcccggtgtgagccagtgtgtcctggtgtgtgcccagtgtgagccattgtgagccagtgtgtggccagtgtgagccagtgtgagccagtatgtgcccagtgtgagccagtgtgtggccagtatgtgcccagtgtgagccagtgtgtgctcgatgtgagccagtgtgtcctggtgtgtgcccagtgcgagccagtgtgtggccagtgtgagccagtgtgagccagtatgtggccagtatgtgcccagtgtgagccagtgtgtgctcgatgtgagccagtgtgcctgctgtgtgtctggtgtgagcccagtgcaagccagtgtgtgcccagtatgtgcccagtgtgtgtcgtgtgaggcagtgtgtgcctggtgtgagccagtgtgcccagtgtgagccattgtgtgctcgaggtgagccagtgtgcctggtgtgtgcctggtctaagcccagtgcaagccagtgtgagcaagtgtgtggccagtatgtgcccagtgtaagcctggtgtgtgcccagtttgagccagtgttgagcccggagtgagcccagtgtgagccagtgtgagcccagtgtatacccagtgtaagccagtgtgggcccagtgtgagcccgctgtgaggcagtgtgtgcctggggctcacgctggctgggatcttttctttgatctgtcactgaaaacattcagataagaatttggttctgatttgcttggaatcacacagtgaagaatttgaacttgctttcctcagtccaagctctttgcatttgtcatgttctggggtcttgggtggtcctcgttagccagctccctcaagggctgactggagtcaaacatgtctgctctggttctgctcaaacatgtctgctttggttccacggtcagacacagccagggtcagatggccactgcctgggggtctccgtccagagaccattctgagagtgtggggggctcttcccccttcctcactgctgttttcactccaggtcagtcacccggtgtttctctcatagcgggggtgagctgggttcaagctgtcatgggagttgtgtctgtgctgagctggccttgcttcctggaaatccaggccgggctgcggcttcctgcagtgacacggtgtcggccccacaaggcaccgagtgggctttatggcttcactggtcccgcagccatgctgcgtctcttgtggtggagacaccaccaaatgttccctgtcaattaggacaagaagcaatgcactcccatgcagtgatcttgactctcagagcgggaatccacagggagggggtgccgcgctgagccgtgcgaggccccgcaaaccacagagcgcttctgggaacatgcccagggtccacaaaccccagagcatttctgtgaatgtgcctggggtggttttcatcttcaccagagacttcccacaagtggtaccgacttccgggtctacaggcccctcagcctgtgagcgccagcaggctgctctccctcacctcatcccatgctgagtttgtgcactctttagcccactttcaattcagttggattcttctgctgcttgggatccttacaaagcattgttgtttaagaaaacttcatgtcccagctgggcgtggtggctcatacctgtaatctcagcactttgggaggccgaggcaggtggatcacaaggtcaggagtttgagaccagcctggccaacatagtgaaaccccatctctactaaaaatacaaaaattagctgggcgtggtagcgtgcacctgtaatcccagctactcaggaggctgaggaaggagaattgcttaaacccaggaggcagaggttgcagtgagccaagattgtaccattgcactccagcctggacgacagagcgagactccatctcaaaagaaaaaagaaaagaaaagaaaaagaacagtttatgtcccacgagtacggctacacacatcttccttttaaatgatcacttttgtttggagatttggacttgacatttcaggccattagctcaccatccatggcctgttatggaaacccactcctgcatccatctgtattaagattgcatttaataaaaaagccatgaattagtgaaaaaccagaaactgagttgagcccatctttccatatgtttgcctgctggcggtctggagctgagttctttcctctcagacagggctctgctgttgggatggccatgtgcttgagcggagggtggcaggagggaggtgggaccaggccaggctctcccaggccgggaatgagggagctagcacatcaccagcgggtctaagggtttgtggaagctgcagtggggacccagcattgggctgacggtccgtgggaacgaggcagagatggtggtggagctgggtggtgcagagagtgcctgatggcgggaaggtcctggagaagggatgctgagctctgagctgcaggaggaacagctgctaaggaccagcgtggagagcctagcaccaccttcctaaggtttcctttgtgccggctgtggatctgctggaacgtgttcttccctggagatgtgggggagctcctgctgtggagagaggtctcagatgctgcctcccagtgctctcggcttcaggaaagcctctcgactgggtgacagccccaccctgcccctgaatgggtagggcacctccgaaacacatcggttggatccggaagcatgttcttagtacagagcagttagatgagactattacggtttagcaagcgagacagccagtgctaggagtccaaagccttggtctcagttcaggcttggccaccaacccgccacgtgcccacaggttgatgtagctggctcagctggaactcgtaaatcctcccacaccctgtttttcttgcagtaaggctgtcccggcaccagggtgcagctgggatgcccccaggacgatctgcatgacggtagctgcttttataatttccattgccatgaaaaatagctgtctttattggaaaagaccctgaaagaagcgagtaagtaacatacagacacggtgactgaacttccccatcagaaccaggaaggaactctgtcactgaactgtgactgcctccgttagacttggttcaccgcccggcccccttggatcactgactaaaaacgacccgactgtgtgaaacagaggcctggtcgagtaatggtgactctgtgacagataccttgcaggtactaaaattatacttcttaggagtttcttaagaacataagaaaattccggtggaatagtgttaaatgacaaaggcagctgtaaaagtgtcccaatactgcgatctcaaccatggagagaaacagccaatgccagcagccgtttcctcagatcggtgggttacaaataattttagttttctcctttgcagtttctgtgcggtggcacacatcgtttaaaaggacaacccggtgacttccctaagggttcccccgagggtcttgctgccgccctcgtcttctgagccaccaagagcaggccccttgtcttggatgcgctgcgagtcacgtccgacgccgctgtgccttcaccacctcatgttttattactgttaaaaatgaatgtttttccattttgggatgagagagtgccccagctcccctgccctcttacaggagtgaatttcattcgtggccccagtttaaagacactcggattggcttgttggtttcatcataaccttctttaaacacttggtgacaggctaagagaacccctgaaatcagaatgtaagtcctcggcggagttaggtatgcaggactcagctaggctggtctcggactctgcgtctttcccggcgctgtgcaggcctcagctaggctggtctcggaccccgcgtctttcccggcggtgcgcaggcctcagctaggctggtctcggaccccgcgtctttcccggcggtgcgcaggcctcagctaggctggactcggactctgggtctttcccggcggtgcgcaggcctcagctaggctggactcggaccccgcgtctttcccggcggtgcgcaggcctcagctaggctggtctcggacaccgcgtctttcccggcggtgcgcaggcctcagctaggctggactcggaccccgcgtctttcccggcggtgcgcaggcctcagctaggctggactcggactctgggtctttcccggcggtgcgcaggcctcagctaggctggactcggaccccgcgtctttcccggcggtgcgcaggcctcagctaggctggactcggactctgggtctttcccggcggtgcgcaggcctcagctaggctggactcggaccccgcgtctttcccggcggtgcgcaggcctcagctaggctggactcggaccccgcgtctttcccggcggtgcgcaggcctcagctaggctggactcggactctgggtctttcccggcggtgcgcaggcctcagctaggctggtctcggacaccgcgtctttcccggcggtgcgcaggcctcagctaggctggactcggaccccgcgtctttcccggcggtgcgcaggccccagctaggctggacttggactctgggtctttcccggcggtgcgcaggcctcagctaggctggactcggactctgggtctttcccggcggtgcgcaggcctcagctaggctggtctcggacaccgcgtctttcccggcggtgcgcaggcctcagctaggctggtctcggacccgcgtctttcccggtggtgcgcaggcctcagctaggctggtctcggacaccgcgtctttcccggcggtgcgcaggcctcagctaggctggactcggaccccgcgtctttcccggcggtgcgcaggcctcagctaggctggtctcggactctgcgtctttcccggcggtgcgcaggcctcagctaggctggtctcggacaccgcgtctttcccggcggtgcgcaggcctcagctaggctggactcggaccccgcgtctttcccggcggtgcgcaggcctcagctaggctggtctcggacaccgcgtctttcccggcggtgcgcaggcctcagctaggctggactcggaccccgcgtctttcccggcggtgcgcaggcctcagctaggctggtctcggacaccgcgtctttcccggcggtgcgcaggcctcagctaggctggactcggaccccgcgtctttcccggcggtgcgcaggcctcagctaggctggactcggactctgggtctttcccggcggtgcgcaggcctcagctaggctggactcggaccccgcgtctttcccggcggtgcgcaggcctcagctaggctggactcggaccccgcgtctttcccggcggtgcgcaggcctcagctaggctggactcggactctccgtctttcccggcggtgcgcaggcctcagctaggctggactcggaccccgcgtctttcccggcggtgcgcaggcctcagctaggctggtctcggactctgcgtctttcccggcggtgcgcaggccccagctaggctggtctcggactctgcgtctttcccggcggtgcgcaggcctcagctaggctgcacttggaccccgcgtctttcccggcggtgcgcaggcctcagctaggctggtctcggactctgggtctttcccggcggtgcgcaggcctcagctaggctgcacttggaccccgcgtctttcccggcggtgcgcaggcctcagctaggctggtctcggacaccgcgtctttcccggcggtgcgcaggcctcagctaggctggactcggaccccgcgtctttcccggcggtgcgcaggccccagctaggctggtctcggactctgcgtctttcccggcggtgcgcaggccccagctaggctggtctcggactctgcgtctttcccggcggtgcgcaggccccagctaggctggactgactctgcgtctttcccggcgctgtgcaggcctcagctaggctggactcggaccccgcgtctttcccggcggtgcgcaggcctcagctaggctggtctcggaccccgcgtctttcccggcggtgcgcaggcctcagctaggctgcacttggaccccgcgtctttcccggcggtgcgcaggcctcagctaggctggactcggacaccgcgtctttcccggcggtgcgcaggcctcagctaggctgcacttggaccccgcgtctttcccggcggtgcgcaggcctcagctaggctggactcggactctgggtctttcccggcggtgcgcaggcctcagctaggctggtctcggaccccgcgtctttcccggcggtgcgcaggcctcagctaggctggtctcggaccccgcgtctttcccggcggtgcgcaggcctcagctaggctggtctcggaccccgcgtctttcccggtggtgcgcaggcctcagctaggctggtctcggaccccgcgtctttcccggcggtgcgcaggcctcagctaggctggactcggacaccgcgtctttcccggcggtgcgcaggcctcagctaggctggtctcggactctgggtctttcccggcggtgcgcaggcctcagctaggctggtctcggaccccgcgtctttcccggcggtgcgcaggcctcagctaggctggactcggacaccgcgtctttcccggcggtgcgcaggcctcagctagactggtctcgtactctgcgtctttcctggcagtgcatcagcaggactttcagcctattgttttgggttcttagcagcaatgaacatgattgtttttgtcttaaggcctcaagtgatggccacatgaaggagggtcccctcctttaccgacagtcacctgatggtggatggtagttataactacagaatgccttctccgaaacacccgggccccagacctggtgagctggtatgggagattaggctgatggttaatgcctgtgggccccgagatccccggaccttcttgagggtgctgagcacacctggcgtgggagattaagctgatggttaatgcccctgggccccgaggtccccggaccttctcgagggtgctgagcacacctggcgtgggagattaagctgatggttaatgcctgtgggccccgaggtccccagatgttctcgagggtgcggcacatgcatggccactggggccaggcagcagcatcgtgcttgactctgctctcagggctctcagggccgcgctctgcgggcgtctcagtccccggtttgaagagcattttctgaccactgggcattacgcgtgctggcatgtgtgtatgagcctgttccgtacacacatatgatttgtttgaatgtagccagagacaggttaatagaggaatcgggagagtcagttctttcactaatattcatctccggtggtcacagacgttgtccctgtttttgtgtgaagtgatgttcactcggcccccggagctagtgtgttataatcagactttgggagcaataaacgttaacaggcagagtttctgaaaacgcctcgctttgctccttgacggaattccattacagctgggggaatcgatacgacgccttgcttcattattgcttttcttccacgtgggcagttgcttaataaagcccgaagaacgggccgcaccgaaaacagaacgggatggtgccaggtgcctcccctctctggcctctctgcatccacctgtgggatgcgccttgtgtacgtcacagagcactcctgcgccacacgtaagcctgtgtccaccctggagaaatcactgggcgcctggagggtggtccagcaggttccggaatccgacggctgcctctctgctcggagaccttggagctgtttagcctcttccgaattaatctttctcgtctaaaaaagtgaaaataaggtaattaccaccttagaggggagttgtgaggattaaaggaaatgatacatgcaaactacagaccacagcagaactccgtgcaaagcagttttcaggattccattccagtgttggccgtaaagggactgtaatgtcccagtttctctttcctcatctagaaaatgaggggctggatgtggtggctcatgcctgtaatcccagcactttgggaggcggaggtgggcggaacacttgaggtcaggagtttgagaccagcctggttaacgtggtgaaaccccgtctctactaaaaatacaaaaactagtaatctcagctactcaggaggctgaggcaggagaatcgcttgaacctaggaggtggaggttgcagtgagctgagatggtgccattgcactccagcctgggtgacagagtgagactttgtctcaaaaaaaaaaaatgaggaaccagaggggctaatctctgagacctcttcccctctaagaacattttcgttgagacattttgggagtgccctgggcaggacaggcagggcactggagaggaagctagggcgggaccatttcatgtccctagggttcaccgtgtccccacgaggtcatgggtgctccccggaaaggtcaggcttgcatcactcagcaaaggaaggttactgtgggtggagggaagccccccaaatccacttccttcactgccgtgctgctcaggtctggcccagcagcaggggatagaacatggatcccggtttctcccccgtggtttctcttgggtttcttgcttgtttcccagatgagttgatgtatacagtttattcacggatcaaggctcatttctttgctatcttaacaagtgacagcgttggagataaatttgcattttgtggtgtcacctcaggcttccttgttgctttgggctgagtagcagggatggaacacctgtggtctcgggtttatcggccatggttcctatctgggaaactggcgtgggccctgattggctatcgtcaccctctcctcgctttatctctggagagcagcaggagtgtgcagtggctttgaagcctttctttgtctctactgaccatgcaaattacacaccaactacttgtaagcttgagctcctgtgagctggccgagctcgggaagattattgagaccatgtccgaatggtggccccagaagccggcagtgtcagcccaggtgtgacggagaccacatcccaatggtggccccagaagccggcagtgtcagcctgggtgtgactgagaccacatccgaatggtggccccagaagccggcagcgtcagcctgggtgtgactgagaccacgtccgaagggtggccccagaagccggcagcgtcagcccaggtatgacatcccgtgtagctgctgaggccttcagatggcatttgctctttcatgtggactacagggtttctttttcttctttttccttctttctatcttccttttattttactttctttgagacatgtaagagtatgtgtgtgcatctgaaatgagaatctggcagcattcagagttttccggctcaattccgtgtccagatttgaaattcagaaaatcagatggtgttggaagctgccattgatggggtttgttggtacttctcaacctgccattccagctctccccaaccaagctggccaaagagttcaagccttttgcagagacgtggatgctgtcttttgctgtttaagaacctacctaggatttgcattctgatctgcatttcttaaaaggttgactgaaattcagttccttgtagtctagctcctttgcagtttttgatctctgaggaagattcagtcagctcgtaaaattaatggattctagcaaaattgcgttttagtgatacttttcagtagatattctgtgaaaagtggatttgaagtatttctgtgatgaggctcgattattaatgcagaacttgattgccaagaaccaaactacctccctcatcagtaacttggtctctagcttcagcatctgttgcttgaatatttcacagacctgaaaatgaaggtgggcccaagttgttcagggttaagacaaactttatttttttaaccccaaaccttagggctaataaaaattctttattagaatgcccaaaggcattgatgaataggtttggtcactacttttaaatgtaaaactttttaatttcagttccatctcatttacatcaaacagagcatatggctcccaaagcagcccagaacatgctgcggagaaaactagcaatttactccacgattcagcttcatttttctttcattttcatggaaaccataagattgtttttgtgtttcaaatcaaacatgtttttgagcaaagagtacattacccagctgtcctaaaagcagaacttatcactgttcagatttaatccaagccatctgctgcgtttctttctttccatttatttctgaggcacatcacaggaaagctgcttcttgacatatctcacttggagaaactacaaagaggaaaatatggcaaaaactttcaatgtcgctttgtcgatgcactttgcataaataatgaaacgttgccctccgctcagtgttcaaaaacccagtgcttgtcaccccaactttaaaataaataggaaaactccaagaaacaaactcagccttacatgttcatttcctaccagggtgggtgtcactaatatccacaggctgagctcttttttcaagtgtgattccagtcagcttttcaaccaaaggcctgagagctgtgcaggacatgacaggtgcaccaggggaccaccagccagaatgggagcaacaaggggtgcggctggccctcgattccaaagcctggactgaagatctgagccacacacgtctaatggggtacgggaatcctcagtccagaaatgaccttgaactcagatacttgagcagaggatgacatgggcagaactgagtatattgtgctttctaagatgttatgggtccgatcaagaatgggaaggtgatccctggaattggacatctctgtcaggccctgttggaacccagggcgtctgtaagccacaaccgcctgtgacctgcccctcatgcaactgccacgtctcatcaacagggacgcggaggaaactgactccgagccgtcacttcatccccgcttccatggaagacatgctgcttacatatttcacaaatgtggccggagaagggaggcaggaaccactcagtcactgggattatcttctgggaagcccactcggatgatggggagtatcttctgggaagcccactaggatgacaaggaggacctcatctgcatggctcacagccatgacagcttgggtctcagagggaagggaactcaggggcaatgcgcactggtgggattgcttatgcacgatatttgtcaagccatctctttttgtaaataactcttctcattaaaaacataaggcagctttgcaactatgctgatctcattggcttttggtgaagaagaaggaatgtgtgctggaccctgtgcctgaagctggagtcccaggtaccccaagcccaggaaaagacaaagccaagattctatgttctgaaaggagccaaatgtggctcagttgccctcaaaggagagaagatccaaggtaacccgtggtcagcaagagtcagagggctgaagctgtgcctgtggtgttggctgaagactgaggggccttttcgcgggtgggcagtctcttcctcctcactgcagctttggggtgctgatgctctgagttcagggtaaggccagctcgccgtgagacaatgtgtcctgcctgccttgggaaggaaaacgggaggaattgggagggagaacatgttcccagttctttactcactgttgtgctggacacaaatgtggcaggaacctctgataaaatgccccaaagctctggagaccttaggggtcaggtcctgtgcacaagattgtaacagtggccaacatgacagagtttcaacagatgcctgttgagtaaagaatgcaggcaccgaggttcaggcacagctcggggtccaatgctaacataggtggattgcatcaccagcactggtgtcagtgggccttttccttcaggagtgggctttgaagtaatgactgccacttcttttggatttggagataataaaataacgaagtgctgagcttccaagtccggtcagacatcacgtgtgagcttctgagtccggtcagacatcacgtgtgatcttagaaatccctgagtggtgaatgctggccacaccgagtgctggaggcttgtgaattcgactctcttctccaagtcctccatcaggtatttcactcattccagctgcagtgctgcgtggtgaggctcctggcgtgacatggaaggagggctgtgtgagtcagggctgacactcccagagcagggaatgggaaagagagcagccactctgctgccttcccatgtggaagggtctgtggagctgggcacctccgagagtcccgaggccccgtgcacttgactgagacttcctcagtctctgatgagtgattacggcagtgacagaattcttgcaatgatggaattcttgcagtgaaggaattcttgcagtgacggaattcttgctggtgacagcttatataatgtttgcaaaacagccgttttctaaaatggagctttccaggccaaaaatgcttgatgtcaagaaaatgacttttagctttgagatagcatctgggtctaatttcagaaaggtgggtctacacacaggttactgccaaggacacatgtcttcaggctccagaaccctgcctcaaggctggcaacaccacagctgcctgaaatgcaatatttaaacacagaaccttacaaaagatggcaagagggtcagagtcaagcacaaaaccaataccaggttgtacctcattgcatggtgaaggagaagtggcaaggactatgtgagccactggaataacttataggaaaatgaggattgtttcatgacctgtaatgttgtgaaaacgttacaaactcttataatctaagtgtgtatggaaatgaaaacagtgagtctgacaatgatgtagtacactgtgacaacacagtgggacagtgagagctacagcatcttgatgtagtacaacatgacttaacacagtgggacactgagagctggagcatctcgatgtagtacaccatgacttaacacagtgggacactgagagctacagcatcttgatgtagtacaccgtgacttaacacagtgggacactgagagctacagcatctcgatgtagtacaccgtgacttaacacagggggacactgagagctacagcatcttgatgtagtacaccgtgacttaacacagcgggacacggagagctacagcatctcgatgtagtacaccgtgacttaacacagcgggacatggagagctacagcatctcgatgtagtacactgtgacttaacacagtgggacacggagagctagagcatgtcgatgtagtacaccatgacttaacacagcgggacactgagagctacagcatctcgatgtagtacaccatgacaacacagtgggacactgagagctagagcatcttgatgtagttcaccatgacttaacacagcgggacacggagagctagagcatctcgatgtagtacaccatgacttaccacagcaggacacggagagctacagcatctcgatgtagtacaccatgacaacacagtgggacactgagagctagagcatctcgatgtagtacaccgtgacttaacacagcaggacacggagagctagagcatcttgatgtagtacaccatgacttaacacagcgggacatggagagctggagcatctcgatgtagtacaccgtgacttaacacagtgggacactgaaagctagagcatctcgatgtagtacaccatgacttaacacagcgggacactgagagctagagcatctcgatgtagtacaccgtgacttaacacagtgggacactgagagctagagcatctcgatgtagtacaccatgacttaacacagtgggacacggagagctagagcatctcgatgtagtacaccatgacttaacacagggggacacggagagctagagcatctcgatgtagtacactgtgacttaacacagcgggacactgaaagctagagcatctcgatgtagtacaccgtgacttaacacagcgggacactgagagagcatctcgatgtagtacaccgtgacttaacacagtgggacactgagagctagagcatctcgatgtagtacaccgtgacttaacacagtgggacactgagagctagagcatctcgatgtaggacaccgtgacttaacacagtgggacactgagagctagagcatctcgatgtaggacatcatgacttaatagagtgggacagtgagagctacagcagcatctcgatgtagtacaccatgacttaacacagtgggacactgagagctagagcatctcgatgtagtacaccatgacaacacagcgggacactgaaagctacagcatctcgatgtagttcaccatgacttaacacagcgggacactgaaagctacagcatctcgatgtagtacaccatgacagcacagcgggacactgaaagcttcagcatctcgatgtagtacaccatgacttaacacagtgggacactgaaagcttcagcatctcgatgtagtacaccatgacttaacacagcaggacactgagagctagagcatcttgttgtagtgcactgtgacttaacacagcagggaaactgagagctacagcatctcaatgtagtacactgtgacttacaccaggacactgagagctacggcatcttgatgtagtacaccacaacttaacacagtgggacactgagagctgcagcatcttgatgtagtgcactgtgacttagcacagggggacagtgagaggtagagcatctcgatgtagtgtgtgtggcacttgaatccttgtctaggctgtgatagttgtgagcattctccccatggcttgctgagtgtcaatccctttctgagtctggattgccctccaacattttgtgctttgccattttgtggtggtgaagtgcctctgagtgtccctttactgtgaaggtcttattgccccatttcccctggatatcatcgtttccctcacagccacttccctgctgtgtgcggatgagttgccttccttaggttcctgcagcaccgtgagtgtcccacatggtagccagtctatgtttcccagcaggctgtctgtttcctgccccctggcctttctttggaatttcacttccagcaccatcccttttcattctctggtgcacttatatctttgtttgtctgttctttcttctgataattcacttctgcgaaatgttgtttggtttctccctgggagatgatgtggccacacagctccatgctttgctgtctgtgctgagctgagtgacaggcaccctggccaatccccatgcagccaccaatcccacatggctgttaacatgtggtggtttgttgcctacacctggcagcacactttgtactttatgtagttactcggttaacatgccatgtaattgaaatctggactgtgtggttgggggctgggggtgcatatctaaactttggccatgtatccctgtgggttgggcctgcaagggaggacagtcggatgcaatcagatcatccaccacagttgtcccaagcctggctgactatggagtgaagctggattcccattcctgggccccaaagtggaccttcacagaaggcttcctccagtgcatggggcccagggaaggcacctgtgtggaaagtatttagggatggttcaggtgtgcagtcaggcttgggaaccgtggattgtaggatttgctgtttctgaaaccaacaccaaaggtggatgtggaagagaagaaaccagaacctaacacttagattcctagaagagacaggactgtggtggctgccaccagacacgtcatggggatgtggagccccagccacagcagacacaggggtggcaggggcttctaggggaccacccagccctctgaggaatgctctggtattgaaaatccttagagacaatttatgaactactctgaagtcccttcttagtgactaaaactaggctaaatcacctgatttgtttaatttttccttaagaaactttctcatttatcaattgaatgaggaagaggcatgggtggcctgcatacttcattgagggtctttgacgaggatttgcgtgtatgggatattaatgagccattgtagggtggggtggggggacaagtcctcaacaataactctgaggcggggcccgtggtatatgcagttcttgttggtagaatgggcccatggttctaaaccctttctgtacatccacagtagctgggagtgctcagataagtctggtaagcaggccgcactccggagcagtgacatctgaatctggtggaggtggggcccaggcacctgcattttcagggtcccaggtggtgtccagtgtcatccagggctgaagcagctggtgggggcttagagaggatggtgggtagggcctggggtgacccttccaaacccaggcagcaaggctgctggctctctcccctgaggaaggaaagcaggagggtttcttgaagccacctgctacaggttgtttttgtttgtttgacgtcattcatcagctttgcgtctcttcaccaatactgtcgctggggcccagagtggggactgcagagtaaagattaattgggaagcagggagttgaggtgtggtttctggcctcttggtaggtcaggaaattagctgtttgtatcatcagagaagtagctggttgtatcatcagagaagtagctggttgtatcatcagagaagtagctggttgtatcatcagagaagtagctggttgtatcatcaggaaagtagctggttgtatcatcaggaaagtagctggttgtatcatcaggaaagtagctggttgtattatggctggagtgctcagctcctgttttccttgcaggcttttgtcccaggcagaggtaccttcccccgcccctcctcatgtggatgactggtagtgttttccttacagcacgctggctcattcagttggtgtgagggagctggctggatggagatgctccggaagcttcatcagtggatgcccctcccccactttcaacacagctcccagcgttcagtggagcctcgaagaatgagccacattgatgtggccagggcgggaggcacggcacaatgccggcaattatgccagatcgaggacctcggtggggacagctttttgggccgtggaagcgggggcggcctccagcccgcatgtgagctcgtgccagcttcttcctaatgggaattctcagtgggtggctctgatgtatgacttacagctgagcccggagaacatctaatttcctttgcagctctcttcctcacagatgcaattactgtagtgaaatctggtccaggaggatgggatgggattctattttaaggttatttctttccttcttaggcctgaatagccattgttaaccgcccgggcaccctcctggatccgtcctttggggcttaatgctccagcccgttaattctgctctttaaattctcacaggtgactgctccctgtcagcccctttgtcttaacctcatggtttagtgctgctgtcctcactcctggtgtgccctgcatcatcgggagagctctgctatgggccgttcggggttgagcacctgattccctacgctctggaagtgcacggtactcacttggtagaggatttgctagaaccacagttctccccctgctggaacactaggaatccccttgcttcctttttttttttttttttttttttgagatagaggctgtctctgtcacccaggctgaagtgcagtggcacgatcacggctcactgcaacctccgcctcccaggttcaagtgatttagtagagacacggtttctccatgttgaccaggcttgtctcgaactcctgacctcaggtaattcacctgcctcggcctcccaaagtgctgggattacaggcgtgagccatcacacctggcccttgcctccatgtttaagggtggcccaggttgagctgaaaaggctgggtcaggaccgctgggcctggacacacaagtgcttcctgtgtgtcccacaggctccccagcacccgcaggatgggcccgttctcctagttttacagacaccaggctgagagactggggtcctcatctcccacccacagaagtcttcccactgttagtcctcccgggagaggggtgggctcgcctgctgaggtcgccatggagcccacacggggctttcccgttcaggcctcttgagccctgccatcttctgggaggggagtcggaaaaggttaaggacaagagatcctcatctgtgttagtcacaggcccagagtggacagtggccagtttcctagttgagaagaggacttggccaattgggggccatgttaggcccactgcattttatttccttaaagacaatgttttatttttttgtgtgcattcgggttcagatgctaagtgagctgtttaggaaatgtaaacatacattcaaaattgaattatctttccttttctcgtgagcccctacgacttattacaaatgagatacaaaggattgtttttgatcttgaacccaactttggcacaaaatttgtcttgctgtggattttcttgtgggtctggaacgagcttgcatctgttatcaagtctgctcagtggcgagagggaagggagccatgttgaggagggcgctggatgggtcctggagctgaggagggtgctggatgggtcctggagctgaggagggcgctgagacgggccctggagctgagaagggcactggatgggccctggagctgaggaggccactggatgggccctggtgctgaggagggtgctggatgggccctggagctgaggagggtgctgagatgggccctggtgctgaggagggcgctggatgggccctggtgttgaggagggcactggatgggccctggtgctgaggagggtgctgagatgggccctggtgctgaggagggcactggatgggccctggagctgaggagggtgctgagatgggccctggagctgaggagggtgctggatgggccctggtgctgaggagggtgctgagctgggccctggtgctgaggagggcgctggatgggccctggagctgaggagggtgctggatgggccctggtgctgaggagggtgctgagatgggccctggtgttgaggagggtgctgaggtgggccctggtgctgaggagggcactggatgggccctggagctgaggagggtgctgagataggccctggtgctgaggagggtgctgagatgggccctggtgctgaggagggtgctggatgggccctggtgctgaggagggtgctgagatgggccctggtgctgaggagggcgctggatgggccctggtgctgaggagggtgctgagatgggccctggtgctgaggagggcgctggatgggccctggtgttgaggagggtgctgagatgggccctggtgctaaggagggtgctgagatgggccctggtgctgaggagggcgctggatgggccctggtgttgaggagggtgctgagatgggccctggtgctgaggagggtgctgagatgggccctggtgctgaggagggtgctgagatgggccctggtgctgaggagggtgctgagatgggccctggtgttgaggagggtgctggatgggccctggtgctgaggagggtgctgagatgggccctggtgttgaggagggtgctgagatgggccctggtgctaaggagggtgctggatgggccctggtgctgaggagggcactggatgggccctggagctgaggagggtgctgtgatgggccctgcagctgaggagggtgctgtgatgggccctggagctgatgagggtgctgcgatgggccctggcaggtgtgttcttggcccacgcatgttctcagccccagtctcatgtgcgcagcctcatttcaccctcacggcagcctaacgagatgggcctattgtcccctgagccacagagaagcagcccgggaggaaggccagtgactgacctgggtcacagagcagctgagtctggataagacctgggccctggcccctgagaccatgctcccatctgaggcgggtgtgagtgccgcggggcggcgccttccacctccattggcgttggttggctgcttggtacccaggtttcccaacttgaagttgagtgcttagtgtagacaaggacagcgagtgagttctgatgctgccctctgactggctgtgttacctgggggatcccatctcccacgggaaggggacccctgttcccgggacgacagcaggacttgcaggtgccttggctcccaggaggtgagccgtgagtgctggggggaccagagagtggtggccgggcatgtgcaagggcccaggggaccaggaggtgagaccccagaggctgctgaaggagctgtgaggacccagcaggggcagcagtgcgcagtgccaggccccgcacttcatcacgggaagcgactggagatgtcacctcatttcaaggtggccggaaagctgtggctgcacacatctttacgtggggaagggagaatgaacccactgggaagcgtgtgaagaagccgtgggaggcagaaacggagctgcgtttggttgtaagggatggggtgctcatgggttttgagtgcctgctctgtgaagggtcccatgacacagaaacaggtggaagagcgaggcctcctctcgggagctgcaggagtgaaaataaggctgtgccagggaggagagggccccgggttcgcaggggcagcccagcctgtccggatctctgtggcctgacaccaccaagtgaatttcctactcacgctccatgtctggggtcacctgggtgcttgtgtaccctgtccctccggggcctcccaccccatgagcacactgtcccgtcaccccttccctgtgtctccgtgtctggggtcacctgggcacttgtctgcactgtccctccggggcctcccacccgtgactccaccaacaccccttccctgtgtctccgtgtcttctcctctccctacagggacgtcaatcactacatttagggcccaccctggatccagatgatctcacctcaaggtccttcaataatgaggtctgcgaggaccctgtttccacgtagttacattccgaggctctggctggacattcccagagaagttaagagccactcgtggttttgttatttcactttaccgaagttggggaaaccgaagcttagggaggctcaccttgctcaaagcctgtagtttgagacagactgggagcctctgcccttggtcaccccacatgcctcagagtcgcagaacttcagggccagaggaaaccttaactggagctggaagtgggctcacaggtgtctactctgtcacttcatcccacgagaaggagattaattctcctgtctgtagtcacctgggtactcggggatgagacgagggtgactctggcatcgtgacctcattctgtgtcctttcccccacatctcctgccttcgggatgacagctgtgtcctgagtgtcgtgttaggttgacattttggtgtcgggagaggctctctagagagggagcgggccttgtgtggtgagggtagcttgtcagatgcttgaaggcagagagggtttggggaggtggctcagacatgggctgtttttctttttcttaaatggagggaaggtggccagagactgtggaggtcacccggatgaactccaggtctgcctgcagccgtaggaggaaaccgaaggagtgatcaggctgaatctgcggggacgcctcggagccacccaggctgttcagcgaacctcaggcagctggggctgtgggggcacaccccatcttctcaagttttcagaaaactttggaaggcaagttcatggaagctgctcaaaaaaacactagctttattattattttttaaagccagattttttgagaggcgacgtcaacacatcttctcagctctttatgtcaattcttaaaacacttgccagattctgcaggacagttctgaatgtcggcatgctctgtgagggcacctgttcttcagagcgagggtctgagggggcctgcgcgatccctacctggccccttccctggcaggtgaggttgaaagccagtggaggttttctgttgttagagacccccggaaccctcacagccaccctttggttcacatagaggaggggcttggatgcttcgtaaattctcctgccggagtttgagctgctttaaccacggtccttttcaggcatgttcataacatggaaaccagcttcagaaggcagccctggggaaattgacctgactctatctgttagcagcagccactctttccttcctcagactgaccaggtcttctgtgccctctccacgctcatgcctgggtaggtcctgggtaggtccacgcttatgcctgggtaggtcctctcctaagctgaggactgcccacctccccagcctgctcactgcctgctcctgcacacatctccccatatgctgccagggccagccctgaacacaggcaatggctggcttctggctgcagaggtcagcgtgggccccacaggatctgccatctccaggagcccctttggaggtgaggccccaggtgagccccaaatgagtagatgcactgcagtctgcatctactcattaacgtaaaccaagcattacctgcgggggcttctcatgaatgaaaacagaactttcagggtgttacgaaaatgatatgattgtgtacataaagcactgagcttggaatctggtctgggaggatgatcttttgatttttttttttttttaattaaggagagcaaagtcattactagaatgtatagcaaatatggaggttaactttgtatcgtttaagtcatgtttgtggtaacagagttttaggctgtgtttggtgtcaatgttaatatgactggggtgagtcgtgtcaatgttaatatgactggggtgagtccagtgttgacgttagcagcgttttatctcaagcatatgtgacgttgatcaaaatgtgaacttttgatccgattctccttcctaccccactggcttagttattgctgtagtccggtcacgaagggtggtcacacgtttggtgtatttctgcaaacacggaggaaacaccttatttatattatgcaatttaccttttcttatcatttggactttttctgagcccatcaaattgcttgttttatgattttgattttgcaacacagtaataaatgtcattttctggaaataagtaatgaacatctgcttcctctgaagatgcagtatgagtccaccacgtgcagttctcacaggcagggacccacctccgggctgatacacagtggtgacggttttcttcttcttcctcttcttctcttaaaagtctatttgaaaaattccactgtagagaaagctactgtaatctgctccttaagaagatttggcctaggaagaagaaaatcatcctttatacttttggcttattaaattgaaaaatatgcatagtggtgttcttattaatttattcatgattttattaatgtttaatgctgcctctggtgttgtctgctttcaataccaaagaaaatgcaaaggcacatttgatcatgtgtgtttcagatcacaggatctcgtgtgtttctcttctaacactgaaggccaccagatgtcagtgtaacttaacaaatcacatcctacatgtcacgttgacttcagcatttggtctaagtgttgccttttcctttcctatttcaacttctgaagatgaagagggactttaagggaatttgcacacaagctccatagacttgagtcattggatatcttctgaagatgaggagggactttaagggaatttgcacacaagctctgtagacttgagtcactggacattgtgggagatgcctttttgcttttgctgtttccaaacctcccagctaatcacgccatgaactcatggtccctccactgagcacggcgatggttccacatcggcttcgtggcaaggacggattccaggttggggctgcagccgggctctgcttgagcggcccagggtcttctgtctcaatccaggacccaggacgcaggatgcaggacgcaggacccaggacccaggacccaggacgcaggacgcaggatgcaggacccaggacccaggacgcaggacccaggacccaggacccaggacgcaggacgcaggacccaggacccaggacgcaggacccaggacacaggacccaggacgcaggacgcaggacccaggacgcaggacgcaggacgcaggacccaggacgcaggacccaggacccaggacccaggacgcaggacgcaggacccaggacccaggacgcaggacccaggacccaggacccaggacccaggacccaggacgcaggacccaggacgcaggacccaggacccaggacccaggacgcaggacccaggacccaggacgcaggacccaggacgcaggacccaggacccaggacccaggacgcaggacccaggacccaggacccaggacccaggacccaggacccaggacgcaggacccaggacccaggacccaggacgcaggacgcaggacccaggacccaggacccaggacccaggacgcaggacgcaggacccaggacccaggacccaggacgcaggacgcaggacccaggacccaggacgcaggacccagggctgggcttgtctgcagcccgacctcctcacaggcggatgttggttctcttgctgggtctccctggagggttccttgctgacagcctgagcacgctcagccttgctcattgttcagggctggcagctccatgtttgctgtgggcgaggcctgtgcaggacagactttgtccagtatttacagcattttcctgattccatgttgagagataaagcaatttgcctggagtgcctgctgtgatcctggagctctgtcatccagggtctgtttataacagcagaggaacgaaatgagccgaaacacaaatctaatacaaaaaaacaaaatcaggagcatttttgaagtttagccaggtatccaggaggcagtcagccacttatccagtggcatggggatgagaggtagtcttctagaggtgtgtgaacagggcaggtctcagggcatggtcagtgtcacatgccagcgagtggctgcagcaggactcaggtccgcgggagagactggggaggcttccagagcggcacctgccctggggaaggagccgatgatgatgcagggggctccaggcatgaccagctcttccttcctgagataagcaccactgcgggatctcagtgtgcagccacatgtctcatggatgagccaccgggatctcagtgtgcagccacatgtctcacggatgagccactgcaggatctcagtgtgcagccacatgtctcacggatgagccactgcgggatctcagtgtgcagccaaatgtctcacggatgagccaccgggatctcagtgtgcagccaaatgtctcacggatgagccaccgggatctcagtgtgcagccaaatgtctcacggatgagccaccgggatctcagtgtgcagccaaatgtctcacggatgagccaccgggatctcagtgtgcggccacgtgtctcatggatgagccactgcgggatctcagtgtgcggccacgtgtctcacggatgagccaccgggatctcagtgtgcggccacgtgtctcatggatgagccactgcgggatctcagtgtgcggccacgtgtctcacggatgagccaccgggatctcagtgtgcagccacgtgtctcacggatgagccactgcgggatctcagtgtgcggacacgtgtctcacggatgagccactgcgggatctcagtgtgcggccacgtgtctcacggatgagccactgcgggatctcagtgtgcggacacgtgtctcacggatgagccactgcgggatctcagtgtgtggccacatgtctcacggatgagccaccgggatctcagtgtgcggccacatgcatggataagccacttgtggtcgtggtatgcagcatttcactttgcttctgggaaggttttccgagttttccaagtgcaggctccacacacagataagtttcactgtattaagagtatagagggccggatcttggttggattcagaaaagtagttattaaaaatatctgataccacataactggataaatcgtctcttgctgcagtaaagtgttgtgcatgccccgtttcttagcaagcttgcggaggctttgtttgttgttcccttccagtgtggaggagagacggtcggacgctgcagctctgtgttgtgtccttatcaggcatcatgctaaaaaaacatttcctccagggggctgtttgtgaaaggcaagattttcagaggttttaaatgggaggatttcagccctcctggaccaagcctctgcttggagctaacatcgaagctttcagagagttttcctatagctagggtggcctctgtggccatgcctgaccttcgtctaggtgttggcattgctaggaccccaaaatcctaggggatgtgacacccaggaattctagagatctcccaggcaccccgggaggatgtggactccaggcatcctagggggtgtggatgttcgtgatgctgtctttgtggatggggaaaccctgtaacaacttagctcctgctggggccagggagctggggccggggagctgaggccgaggagctggaggccagggagctgggggccggggagctgggggccggggagctggggccggggagctgaggccgaggagctggaggctggggagctgaggctgaggagctggaggccagggagctgggagctggggagctggggccggggagctgggagccagggagctggggccggggagctgaggccgaggagctggaggccagggagctgggggctggggagctggaggccggggagctggggccggggagctgggggccggggagctgggggccagggagctggaggccggagagctgggggccggggagctgaggccggggagctggaagccggagagctgggggccggagagctgggggccggggagctggaggcccgggagctgaggccaaggagctgggggccggggagctgaggctggggagctggaggccgaggactgcaggccctggcttgtgtttctggcacaggactcccgagtgactggtgttgttggggtggatataaccaaacagggatttaaggaatgcagccagcaattgcccaaagccacgtcccctggggagcccccgtcctcacgggtcctggtgtcttcatcctgtggactggctcagcctggcctcagcgcctgccccggggtcagcaggttaaggggtccacagcccctgcagcaggaggttttaatgcctgaactggagaaccttcaaaggcacacacagaatctctgtctcctcagcatcctcccatcaaagtctgtccgcatgtgttcctggctagtggctcaggaaaggtctgacgtcttcccacgtgtgacacagcagcacaaacctccagcacgtgtccccaccctgcacacaggtgttctggtgacgtccagtgaaagggtcacttataagccttggggccacagtgtgtcctgattaagcgatgtttgtaaagttgatctctcctattgtcacggcgataccttttattatagaaagtccagaggctgcaaatcaccaggaaaagactgcgcatgctgggattcccccaccacaacgtcttcgtgtcatttttgtgtctgtcctaatggacttccttttctttggtaaggacatgagtaattataaaaatggaattgtagtgtttcttgtgacttttaccctacattttaaacctcattaccttaattaggtgactttttgtgctagctaaaggcataaagcaaatattcatttccccctttccagccatcatggttttttccaaagtgcatcatcccagcatcagaatttcagaactctgggggaatcaagattcagcctcgtggggttttgggagttttcagagtgggggtgcaggacccctccccgagtgggtcttggtgtgcgatcctcagaccccaggcactcgcagtcccggctgccgcactgcctgcctgctgcccaccttagcccacttccagtccgacaggcagcgtgaacagaagtgacctctctgtggtgattgacgtgccaccagagtggcccttggagtaacaaaggccacacccaggggtttgggcctaaatgtgcttgctccgggcacgattctcaaacctggagcccatgaggattacctgggagctgttgcagaacgagggcagctgggcctgtgcccgggcctgtccagggttgctggggtggggcctgcatgtcagggtggaatccttgccactcctgcctgcagcctggtggagacatgctcttcaggtcagctctggttatttacgttttcacatcagtacggcagggcctgcatgggtgcgtttgtgtctttcacttggcttcctgctggtgaggggtctgctggcagaggtgctcacatgtgctcccctggcctgatggggcaggtttctctctggccacgtgcccacgtgcattctgtctgctcaacctcccaagtgcacagcttgaaggtggtccagaccttaatgtggggggattttcaccaaaaccctgtggtgtctccaaacagagcgagaatgaaccccctgggaagcatatgaagaagccgtgggaggcaaacggagctgtgtttggttgtaagggatggggctgctcatgggttttcagtgccagctctgggaagggtccctttgctgtggagaatcacagaggaggcttttcttttctgacctgctgcccctgcaccccatgattctccctcatcagagttttgctttctgctgggcaaagccaggaagggacagacagtccctggcctgggttgagcccccaccaccctgtccctccaccgtgggaccagagctgtccatgacaccaccctgcctggccatggcccttggatccctctagggcgggcgcagggtccggagagcaggcacgacagctgcagacacccagaccttcccttccctgcaggaacatcgcagggcttgcccaaggccgcatggacagctgcattggaaggagactcatcgatgactctgcattttggggctttaatttatctgccaaatatggagtaagcccctggcacgtgggatattggagtctcagcagtgtgcacagcagagtcttgtctccatggagttggagggcgctgactcccaccaacgtaaattcagtgcagatgcaaaattagcagagaagagggcgtggggtgcactggccaacagcatgagccagccccacctccgagagtcaaggtgaagctctgaggcaggtgctcatttgcgagctggaatgcatgtgtgtacagaggttgtacccccagatttccaatttggggaggtgctggggcatgtgcctcctagtgccgtggacagctcaaaagtcagcacctgtataccctggtcctgtgtctggctggtccctgagtcccacaagatgtatgtggacttgttgtgagccactctcccaccgggctgtcctccggggttctcccttttcccaggtgtgtttggagggggtggctggatgtgctgactcctcatctcctctctttcacaccccgtgtcccgcctctccctgaccctgctgggcaccggtcagaccccctttcctcatctctctttcacaccccgtttcccacctctccctggctctgggcaccggccagaccccctttcccagatgggaacttgactggcggtctggatggagagaggcctgggaggtctgggcggcagtgtggacatctctatggattcaggcacccctgctctcgttttgtcttccctccactgggcacctgctggtttccaggctgccgtcagtcccctgagcccctctgtcttcccagcttctcccttaggaattaccagccattcgtccttttgttttcctttcagccccttcaaattttgtctcgggaataattttgtgcattatcagatcatcaagatattttactaaagacatttcttcctaagaatttagttattaaactagcatttccctttttgagttcctcttatggtaacagctcttcactagaatgcctgggacccagtgtgtcatggcaaccatggggctgtcccatggcagccccactcctgcactaggccagggtctctctgcctccacgctgctcccttggggtccatcgtgtcttggcacccgtggggccgtcccgtggcagcttcgcttctgtgctgggccaggtctctctgcctccatgctgctcccttggggtccagcggctcctgggtggcagcaacacagagaaggagcttccggtctattttctccctggtggaggtctctgaagatttttcactgctggaaaaagaggaagaagcccagtaaaaataacaaacgaggggatggagcctccatacacacagccttccttgctcacgggatgagcctgggtctgaggggcttggagcccgccttccaggtgaactgtcagagggtcaggaacccggagagcccctggcaccgcaggcatcactgctgcctccgtcatcaggccccacgtccctcttgtgcttgctggtggcggtgccgctttctcttttagattctgcatctcgtgcgtgtcggttcctgggtgatgagcggccttggccacaggaggcggagcagggcccaccgcagtcggggaagctctgggtttgctgtctgctcggctttcctcgtgaggttctttacaggatgttctttacaggatctgggggaatgcggggggtgggacgggggctgctggttggtgtttgaggagctcacctgcaggcaggacgtgtcctgaggatccgtctcagctgcatggcaggcatggagcagggctgcctccgtttgtgtagaggatgcctgcactccagagaggctctgaggttggcctgagaggctctgtctgcatttgtggctgggaccacggtgtcctgtgctgaggctggtctcagttgctggggagatgctgccttgggacctgcaagagggcaactcccagcgcccctcactttcaccccaaggagaatcgtagctgagatgacaaagcgcatcttgtgttcttgttagatgtgtgttggcttcataatgatgcagcataatgatgtcaggatggctttggagctcagagaaatgggcttgagccaccataaagcaatcccgttggacttaatggctgtgattttgttgtggtgatgtcaggaggctttctgtccagtttctgaggagctgtgtgtctggtagacacagagcaataaagcaaaacaaaaacaaagccagaatgctgctccagcctgagtgtgggggagatgggacagcatgggttctgtgcatgacgactgccctgtccacatagggtagcgcatctgcttggttcaaaagtgactaagacattggtcttcaaaaaatatccatcagttacgtcatttcttttggcaaaattcttgatgtttgtgggggcctcgtaagtttaggcatcctcattaaaacctctaaagactgtcagaaagcacagctttaacgatgacataaaggcatctgttacatgagaaaagcgtttacttcctctcctcaccccagtatgaaaggtggcctgagtaccctgcaggtgtggtcacagcagatctcttgcatgcagggagtttggcaaacccagactggtgctggtctgcagactcgccgcccctcccagcttcgctccctgtgggactgcaagtgcctggggactaatgagtcccgcttcccactccccttgctgggagagctccaactgacggccaaggagtgagcgtttaaatacctcagctacaccaccccttgaatgggatggttccggtgcagtaggagctggctggtgatgcacctttcactggaaacccaaccttccttgtcacactttttttcttttaaaaatttcctcctctcccctccccttccattcccttgtttcttttccttcttttcttttctttcttttcttgagacaggatcttgctttatcacccaggctgcagtgcagtggcttgatcatagctcactgcagccttgacctcctgggctgaagtaatcctcctgcctcagcctcctaagtagctgagaccacaggcaggagctaccatgcctggctaatttttaaaaatgattttatagagacagagatctcactttgtggcccaggctgttctcaaactcttggactcaagtgattctcctgccttggcctcccaaaacactgagatcacaggtgtgcactaccacacctggccaactacaattgtttcttattccaggtctgcttctgtgggaatagaaatagagaaaatttttcccagtgaaactgctcagcagggtctcctatactgacacccactttcaacaattcaccaggtgacacaattctaaatcagctctttgtgccccttattaaatatgagcaggcatcccaggatcactggacacttatggaaagcctctaatgaaagagccctgacagccacatggaagaagacagcatgaaatgaagagagactatggacactaagcaaatacataagacatgtataactccaggaaaaacaagaagacactgtgaaaggaagagacactgtggacactaagcaaatacataagacatttataactccagggaaaacaaaaagaaaaaaaattaatactagtcacagcgtactacatagcctagttggggatagcatttacaaagtcacaatattgtaagcacataatactgatctgatgaaaattgtaatgtaactaaactgggaaagagaaagtaagcttggaaacagtgatgtgttatggagaggtaggcccatcttctgtagcagtcagaaaatagatacatcctaaatctgaaagctgagaaatggcaacgtgaatgtgtcatgtggagatatggagatgaaaaccaagagtcagctaaatgagttgagggtgcttacctctggggagtagaaatgcgggtggggaaaaggtgggttagaggtttgctcatttccccaaccagacttagatttttcaaactatgtgcaagcatgatgtttaaaaataaaccctaaaataagaagagagagttaactttgacaacggcaataacagaacaaagaatgtactttatgtatgttttctttgttctttgtttaccccattctagcaatgcagaaacagttagaagacactcaccgagccccacctggcttcccacctgtgaccaggtgaggcaacagtgtgggggaggatgaggcagctgccctcggcattgcctgtggcaaggccagcaacacaacccaggaaaggggaccgttttcagtgtctagtgggataataatatctagcatttactgggcatactcaatcttgctaccaccctggttttgaaaacacaaatctgttcaaatgcagttgatacatgggggagcactttgtgcatgatgtaattttgcattctcctatgaatgatgaatgacgggttgctagtctggttgaacagttacagatggatttgtaagctagacagtgtccctcaggaccatggaatgtgtggatgtatcagcactacagaatcttcgagtctgcaaattttcccagcctcaggatcagtggggactcatcatcctctcatttccctgctttggttccaccctcagtggccgtccctccggttcctactccttgttatcatgcacacctcgatttacgttcatggcattggaaaaccctcctgtttgattgttactgtcaggccgtggcaccctgcttgtgcttttcaatttgttttgttttgctttgcacagttgtgtgtgcatgtagctgtttttattcactgttatacttttattctgtatttgtttcctgtttcttttggtcaagaggcctcacaaggcatcttctctgcaggggaggagactcagccctgagagggatgttgttgtcatgtggaagtggaggcacagagtgactggggggtggggagggagtggcaggacaggcccagacctgcccaaatggtatgacatttcggcccccagctttcctgggtggagccctgtgctgtccctattttgagctggggcaggacacactatttctctggaagggaaggtgagggtgcagggcacaggaggagtgtttgtttgggcctccagagctggtctcgatctgaggacctgcttcatgtcagccctgtcccctggccacttggagggcaaccctgaggctggttcacaactgctcgggggtcctgccgctgggagggctggttcacaaccgctgagggtgtctggatgcaggctcctggcagcatcctggatgggcgcagctcatgtggttctctgcagagtggccccacattgggcacaagcccctgtccctacctcggagggcatctcctgcattacccaggaagtgagcctctctgaatcttgtttgctttgagattacgcaaggaaggaaaaaatgctgaagtgtaagttttgagggtgtgaggcatagtttaaatcagggaggcactcttacagcagatggcctttcagaataattaaaagagcaaattaaaagagcaaattgaaagagcacttcagcggggcctgggtctccacagaggacaggatgtcggtttgtttcaaaagacagaaaataaagtttctttccaaagctgcaatttccttgaggccattgtaccatcatgtcacaagctcgtgtactttttccttgtcttggggcttttacagtgttctctgggggctatttctgggctctcaacagtcttattttgggaaccactgctgagctgcttggcattctctacagctgttgtggcaaaacaggacagaccccgaggcgggtcaccgctggtgtgtgcaggtggaggcggcttggggagatggtatgcgcacacacacacatgcacacatgtgcacacacaaacatgcacacacacgtgcacacaaagcacacacaagcctaccctgtgagaacggagctgccccagttccctgagtgcccccttcagagctctgggtggcctctaacatcctggctgcttgtccatccccctgagcacaggaagcgggcaaggcacaaaactcactcggcgaggaggggagcagctcgctccctccacatgtgcatgcatgtgaacaaaatcacatgcatgtacacgcgtgcacacacgtgacacattcatgcacacacacgtgcacatgtacacacacacacagacttcacctcacgatgctgtcacctttttgtgtgtctctttaaaggtctttttgttttgattccttttgcgggtttgaaatagagatatatgcattaatcatttccccagcactacacttttattgttttaaacggcttctttgtgtgtgtgtgtgaaaatgctcaaaaggcctttgacaatgacggtgagaaaaccagccctggctgggcgctgtctcccgttagggagtgcctcctcagcccacgtggcactggctgcccgctgccctgtgcgtgtcccggccttcgctgcctctgcagcctgggagcttggtctctggttggggaggccagggccagcctgcgatgtggctgttgagaagctgtgcgtgcctgggccagggcagcagctctgccccatgggtcgcggcgggactgggatgaggccccactctcacctctgtgaccagggggcagagggaagtctgtagcccgacctcacctgctgcaggctccgagctccccctccaggctgggccctccatggcgctctgcccgaattcggggctggtgggatccaaggcggcgcaggccgggagccctcgcccctcgcccctcgcgcctcacccctcgcccctcgcgcctcacccctcgcccctcgcgcctcacccctcgcccctctcccctctcccctcgcgcctcgcccctcgcccctcgcccctcgcccctcgcgcctcgcccctcgcgcctcgcccctcgcccctctcccctcgcgcctcgcccctggcccctcgcccctggcccctcgcgcctcacccctcacccctcacccctggcccctcgcgcctcgcccctcgcccctggcccctcgcgcctcacccctcacccctcacccctggcccctcgcgcctcgcccctcgccccgcacccctcgcccctggcccctcgcccctcgcccctcgcccctggcccctcgcgcctcacccctcgcccctcacccctcacccctcgcgcctcgcccctggcccctcgcccctcgcgcctccccctcgcccctcgcccctggcccctggcccctcgcgcctcgcccctcgcccctcgcccctcacccctcgcccctcacccctcacccctcacttgtgcagggacagccctgggcgcaggtgcccgcacgggggattcaggtcgagaccgcgcctgcgtgccatctagcggccgtgctcgggtactgcagcccctccaccccagactccggaggctcctggaaggtgggtgaaccttgcagaccacccaggcgaaaacgcggctacttactcaggctggcgggaacgaggggtcagtcactgtccctcgtgcttggcaaagactcaggcaggtagaggagccgaagttttacagcagaaagggctggttggcccaggtgtcgtgtggacgggcagggcctcctgagtgctggctggggtgcccccggctttctctggctgacgcgttgcagagatgcggcctgcacagcctggccgctgtcccactgtccctgtgacgattcggtctcttttgggcacacggtaaatgcctctggtcagggctgtttaggaggtgagggtgtcgggtctccaacactgagtcaggtggaggggcagcccctgccgcacaccctctgtgtttttgtgagttgcctacagtccttgtcgccccgtcctgaatgctggaagctttgacgctagctcgtcttcctttcttaggcccccagcagcaaaaatctgctcccctcatcaatgagtgagttttgtgccttgacactttctgcgcctggggggatggacgagcagccagtacttagagaccacccggagctctgaagggggtgctcagggaaccagggctgctccattctcaccaggtgggcttggacagccacgggggctcatccccgacctgccaacctgggtcactcctggtgaggcagcagcatccccgtcgcaggctgggacagcagttccacaggtgttccctgcacacacctgtgcctctcacacttccgtggcctccaatgccctccctgtggccctgaaagcagccatggatttttgtgccaagaaaaattatacctgctccttggtgggggagccagaggggagccaggcgtctatgggggacagagtggggccagtggtccacagggaacagagaggtccaggcatctgtgggggacataggggaaccacgcatccgtgggggacagagggggtccaggtgtccgtcggggacagaggggttgaggtgtccgtgggggacagagggggtccaggtgtctgtgggagagaagggtccaggcatctgtggggtacagaggggggccacgcatctgtgagggacagagggggagcgaggtgtccatgggggtgggacattgttacccaggatgccagtggatgggctgatggcacagtttaaggggtgagagatgaagggtgggggtcccagagcagtggtgtccttggggtttgggtttgattgtgtgttaggggacgtggccttggctggggagggaggtgatggaaggtgatatacattgaacccaggctgctcaccacgtttgagaagcccctgagtgatgttccatcatgaagacggtgtgggcttccttgaagtgtgttgcaatcacgtcatgattccttcttcaccagtgttaggcgatgagattataatgaaaagcattagagccatcacactattgggaagcatcccccactaagctgtgaaaagctagaaactctgatgaaaatgacgctgaaagatgacttccacttccaaaaggtgcagattcaccaaagggagaaacccagagctgaggccggtctgcagcaggtgccgggcctgagacctttatgttgtctgagggaaacacctccatcccctgtcaggctcagagtgtccttttttgttctgggaaccatttctgtgtcatttgtgtggaggctgaagttgcccggggtcgtcctgcaaggcgtctcccagagcgaagtccctccgacgtgccccctggtgatgatgtttaaggaaaccaggctgaactttaattttccttcagtgttcgtggcagagcgtgttaagtacacttgacctttctaaatttatcacgcagcatttgagtctcttggatgtttgcaggattttcaaacccaggtttcggcctttttaaagacgccgtggggtgaggagggtgcgttggaggcgctgtgaccaggatgggatggtttccagctcccgttttcttcctgcccagtctcctttccagccaacatcgagtaagaccagggccacctggggtgcagaggcccctggaaaggactccccttccttctctgcagcaggcacaggggcctgggcagctgggcctgtgcagccctttctctctgtggacttgctgttttcagcctccctggaggggctggtggttctagacactgaggttgacaggcgtgctcgaggagttctcatcaccctgttcttccttaatggaaggaagttatttctaaaattctaccgagaggggctgcctggggtgagacatacctgcaggtccgatgaggctttgggatgtggacagataaccagagcaggatggtcctgtccgcaggggataccgggaagcctgtggggtcctggcgaggctccggcttggcttccaaggaccctgccccttggctgctgactggacccagggcccggctttgtgtcttcgcagttggtgaaacacattgatctacaatgtgtttctgtagcaccttgatgtggtcagaccccggtgagttgactcctcccccacggacacaaggacagggctgcacccacatgttctgccatcctcactggctgctggggccgtgcccccacgtggagctcttgctggccaagagaagcagctgtcctgtgaggccctgctccatgccaggatggttccccagacaacgctgggtgtgcagcagatccccgccgccctctcctcgtgtgagctgacgcatggacagaacacttggggttgccctgtgcctgccgctcagccacggtctcatgagtggacccatcttgtggaacatccacagtgcccaggaggcttgcctttgtgtccacaccctgtgtccagtgctggggtggtccctgacccagcccctctcctcctcggggagtttgacctgcatggccacatcagagtcctcaccctgaggatggacaggagatgaagggagggagaggggaggtccaccctcattccctccccacggaagccccagcctggccattgtcccttggccaaaggtcacccccaaaggcagcccagtcctcacaattccctcccctgggtatggctactccccccgcaccagcccagtactgcatcatccctgccctgcaaacggtccctcctgaagccaccctgggggcctggtggaggactctcgactcacaggcgggctccctgtctcaaaggtgctcattcctgagggcgtcatcccaggtggcaaatctgtttgcttttaaattctggtgagagcagtgctgctcactgttgtgccctgtttgtggccttgtctggctgggggtgcagctcctttcctcccccgcccccggtactgaccagggcctggcactggggaaacctcctgcctcctcccatccccagggctgcagggctgcatccagcctgggcagctggtcagggctgtgaggggctggggtgggactccagctgctctatgtcctggcaggggttgggcctgcatctcaaggggcatgtgcagcatgggtgctggtgggaaaatgtgggaaggcctctcctcctgcggggtaggtgggcatttctcatcataaaatgagacatttgtatcctcctcatggtgaccttaagcctcaggaagaagctaggggaggctgctgtggctgagagaccttcccaggacatggtctctttcccgacgggcctctgcagtcagcgtccgaaggagagatgggcctgtgagtatagctgggtgtcagggcccggacctggatttcgggcctggtgcagcttggccaggagagggagcgcggtttcagacaagggagggtggcgcctgggcttccaggcttggagggatggcgtgggctcacagcccctttctcctcggccattggccccagagggtccctccagggaatggaagtcaatgtctctcgtgcaggttctttttatctttaagggagcagcagctgctgggttagggtgtttggaataagaagtatttgttcctgcagctgtacatctgaacgtgaaacatggctgttgcgttacaaccgtcgcaagagggaagaaaatctagtctgtagttaggatgatttccacccctcgaatttggaagtggtgaattagtggaggtgggggtgggtttcacaccatttcaggagggcttgttcctgtagggccctgacagcggacagagcctgccacgtggacacagtgcatgtgacgcggcacccgtgggggatgggttttcatctgcccttcctgcccctccatttttcgtagcctctttggggcatgacatacccaccttgagcttcgcattttgagaggacatttgtagagtggagctgacagttaaggggacgatgcgcgagaagagaaggcttgggagacatcggccagctctcccgcaaagtgcgctgagagctgaggggctggtggttctgcaccctctgggacggggcaagcctggccgggcagtggacagcagttggcatgggacaggctcagctcccagagccacagtgagcagcattgcggccactcggtgtccagatgcctgtgttccctcctaccttggccgaggccctccagcacgatggtcctactgcgaggctggagaagggatggggtcggggtgcctgctgtgactgtcctggggcagaagggcctccagctcagagactccgcaggtctcacctcataactccgtctggctgctgattccactttacgtgttctttgaaggcaaatgtgtttcccatgaagcaaattggttcggctgcgacttagtgccactcgctgcatgggaataacttcttagtcgagttcattgctgttccaggtgccggctgcccctggctgcaaggagaggccatttccacatagcagccactgagctgtgtgaccatgagagccgtgggaggacacggcccagggcgacggcgcctctgagttcaaggggacatgcctctgtgcacactcagcagccgggggatgagaggacagggtggtggggcggggatggagctggggcacaaagaagatcggtttgaataaacgcagctgagtatcgtgtagacgtttgagaggcttcatccctccgtaggatcctcctgtcttctgtggatgtgaacagcgtcattacagagtcatccgaggtggatgcaggaggcctggctgcaccggaggacagcacctggggctgcctcaccacgcgtcttgggccagggccctgctttctggatgtgtccattaacatcccacaacctttgctgaggctctcacctcttttctccaagagcccgtttgtgaaaactaagatgtggccaggaacaaaggagagcaggaaggacagaacttgcgtttagcccattttctattctgggaatgcgacgcgtgatgatttatccgtgcatctgtgttgtcatccgtgttctcgcagggcctggttccagcagccaggctggtggctgagtctagaattgcatttgtgacggcggcagccgttattgcaaatgtacctttcttgtgtattgatctttcgcagatcccattatttttaatttatttaataaggaggagtgtttgtttcataactcagaatcaaaaccataattattcactcagactctggtgtctgtgcaagggaagcctgtgggttgatgtttttcattcttcaatgaccagaggattaattgaggggccaccacagaaagaaggcacaatacatctcttttctaatgaacttgcatttcagagcttaaatccaaagtaattggatttcacagtcaaagtgcgctttcacttcgtgtggtctatggacacggctgcgtgtcctccacatgcgtcgcagcctgggctgatcttaaaaacaactttatgtacagcaggtgtgtcgtgtttcattctgtgaggaatcactcactgaagtgtggtgtggcctcagtggccgcacctgcctcctgccgagggcttcagggcccaggtgtggcccttcggacgcctgtttcccttcagcttctcttcgcagactttgaggcccaggcactgccctgcctgcatctggagcccttctccttccaggggcccgcctcacgttgggtgaaatcaagcctccatggttgtaggttctaatcgccagtccgagcttagcccttagggttgacctattccttcagatcgatcacagctgagctcagcactgagcattggagggtgaaaaagaagttttgtatcatctgtgtgtgggttaataataacgtatgtatttggagtttgtgtctggttcctggctcctgagacccttggagtctctggggcgatgagtgtcttttgtgtgctgagaggtggctgggagccctggctggcttcagggtggggctggtggccagaaaggccaaggcaccattagatggttgggcctttcaggcccccccaactcttggggggttaatcaccaatggccagtgatttaatccatcatgcctatgtacgtgaaacctgcatagagaactaagtgagaggttcatggagctcgcaggttggcagacacgtggaggtgcagggagcctggtgcacccagggcaggtgtgacgtgtgccctgcaccctgccccgtgcgtccctcagtttggctctccttgagctgtgtcctttataagagctagtgatggtgagtgaagtgctttcccaagttctgtgtcatccaaagaaaaattgcacccgaggaggttgtgggcagccgagtttgtcgctggctgggaagaaatgcaggtggcctggctgtccatctgcactggccctcatgggggggtggtcttgcgggaccgagcccagaagctgtgaattctgggaccttggtgccgggattgacgtgaaccgtggcttcccgtggaggatgtggccgtggatcaggtgatggccactcggaagggtccaggggcttcttgttcagtgtggacaggggtgctccttgccgagacctgcagagtgaagccgacacaggggagaggtggctacatcctggggtcgggggaatcctccgaaagtattttctgtggggagaaggctgctgtggagctggggttctccagagaaacagactcagcagggggtttgtatgtgtgtataaatagagatgtgtgtgtataaatagatatatgtgtgtgtaaatagagatatatgtgtgtgtacagacagagacagtatttcaaggcattagctcaccgattgggggcctggcgggtctgacatctgcagggcagctggtgggctgggaattcagaggcgggttcctgctgcagcctcttgtccgaatcccacagggcagcggcttggagactttgacagctcttcatgttgccgccatctacagcaggattccatctccttcaggaaacttcgccctggctctgcagcctccgcctggatgagaccatccagcaccattgcctttaagtcagcagattcagcagatggtggtggccaccgcgtcttcccagggcctcacagcagctctccgccttcagctgcatccccgggcctggccgggccaagctgagctgacagggatgccgcagccccctggagtccagtccccccaggacccagagagtgctttccaacatcgtaacccgatcgcactccacttgtaaatgcgcccttggctaccgtcttacaaaacaagagttgtctttgtggtcaccatctgccttccagctctctggagcctgcggagaccccagcgaaggcagtgagcgtggtcctggccccacctcagccctcctgtggtgcaggatgagccctccctgacctatttggcttgcagatgtgatttcagtgtctatgtgaattgggcatctgtgtttacagttctgaaagtttcatggaaaggtttctggtctcccatgtggtaccaggagatctgtccgtgtgggccctgaagccagggcagccgctggttgaagctgaggccacttagggcaggactttcccagcctcctggggatctgggtcccggtttggcctcagaggcatttgggcagagcctcccgtgttctagaacacatgctgccacagagacgcgtcatcaaaagagcctgggcagacgcgatcccagagggtgagaagccacagtccccccatcctcagcccacccctgtggcgagtgcttaggtgggtgatcgggccgtgtggagtcgtgttcatcatggaggatgtggaagcaccttcccattcatctcccagggtggcagattgctaacaccttcccattcatctcctagggtagcagatttgctaaaactctggagagctgcattaacacttgaaaccaccacagcaagagctgggagtcgatgcagtaggagcctgtgaagggctgggctttctgttttttgttgcctgaacttgatcgctggtaggttgtacatctacatttggtgatggtggataagattggggattgaaggatccatttttttccaggttaaatgtttgggcatttggatgatcgacagtgtgttcagttatgctttctccaggttcatgtccccactggccccatctcctgcacccatccatagctataagctcccctgaccccatcaagctacctggaaaagtgcataccctggtcccgaggggaattggatgaatgagcctggatgaacggaggcagctcctgcaccatgggaggagggactcggggcatgggaggagggactctgggcatgggaggagggacttggggcacgggaggagggacttggggcacgggaggagggaggaggggtacagaaggagggactcggcacgggaggagggactcggggcacgggaggagggacttggggcacgggaggagggactcagggcatgggaggagggaggaggggcacagaaatagggactcagagcacaggaggagggactcggggcacgggaggagggacttggggcacaggaggagggactcagggcatgggaggagggacttggggcatgggaggagggactctgggcatgggaggagggacttggggcacgggaggagggaggaagggtacagaaggagggactcggcacgggaggagggactcggggcacgggaggagggacttggggcacgggaggagggactcagggcatgggaggagggaggaggggcacagaaatagggactcagagcacaggaggagggactcggggaatgggaggagggaggaggagcacggaaggagggactcggggcatgggaggaggggcacatctgctcatggagggaaacacagcagagccctcttcctggagatgaaatccatggtgttcaccacaggagagacgcacaaggtcaccaacccatcttcttcctggagactgtggaaatttagaaacggacttgaaaccgttttctggtatcacgtagctcatcagtagcaggcctgaacttgtgcttttctgtatgccagcatttgtaaactttgagtaatatctaaaccccattaaaagggaaaaattgtatggacctcctttgttgacttaaggcattattatcattaatgtaattgtttaaatcactgaaatgaaacaaggtgtggaattttatgctggattttaattaacaagaatgtttcatggatgcccaaacttctgattttccattttatctcaaaacagctctctttgcttgctatacagtgagattttaaagtagaggccaattctacttggttgttgcactttcacccttaatgtttcttcaaatcctttcaaaatctgaaatgtcatcagagtacatcttcatcggttcaattgaaacctttttttttccagtggtgtctttcttgccttaattggttgggactcttgtctctggaattgttcccagaattttatattaaagtagcttttgttacagtgggactcacatagtgtggtatgattggtttacaaagaagacatttaggttcttgtcgatgttatcagaagaggacaaatggtttcgtatttattattccatgcttcaggggcattggtgggagtgtggaacggaaaatttaaacatcagaaactccattaggggacgttgatgcactgaatggaagtcacaccagcaaattcttctgcggtgagggcggaagtcacaccagcaaatcctgctgtgggggcgggcaggtgattttactgatgcgcagcaaatactgctgtgagggcgggcaggtgattttactgatgcgcatagcccacatgctgcagaggtgcaccctgacatctgtgtttggtcggccctctgactcgtgaaaatgtcttctggcaattagtatttcagttttggtacctttggtaacttttacaaagagtgcatgtttaagggtcaaatgtaatcacttattagtaaatgaaattttttattttaaacacacagatgggtgttatgcacacagtttgcagtgatttttgatgaagggaaggttcattccctcccacaaacacccttctggcttaatccctcctgtaatacagggtttctctacattatactcatctgtcttggcttaagcagtaacacctgtgcctgttgaagcgccttcttcctaagtgtctggctttgtgtactttcatttgcatacagagatctgtaactgttaaggagcccctgccctctcacactgtggatactgtcagtgcctacctttcactgagatcagcgggaaaaacctctggaggttgggtgctgcccctggcatcttgcattaatagtttacagcccgcggtccccacatcccggctgcttctgccctgtgttgtgctcctgagagatgtgttggtgtctggccgaaaggtccttttggtttccagggtaccataaatcctcaaaattaatgggcaatgcaggcccttaccagctcctcctcctgtgtggtgacctccaaatgtggccacctgggtgacagcagacaaatagacatgtgtgccaagtaccttgagcgagcccagcaggttgtgatacagttggtgcacgcaaatcatgagtgtgtgagggacatggatgaccagcgatgagacagaggatgcgcgggatgcttcaagcagagtttaaagttctgtccctgaaaatggtcaaggttctcaacaggaagtaaccatccaaacagtggcattttcaagccaaggactcaagtgaaaaggattccttcagtgtgatcacgctttccggagcatagtggctctcatatgccaaagggtttaaaatactaatgacgttattacgtaattctgtaaaaaagtcattaacatcacaaactggccgtagttgtttgctgctactgtgtgcctctctgagacatatgtgtgcgtgaagacacctgagcaggtgggctctagttggggtttccataaactctcaccctgagactcttctgcaattgaacacaaacccacacctttctttcctgaccacttaaagttcttttgtccttctgttttgatgactttagttttatcttgacttttgaacttcaaattaaatttctgacagtaaagctggataattttaaaatatcattttttgggatcccggaggctatttaaagtctttggttccatgtaattaataaaaaattgaaagggcattccatggcaaaactctgcactttaaactggcagccacaaagggtgagggcaatctctcctttggaagagtatattatactttggaatgttaagtccatgctatttcccattttgtttatagggatgatattatgtgcatgattgctctgttctgaagcaaatactggccctgtggattatatcaaatagatacattcactaatagaagtgcctgaccctgcatgctgcttttgcctctgatcactttttttgaatgagttacaaaaataattcttcaaaatagttcttcaaattctgttgaataagagttctgcatgaggtgtgtcttttgaactcttgttggacgttagctcaggaggtgggtcttcagggcccctcatgtgttaataggagccttaatgttctccaggcatcatgtcatgatgaacattaatgtactgtgggatactgacggagtgtgccatttatcaataggctgtaagacagtggtccccaacctttttggcaccagggaccagcttcctggaagacagtttttccatggaccatggttgggggtgtggttttggaaagatccaagtgcaatatgtttattgtgcacttttttccaactcatttgccactctaaagcccactgatagggttttcatatgtgtctgcaagcaattgattgattgtgatctctgtgcagtcagacctctctgttcatgttaatctgtgtttgcagctgctccccagcactcccatcactgcctcagctccaccttggatcatgaggcattagattctcgtacagagtgtgcagcttctgtccctcctgtgcgcagttcacaatggggtttgcactcctgtaaaatctaacaccaccgctgatctgacaggcagcagaactcaggcgggaatgctcgcacacctgctgctcacctcctgctgtgtggcctggttcttgtactggttcatggcccgggggttggggactcctgctgtaagaatagaatggggctggaaaaattgtttttgcagaagacagatttatgcatttctttccttcatggcgactttctgaggagagaagaggggagtggggaggagaacagtcgcattcatgggatactttgcaaattccatgctgttttacctgttttacaccaaaaagtgggtgaggttgtgtggcttacccaggacatggtggaggggtcttcagcccagggtggtgatgcagtggccccatcctccctggtcctggcctcctccacatcctgacccccggggctgttcacggaggggagttggagtcatgaggctgtgctgagctgcgttgcccaggtgcctgcacatgtatgcccaccagggtggacctgtagtgggtcctgcccaccatttctctcctggctgtggctctcagggtgctctggtgagacaatgtaactggcacctgccttagggctagtgatatggtttggctgtgtctgtacccaaatcccatcttaaattgtagctcccacaattcccatgtattgtgggagagacccagtgggaggcacttgaatcatgggagtgggtctttctcgtgctgttctcatggtagtgaataagtcttacaagatctgatggttctataagggggagtttctctgcacaaactctctcttacctgctgccatgtaagacatcccttggtctttcaccatgattgtgaggcctccccagccatgtggaactgtgagtcaattaaatcactttcctgtataaattacccagtctcgggtatgtctttatcaacagcatgaaaacagactaatacagtaaattggtaccggtagagtggggcactgctgtagataaccaaaaatgtggaagcaactttggacctgggtaacaggcaggggttggaacagtttggagggctcagcagaagacaggaaaatgtgggaaagtttggcacttcctagaggcttgttgaatggctttgcctaaaatgctgacagcaatatggacaataaagtccaggctgaggtggtctcagatggaaatgaggaacttgttgggaaccagagcaaaagtgactcttgttatgttttagcaaatagactggcagcattttgcccctgtcctagacatttgtggaactttgaacttgagcaagatgatttagggtatgtggcggaagaaatttctaagcagcaaagcattcaaaaggtgacttgggtgcttggttttgtaggggaagcagagcataaaagttcagaaaatttgcagcctgacagtgtgatagaaaataaaatcccaatttctgactagaaattcaagccagctgtggaaatttgcctaagtaacaaggagccaaatgtgaatccctgagacaatagggaaaatgtctccagggcatgtcagaggtcttcacagcagcccctcccatcacaggccctgaggcccaggaggaaaaagtggttttgtgggttgggcccagggtccccatgctgtgtgcagcctagggacttgatgccctgcgtcccagctgctccagttgtggctgaaatgagtcaatgtggagctcaggctgtggcttcagaggggggcaagccccaagccttggcagcttccacatagtgttgagcctgcaggtgcacagaagtcaagtactggggtttgggaacctctgcatagatttcagaagatgtatggaaatgcctggatgcccaggcagaagttggctccaggggtggggccctcatggagaacctctgctagggcagtgcagaagggaaatgtggagttggaacctgcacacagagtccctactggggcactgtctagtggagctgtgagaagagggccacggtcctccagaccccaaaatggtagatctaccaacaactggcactgtgtgcctggaaaagtctcagacactcaatgccagcccgtgaaggcagctgggagggaggctttactctgcaaagccacaggggcagagttgcccaagaccatgagaacccacctcttgcatcaccatgacccagatgtttgacatggagtcaaaggagatcattttggagctttaagatttgactgccctgctagatttcagacttgcgtggggcctgtagcctctttgttttggccaagttctcccatttggaatggctgtatttaacaaatacctatgcctccattatgtctaggaaacaagtaacttgtttttgattttacaggctcataggtggaagggacttgccttgtctcagatgagacattggactgtgggcttttgagttaatgctgaaatgagttaagactttggggggctgttgggaagatatgattggttttaaaatgtgaggacgtgagatttgggagaggccaggggcataatgatatggtttggctgtgtccccactgaaatctgatcttgaattgcagctcccataattcccatatgttgtgggagggacccgttggaaggtaatcgaatcataggggtgggtctttcccttgctgttctcctgatagtgactaaacctcacaagatctgatggttttataagggggagtttccccatacaagctctctttgcctgctgtcatccatgtgagatgtgactttgctcctctttgccttccaccatgattgtgaggcccccccagccatgtggaattgtgagtccattaaacctctttcctgcataaattacccagtctcaggtatgtctttattagcagcatgaaaaaggactaatacagctagggggtccccatccacctgaacccccatgaacctcttgtgggtctactgactttggccttcttggagtctttctgtttcatctgtgctgtttcttaggaaccccgccccacctgtgggctgtgctgtgagtttgaatgtggagtcttctccatctttgtctgtgctatttcttaggaaccctgctccacccgtgaggtgtgagtttgagttcggagttgtttttgtctttcgtctgtaccatttcttgggagccccccacctgtgggctgtgagtgtgagtttggctgcagtttctgaggatgcagcttttccttcctgtgtaattagtgtggctctttgtcccacccttccttccctcccctcctctgttcctgtctttgctttcatcaaacatttactgaacagacaccatctatgaaggtgggtcttggctgccactgctgcagaggcgtgttgcacagcagaaccgtattccctaccccggtcctcctgccaaccccagtcacccccaccctggggtccgcagccccttctgcaggctgctggagggagcatcctacgtgtggacacctgaccttgctgttctctgctctagggggcagcctatgagccttccccactctgggggctctcccaccccttccatgcacacagggccaggcctggcaggtgcagcccctgtcctaacccagcacttctcaccccgcaccctgcctcaccctgcagggagctcttcccctccacagctctgagagacaggagtgcgtgcagatgcactgtcaataaatacttattaataacaaattcacagatgacaggactgggagcggggtcttctccccatcccattaaagtccccttgatcgtaacagccaaccagccttttctggtaagaattttgtcaagtattttatatataatatctcagctattactaataccagtgctgcatggaaggaattatcattatcttcaatgtattgattaaaacacctctttgacaaatgtgcctgcctgagcctataaccagaaagcaactgagttggatgttgaccctggaccctggaccctggaccctggagtgtgctggactccaaagcccaggagttttgcacactttctttggaaacgtggtgatatcaaggcagagaaccaagagtggggttttcagcataactggatgaagactgggcagcttgactcagggcattcgcaatagagggggcctgtggggagcagctcactgtggggagaggacagggggctgaagtcatcctcggatgcaggcgtgtggtcaccatgagtcactgggacctgcggttcccccttcagaaccattgctgtgtttctgtggaaaaggagcttaagtccctagtgggtccagggccctcctgcaccaagaaggaggtgcctggggaagcctctgggcagcaggcggggcttgcaggcccctttaggaaaactcatgccctggggagcgaatgtcaagagctgaggggacagcctccaaccattatgtaaaaaagccattgtcaaggtcaagggttgtcctgaggccaatagcttttatttgcttttgtgtcaggtttgttcaggtttgtataatcatatgatttgtatgcagtaaaatgcggtttctaagtgcacagctggaggagtcaggaggaggtgtatagtcccggagccaggtccaggacctgccgtgtcacacctggaaaacccacagctggcatcaggactggctgtgttacacccagaaaacccggagctagcgccaggactggctgtgtcacatctggaccacacagagctcttccttgccctcatggatctggttctgtgctgtgcttgctgtgtctgtgttgtagccacgggccctgtgctgtgtggactgtgggggaggcttctgcctgcaccctgcccttgagcaccctccgtgcagggccgtaccagcagcccgtcccttggtattaccaggtagtgtccctggaatgggtgtaagaaagtcagctctccagctgcggacatttggattgttccacttttcagctgtcgtgcgtaaagctgtgataaaccaccgatgccggtttcctgtgaactccattttcattcctcttgggtccatgacaaagcctgtgattgctgagtcccgggaaaattgtgtgtgcatttccacccccaagccgagccagccagttgcctgcctcctccctagcactctgcattgctggggtttcctccccagcctgtgggttcgtggtggtgtccaagtggggtccccttttcttatgcgtgatgatgctggctgtctcttcctgcacttactggccatcccttgctcttctttggtgaagaccgatacattttacatttaactatttttccataacacatggagattttattaacacacacgcacctaattgctaccagattcatgatgaaacaggagcatcccctgaccccgcgtgcttgatgtgtgacagggctgtgggggagtcccctgacccccctctcaggacgtgtgacagggctgtgggggagtcccctgacccccctctcaggacgtgtgacagggctgtgggggagtcccctgacccccctctcaggacgtgtgacagggctgtgggggagtcccctgacccccctctcaggacgtgtgacagggctgtgggggagtcccctgacccccctctcaggacgtgtgacagggctgtgggggagtcccctgacccccgtctcaggacatgtgacagggctgtgggagagtcccctgaccccgcgtgcaggacgtgtgacagggctgtgggggagtcccctgaccccgcgtgcaggacgtgtgacagggctgtgggggagtcccctgacccccctctcaggacgtgtgacagggctgtgggagagtcccctgaccccgcgtgcaggatgtgtgacagggatgtgggagagtcccctgacccccctctcaggacgtgtgacagggctgtaggggagtcccctgacccccctctcaggacgtgtgacagggctgtgggagagtcccctgaccccgcgtgcaggacgtgtgacagggctgtgggggagtcccctgaccccgcatgcaggacgtgtgacagggctgtgggggagtcccctgacccccctctcaggacgtgtgacagggctgtgggagagtcccctgaccccgcgtgcaggatgtgtgacagggatgtgggagagtcccctgacccccctctcaggacgtgtgacagggctgtaggggagtccactgacccccctctcaggacgtgtgacagggatgtgggagagtcccctgaacccctccctcaggacgtatgacagggccatgggggagtcccctgaccccccctcgcaggacgtgtgacaggactgtgggagagtcccctaaccccacgtgcaggacgtgtgacagggccgtgggggagtcccctgacccccctctcaggacgtgtgacagggctgtgggggagtcccctgaccctgcatgcaggacgtgtgacgggtgtggctcatctgtttggctgctgcgtgctcaaagagccttagggaagggagagcacacagataggcaggtgcaggagccggggtgagtgcttttgggctctggccctgcagtagcatccaggggtggggtgtctgtgactcccaaagccgcggtgggtgtgctacagtgctcttttagcagttgccacccacagatggcttaagtattaaccagctcagtgccctgttgatacccaggttcttatctggcgtccaggaagaatcaggtcacagggacaaattgaaggatggcaaatgtgggggattttactgctggatggaggtggctctcagtgggatggatggggagctggagaggggatggagtgggaagggatcttcccctggagtttggccgtcccgcagccaatctcctttctgactgtccccagccgaactcctcttgacattcacacgctccttctcttctctccttccctgacacgccactcttctgttcctccgctcttccactagtggagcctggggcttggcatttacatgggtacaggataggcaggcatgggaggccaaaaggcaacatttgggcacaaaaacaggaatgcctgttcccattgagggccacaggtttccaggcttgagggcggggcctttgccggggaactaccctcttctacccagaatttttctgccacctgcccatatcagtgatgcttttctcagggaaaactgtagttgcaatggatttaatgttcagctgtgctgtcccaccacatccccgagatggctgggtttggccacaccaggagcttgagcctggctgccttgcatgctctcctaaaatgtctgccccaagacacagctgccttgtctgctgccctcattgtgcctggactatgcctgtgtcctgggtactctgtaaacatttgctgaatgagggactaaatgagcagtgaatcacatgacaagccctctgctgatgccctgtgggcacttgcctggtataattctggtgagttgggagctgtggggaggcccagtgctgccaggtttaggcacctttctgacttcatgctctggccggccactgcctctcatatttagggtctcactgccacgtgaagcagctgagagctggtttcccccatgaaatacgtctgctgctgagcctcggggatgtggagtttctcatctatcttttcctctgcgcctcaggccaccatgctctgtgtttttaagcaggaagggattttagccccaccctttattattttctgttacattttcccagttaaatgttacatatagtagaaatctgtagacttgaagtattcaattctgtgagttttggcaaatgcacccagcatgcagcccctgcctgtgctgtgacttagaacatttacatcacccagaaagttcccatgaaaccacatccccgccccggaaatgacttctcccattcctttgcacgatatgcttggtttctccaggtctaaagcttgctgttctggatttccgcagggcattctttaatttctgcctccagcctccatctgtccacttgctgtgtgtggacggtttgtctctgttttgaggggagttccattgagtggatgcgccatgtttcaaacccactttcctgttgacgggctttgttctttctttttttctttcttcagtttttggcgcctatgaataaagtctctctaaacattcttgtacaatcctttttacagatcgtgttttgtttctctcgggctagtgtccaggagtggagtttctgcgctgttgatattgaggtgtgtgtctatgaggagctgcagggtctggtttcacaggagcgagtgagtgtgtgggtggctctgcagccttttgccagtgtgttcttggcctgcagcattggccttttgagttggtgtttgtggagagttccatttccagtggtctgtcctggaggtggctccctcctcctgacaagggagctttgtgattggatttttggtgtttgagacccagctcttccccttcactgctgcttggacccagagcaaacccctcagctctagattctgtttcctctgtttgcggtggggatggtaagtgcacttgccccaagggtcagaagggccactgcgagggtcagaagggcccgctgcctgagccctgactccagtgccgggcgcgtgggcgtcgtgttgccaccgtgggaacagtcatcacactctgcccgtttccctcagggcccagcccagcacccacagcgtctcatcttctcatctgtgcatttgagagttatccatgcaccaggtaggcagagacagaatgctgggcttggcaaaggctgagacgcagagagacgggagggccctccccacactcccatccagagagggcgcccagatgctgccggatgagagcgtctccctttcctggcctgcaggctggctgctactctgcaggtgcatgggctgaaacagttgctatttatttgaatatttccaatcctgctccttcttcaactttcatccggtgggaactggccgcactgcagtgtaattcttcatttcaaagatggatgaatcacattaattgcacagaaaaccatctccaaacctaaaacaaccaaatgtgggtgccaggagagacttcgtttgcttcagtggcagctggtctgtttttcctctgaagagattaagcaaaggaacccttagtaactgtgtgtgatacaaagatggtctgtcagcctttgggaatactagtttactaaaaagaaatatttctttctttcaatcaacagaactgtacttgctgaagataaacgtgcttaagaacatgcagctaacgctatgaaattagcgttactcacactcagttggaatagaagtgccttcaaccttttagcaaaggcaagagcaaattatagcaaaaaactcatttcagaagtcatctttgtgcagaataggccgggccccgaggtcaaggcatccatttggcactctatttccataatgcgattccgcagcgtacgggcgtcagaggaaagcacatctgctgtcatattagtcttataaatgccgatgttaacgctcctttacagacaaagccatcttgggggtgtggccacaggagtttcctctgcctggaagtccttgatttaagaggccgctgggtggaaccttcggccgtgctgccctgtgcagcgcatcctctggcagcctccctgtagtggccctgctcagtgttaccttcggtgttctagagtggccaggtggccccagattgcaggagggatgcccggaagctgtcaggtcggggagtcttagcagccctatgtggctgcttggaccctgggtgctgaatcacagcctggagaactctgcctgtcaggactatgcatgccttttgatttgtttgcttaatatatatattttttcctgcacttaaagataatgcaagctgtataaaaaacagaaataaaaaccaaaagggagatgcccatgaagctgaatcagagggtgactagatgctggggctgtcttggggcactctggggatcagcgtggtggagatcagctccgggaaccagcgtggtggggaccagctccggggaccagcgtggtggggaccagctctagggaccagtgttggggggaccagctccagggaccagcacaggggagaccagctctggggaccagcatggggggaccagctccgggtaccagctcatgggagaccagctctggggaccagcattggggggatcagctccagggaccagcattggggggaccagcttcggggaccagtgttggggggaccagctctggggaccagcattggggaggccagctctggggtccagcctgggggtgtccagctccagggaccagcgttggggggaccagctccggggaccagcgttggggggaccagctccggggaccagcgttggggggatcagctctggggaccagcactggggaggccagctccggggtccagcctgggggtgtccagctccggggaccagcgttgggggtccagctctggggaccagcacggggtgggcaggtgagactccacggggacctcttagagctgctggggctcggggcaagcctccctctgtgcctgcagtgctcagccagaggtgctcatccccggaaggtgtggccctgcgagggggtcttccgcacacagccagcgcccaggagggctgatggcagagggtgtctgtggcgtgactcacagaacctcatccccggggccacgacggacgctgagtgcgctacgtccagctgtgtgaggttcatctctcccttttagaaaattacatccatgggtttatattccttttctcaataagtactatatcttgagcatgtcacgttatctgttttataaatatgatctttaatgtggtgtaatttaattattcacctacggttggaaattcctttgtttctcaatgtctgattcttagtaagcacatctttgaaaacgaacggttttccgcatatgaatcatttccttagaacattcccctagaagtgaaattcctaggtcacttggtgtgtgcatttttgagagttgctgaattttccttccgagaacttgcataaagttcctctctcaagcgtgaggtgcttgttgcgtcacaaggtcatcaatgtggatgtttattagtgaagaattttaattgtgtaggaaaatatgcctcctcgttttggttttcatttcttatgctaagtttatgttttcttttatgaattttattggtaaaattgttacaaatgttaatcaaataaaacataaggatatattttattctcatgtatttaaaaatagaaggttaaatcttcatgaagtgaaattaatcttttttttttttgctttcctttgcttgtttaggaagtctctcttattataggatctgataactattcacctaattttttccttcctttttttcacctaaatttttcctaccaaaaaaaggttttacttgaatccatctaagccattggagatccatgttgctgtcagggtcacttggccgtgttatccttgtccacactgtgggcccgtgtttcttccctgcgcagtcacatacctggtcaagtttgttcctaggtatctgaaaatttttcgttatgaccgagtgagattattttttctcatatttcccaaatgacaattgctgctacattttttactttttttcttataatgggctgctctaccaaaactctttcattgtgatagttcgtttgattctttagaattcaaaaacagttgtgtgtaagggtgttttaaaaattgttaattttgtgtggtatttagtaaactctgaatcttcagatgagcatctttggaagtggaagtttttttgtattccacttttgcatgttgctttctttcatttattctggttctcccagcctttattgattgattgatttttaaaaatttttttgagacaggagtctcgctctgtcacccaggctggagtgcagtggtgcaatcttggttcactgcaagctccgcctcctgggtttatggcattctcctgcttcagcctcctgagtagctgggactacaggtgcccaccaccacgcccagctaatttattgtatttttagtagagacggggtttcaccgtgttggccaggatggtctcagtctcctgacctcgtgatccacccgcctcggcctcccaaagtgctgggattacaggcgtgagccactgcgcccagccctcccagcctttatttattttttctttttatttttgagatggagtctcgctctgtcacccaggctggagtgcagtggtacaatctcggctcactgcaacctctgcctcccaggttcaagcaattctcctgcctcagcctctcgagtaactgggactacaggtgtgtcaccatacctagctaatttttgtatttttaatagagatggggttttgccgtgtcggccaggctgctctcaaactcctgacctcaggtgatcggtgtgcctcggcctccctaagtgttgagattacaggcatgagccactgcgctggcctctcccagcctttaaaaggcagttgtccttatgccaaatccccagtcagtcaccgccgtgcaccagtttctcctgcagtgttgatcacctcgttcccatcgtctgtagctaagctcctgttcacggtggctttcgtgtgactgaggtgacttcccgggacagttctgccctcggtgtttctgactgggcctcctgcccgctgagaccacactgtcctcttcacagacttccttctcagtctgtctgccgcccagtcaggtcggggacttctggagtgctgttatcttgctttttatggttgtcattttcttaaatttgagaacacaaatcagatgctttttagaatttacatgggtttccaactgtaatttttaaaacctatttattttcctgtaccttcaatgtaggtttgccttttccgtgctacagaatcattttgtggctctcacatggtttttctgtttcagtgttccagtttctctgtgtatgtttgtaactatgttttcacgtttttatccttataacgggaaatgtgtaatcagggctgatatttaccaataaacagattggtgaatgagcagattccccttggcccttttactttctctactggacagtgggaggcgtttcctctcggttcaggcagatgccatgtgtggcctcaagtcagcctggtgctgatagcatctgcccagtggccccaggttgggggggtcctgttctgacccccggcaccctcaccatgtgttgagtgattcacttttggacactctgtgtattagtcagggttctctagaggggcagatatatatatatcatattagttacatatacgtgtatgtatataactttataggtatatatatgtgtgtgtgtgtgtgtgtgtgtatgtgtgtatatatatataaaggggagtttactaagtattaactcacatgatcacaaggtcccacaataggctgtctgcaaggagagccagtccaggtcccaaggctgaagaacttggagtccaatgttcaagggcaagaagcatccagcatgggagaaagatgtaggctgggaggctaggccagtctagtcttgtcacgatattctgcctgctttatattctggccatgccagcgactgattagatggtgcccacccagactgagggtgggtctgcccctcccagtccactgacccaaatgtgaatctccttcggcaacgccctcacagacacacccaggatcaatactttccatccttcaatccaatcaagttgacactcagtgttaaccatcacactctggttcctctggaccccacacaattcctgcctcttcacctctgtctggcagagctctcgtcctaaaattacagtttctgtgtggccacagcaaggaggaagacttggggggtcgaggatggtggggcccagctgggccttgggtctctgagggacctgcaggggagggggctgagtgctgtccttcctccctggggagccccccagctgctctgtgccttggtccttggacgtccctgtgcagcaaagcagtggcctcctggcttccacacctgtcatttctcatttactgtgcgggcgggccgggccaggaactaacagtttcatatgaacttcacctaaaagtccacactgagcttttcaaagtgtggctgtcggcttccatcatgtatggaaaccctacttcatctacctggtcatcactgtgatcagtgctagcccagccagtgatgctggtaggaataccattttttctttttcaagaaagtttgtaatgaaagctttaggtagtcgctaagaaaagtcaagatttgcttctctgaagtcaacacaagcgggggcctcccagggaagctgtggcagctgttacagggtcccgcttctctcctggtagggatgttccagttgggttcagcctgctgccgaatatcctgggaggccggtgcaggaggctctagaatcaacctgtactgtaaacgtttgccctgttgaagttatggaattacaggacaaattctctgacttagatatgcagtggtgtggacagtaaagcctcatcaataaggtttgtattaaaatgctcggtgacttctggtgctggtcaaatattgttctttcctcagctcaatttaaaggttttcctcctctgggaaacttgcagaagggaaagtcaaactcaggaatttggtgtcttgaaacaggaacatggccctaagttatggtgggagcagatgagccattcccaaatgctgctgccatggttgaaatttgtaaaccgtctggagaaacggtccatataattgaatcttttgaaaatgaactcattatggagagagttgcattttagaggggaatgactgagcatctgatgggctctgggccaaggaggtcaaacgacttttccttcattctgatagccatggatgggttcaagagcttattttttactctctggaaaaaaactaacattaatagagcttatcccagacttcttggggctatttccaaaggacagaatgctgaggctcacttacaacgtaatttcgtcatccttcgcccgcggagagctaacccatggtgaattaagcaggtgactgacgtgctccccaggagccagcctgactccagcacagtgtgagtgccaccgcccagcctcccagttggtgcctccatcctgtgaaccactgcgtcctcctgcccatgatggccgtggcctttccctttcccaccagtgaggatatctgagtaccacagagctcaggtgagggaagtcagcagttgtctagcatagcttccgtattttacaggtgagaacacaggacttggagaatcgggggctcatggccacatggggagtgaatgcctgtgtgtggaccagaggcctggccgtccacctggggcatctgtgcccccgccatacttcccaattcagctgccgtagcagcaggagcatgcttgtgcctgggccagatgcttccgagcactgggggctggttgaccgaggagaagtcagctctgtgggtgtccctgcagcctggggcacgagtcctgagcttgtctctcattccaggtgctgttgcctttcctggcaacttatctaggacttttctgatgcagaggtcactgtttctcccctgaacccctaagctatgcttttccagtcctgggtgcacgggagcggcactgcccagcacagacagggttatgtagcagaaacactccctggaattggcaaaggcaccgctttgctgttttaaatcctatttgctttccttgtgacgtcttcggtcattttcatggtttatttccattcacaatacccctggaaacagaaaccagctaaacgactgcagctttggatctctggtaaccagaagcaaagacaaaaattcaggaatgagaaccctggccgtcaatggcgactgatttcagaaattgaaaatgtccttaggacaagtcccagcaaatgtggcagaagaaccacccatggtccgcagcaccacgtccttccagccgtgtatgtctcggtggatggaggggctgccggggctctgcgttcggggaaacaaggcgctgtgggcttgttcccgggttgccatggcgattcctcattatctccagtcacagagccgtgtgcagggtattggcagcttacacatgtgctgcagcttctcccagggatgctgtgggtgtgtgggtgtgtgtgcgtgtgcacgcgtgcattgggctgtggcttctcccagggatgctgtgggtgtgtgggtgtgtgtgcgtttgcacgcgtgcattgggctgtggcttctcccggggatgctgtgggtgtgtgtgtgcatttgcacacgtgcattgggctgcagcttctcccagggatgctgtgggtgtgtgggtgtgtgtgcatgtgcacgcgtgcattgggctgcagcttctagggatgctgtgtgtgtgtgtgcatttgcacacgtgcattgggctgcagcttctcccagggatgctgtgggtgtgtgggtgtgtgtgcatgtgcacgcgtgcattgggctgcagcttctagggatgctgtgtgtgtgtgcgtgtgtgtgtgcacgcgtgcattgggctgcagcttctagggatgctgtgtgtgtgtgtatttgcacacgtgcattgggctgcagcttctcccagggatgctgtgggtgtgtgtgcatgtgtgcatgtgcatgtgtgcattgggctgtggcttctcccagggatgcagtgtgtgtgtgtgtgtgcacgcgtgcattgggctgcggcttctcccagggatgctgtgtgtgtgtgggtgtgtgtgtgtgcacgcatgcactggtctgcggcttctcccagggatgctgtgtgtgtgtgggtgtgtgtgtgtgtatgcacgtgtgcactgggcttcggcttctcccagggatgctgtgtgtgtgtgggtgtgtgtgcgtgtgcatgtgtgcattgggctgcggcttctcccagggatgctgtgtgtgtgcgtgtgcattgggctgcggcttctcccagggatgctgtgggtgtgtgtgcgtgtgcatgcatgcatgggagcagactccacgcatgccagttctaacgggcttcaacaacacctgagctctgctggagcacgtgctgtttccaatgggagcgaacgtgtttcctgtcactccagctgattgatctgaatatcagggaatcgatgtcatgtgatttcttttgtaggaagagagggaggagagacaaagggaagagaaggggaagggaggggtgaggaagggaagacagatgggaaaaatcacaccctcgttggttgtgaggagcacaaaaattgccgttgtcagaagtgccgatgaggtctgcctccagccccgctggcctccggagccctgagaaattcccacggaccgtccaacgcgatggagactttgtgcggtgactgtggctcacgtgaggcgctcgcaaggacggtttcccacttgcgtgattccttgtcctgagttatgggaaacgctttcgagtctggggttttttcagattgtgtctgaagagtgaaggctatttattaaaatagtgtggagtaaaccacccaatttgaccatgactttagggtgagaacgtgtgtgtctgtatgaatgtatgtatgtgttgtgtgtgcacatgcgtgtgtgtgtgtgaatgtgtgtgttgtgggtgcacacgcatatgtgcaagggtggttgtgtgtagtgaacctgttgctgttagctgcctgctcaggtgtgaccattctcatgccgttccgttatttcttttttggtagaagtcaagtgcctatgactttccaggccacagtccttggcagggtgtgtatttagaggtaaacatgcctggagacctgtgtgtgtggacagagagaggggaggagccccggctatagacgatgccccacaaacacatccgaggcttggatgacgacttcccagctgtgtgatcaaaactcccgggatctggggctgggacggagaattatgcatggagatcctcactctcagcgtgtcagcgtgaagtctgatgtttaattgaacatctgtctgcctttaatatgaacctcattattaagcttacatgtgactgtctctttgcttgtattctcagatcttaggagatctttaaaaaattgatttataaaccagaaaaagagacattcttggtcacacttacctgaatacgaagtgaggatgggggctctgcataccctgctgtgggaagcatggcgagaggcaggtgaagtgaggatgggggctctgcataccctgctgggggaagcatggcgagaggcaggtgaagtgaggatgggggctctgcagaccctgctgtgggaagcatggcgagaggcaggtgaagtgaggatgggggctctgcagaccttgctgggggaagcatggcgagaggcaggtgaagtgaggatgggggttctgcagaccctgctgtgggaagcatggcgagaggcagatgaagtgaggatgggggctctgcagaccctgctgggggaagcatggtgagaggcagggtttttggtcttaaggaattgatttggttcccaaagccccattggctagaaggtcactgactgcctcatcgttcgcctttcaaagagaagaatgaaacagcgtccggcaggaggcgatgtctggggaagcgtgtgtgtgtctccccatgtgcatgtgtgtctgtgcatgtgtgtgtgtggttgtctgccagcctgaagtccccttttctgtcatattctagtccactgtgatcaacaccagagactcctccatccactctctccatcggccacctcctctccctgacctgccagaggcatccgtggagacccagacactggggttcctgagctgcaggccagccgcttcccaggcccgtgccccgccccctcccgacctctcctggctctctcacctcagagctctgggggccgagcgccctgggacaccctaagtgtctcacctcggagttctggcaccctgcctgtctcactgtatcagcatgcgcggttctctcctaggcaggcacgattttatgtttgtctgggaaatgtgacgatcaagactgggtgaggcccttccaggtcaggtggtcaggaaagcgctcaccaggaattgtgtgcaggcttcgacggggctgcaggacctctctggtcagagaatgaattcagagctgtgggctgagtttcacttgtatgttttgttttttccgaaattgggctcgcagtggttccagcgtgggtgtgacttagttccagaggctctggaggaggcggcctccccaagcaaccgagcatcctcccatagcttctcagggcctctgcgagcacctgagcgtcctcccatagcctctcatggcctcccaagcatcctcctgtagcctctcgtggcctcccgagcgtcctcccgtagcctctcctggcctccctagtgtcctccccttgcctctctggtggaggctcagcgaaggctggcgagctgctgtccatggtgctggccatctggccccagggaaagggctttcgagagtggtgctccacgggtcctgtccccctcggctcatgacgcgcggtgcataatcctgcggagacagctggggccgcctctgttccatggatcatggggaccagggccacctacaacatggtggcctgaattgcgattgtgtctccagtggcgtcgttttgagacttctctttaattctgactcttaattctgactcaaggtccccagagggacggtgactgagccagtcccatctggggctttggggctactgcccctgggatgtttgggccccagaagtgaacactaacccttggaaatctgcagggctttcagacccctgccttccttctccactacctctcatctggactcgagttccctgattctctgcattttcaccaggatgagcgtggttgtgatggacaaacctgacttacggttttatacgcacatccagttatctccttagaatatatctttagcagagaaactggggctcctggggcttggccattttaaaacttcagtcaagttgcaaatttgtcccttgcagaggggacacctaatttgtgcccaacaaaatgtagatgagtccatgtcattcaccagcaacctgagttatcccacaaagtcctttgcctttctgaggtctgatgggcagaattgtcacattgccttaattaggccatctttaattacaaataaagtcaaatttttcttctctgtgagtaaatgagttgtggacatttttttcttcctgtgctttggggccagggtggcctgaggaaagtgccgggcacaggggctctgtcccttcatcctcttgccacacaggacagtgctggccttgggagacaccaggctgaggccgggcgggcaggggcggcctcttctgcctcctcctctggacagcccagagctgagttaggagagctggggcgatggaggtccaggaaaggtggtgcctgctggtgcagctgtggcttctctgcatttctagtctgggctgggctgtttgttaatggaaaagaggcccaggctgggaggttgatggtagcacaggtgcagggacgggatgagtgacagacagacggaggaaagatggaacccacgatggggaaggggctgggattcagggccaagaaacgaagggaggagagaagcggggatgagctccataggcagggtccaggctcagcgggaagagctgggaagagggggatgagggagaggcagggctcaggcagagacacagtgaggactgggcagtgccagctcaggttctcaggagggcctgccccagccagaccatctgtggtgaaggtgagcccacacctggctccaggcactgaccttcctggggcccttgttggtatctgtgttgggggaacacagatccatgcctgcctaggatcccccaggagggtccgggagtgcccccaaggtccatggtgggcatctgctaacagcctgtcctgagggcagggctggctccggggctccagatcgtctgtggctcagctctctctggagggctgtttgggtctcaggtctgaatattggagcccagggcttcagtggaactgggcagtggggatttctgccaggtgtggatggcctgagcagcaagaaagagcaaaagaggttttcacagcgtccttctccagccagctgtgatggggtctgggcaaggatggatgaagagtctgtgggttgtcctggggaggggtggacatggcgtctgtgggtcatcctgggggagggtggacgtagggtttgtgagtcgtcccaggtgagggtggacacggggtctgtgggttgccagggtgtggggtctgcgcatcatccttggtgagggtggatgcagggtctgtgggtcaccccaggtgagggtggacgcggggtctgtgggttgccagggtgtggggtctgcgcatcatcctgggtgagggtggatgcagggtctgtgggtcaccccgggtgagggtggacgcggggtctgtgcgtcatcctgggtgagggtggatgtggggtctgtgcgtcgtcctgggtgtgggtggatgtggggtctgtgcgtcgtcctgggtgagggtggatgtggggtctgtgcatcgtcctgggtgagggtggatgtggggtctgtgcgtcgtcctgggtgagggtggatgtggggtctgtgcgtcgtcctgggtgagggtggatgcagggtctgtgggtcaccccgggtgagggtggacgcggggtctgtgcgtcgtcctgggtgagggtggatgtggggtctgtgcgtcatcctgggtgagggtggatgtggggtctgtgcgtcgtcctgggtgagggtggatgtggggtctgtgcgtcatcctgggtgagggtggatgtggggtctgtgcgtcgtcctgggtgagggtggatgtggggtctgtgggtcatcctgggtgtgggtggatgtggggtctgtgcgtcatcctgggtgagggtggatgtggggtctgtgcgtcatcctgggtgtgggtggatgtggggtctgtgcgtcgtcctgggtgagggtggatgtggggtctgtgcgtcatcctgggtgtgggtggatgtggggtctgtgcgtcatcctgggtgagggtggatgtggggtctgtgcatcgtcctgggtgagggtggatgtggggtctgtgcgtcatcctgggtgagggtggatgtggggtctgtgcgtcatcctgggtgtgggtggatgtggggtctgtgcgtcgtcctgggtgagggtggatgtggggtctgtgcgtcatcctgggtgagggtggatgtggggtctgtgcgtcatcctgggtgagggtggatgtggggtctgtgcgtcgtcctgggtgagggtggatgtggggtctgtgcgtcgtcctgggtgagggtggatgtggggtctgtgcgtcgtcctgggtgagggtggatgtggggtctgtgcgtcgtcctgggtgagggtggatgtggggtctgtgcgtcgtcctgggtgagggtggatgtggggtctgtgcgtcatcctgggtgagggtggatgtggggtctgtgcgtcgtcctgggtgtgggtggacttgggatctgtgggttgtctgggtgaggaaggatgcagcgtccgtgtccccttcacacgctgctcttaaggagcgctgtgagatgtcccactgaggggcttgtcttctcactctccacagctgacatctccagtgttaggtcttgggcaccaaggaggggccaagctaaggtgctgtatattaaaaactgtcagaggaagaaggccattccatcaggaatgccttcttcaggcatctgggctctcgcttgggctgccattcttaatcatgttttaattttcaaataaattgctttcattatccgttcatcgacaacaccacgtgtacattactgctcattaatgtttgtcagctactgtgctgaggctgggtttttaaatagccatggtcacggtgcagtaattaatgatgacccatgttggttttacagaattattattatgtttaatctttgaaaaaacaacctagagtgtcgcggtgttgctgaaagttgtcctcaggctgcaaatctttgaaggccgcaggagtccttgggcaggccttcgtgttgacctgggagcagtccttttatggctccagctgggtccccccggctggccgagcggagtgcctgggtggcactgaggaccacctttcctttgtgactgtgtgttggcctcgccaaatgacctcttggccaatgtgataccaaattaagtttcttgaaaaaacatccattatttaaagcattcatttcgtgcttgaggtctgatcctgttcaaatcagaagccaagacattttcaacgttagtgatggtcgcctctgtagacttgtgtctggttaaagttgtgagtattgatagcgtcttcccacctgtgcgtgaatcactttggatttctggggtctgagcagggactcgccggccatggccttgctgatggggcctcccagatgctgcctgccttcctgtggttggattagctatgctggggccttgaggtcatgctcatcatcaacctcatagtccagactccttagagtggggatggcgtccctcccatccagtttctcatttattcagtaaaccttttatcacttcttaaagactttcagtaacttatacataagaatgaccattttaaccatttagggatatagttcagtggtataaaggatattcacactgctgtgtagccatcaccaccatccacctgccaactttctattccaaacagaacctctgtgcgcattaatgctgactccccctccccaaggccctggctgcactcagtgtaccttctgtgaacctgaccatctgggggccacgtatcagtgcaatcggagcatgtgcccggctgcagccgaacgctaaaggcagcaccgcgtgctcagggctggtgcaggtgtggactgtgtcagcgtctccttcctttctgaggctgagtcccattctgtcgtgtaaatagaccacgttctgtttctccacccctcagctgctgggcgcctgggttgtttctgtgtctggcttctgtgaataacatgctgtgtgcgtgggggtacatacacgtatttctttgagtcattgctttcaagtctggtaaattttcatgaaaccatttccgtcggccgaatattgtgataactgggctttcagtgtgtctctggaggccaggaagggcagagccgcctgcagccctcctccagcccatccttctgagaatggctgagcttccaggccatgctcctgaaaaaggtgaagctgagggcaggaaagagggccccccatggctacctcagcccacgcccctcccaccagtttaagaccaggccggaagaaaggtgggcgtagggcgtctcaggtctccctgtggttggtttggggcagcctcccgaggcttgctgggcacccagtccccgcctgcaggggtgagccgggctgctgttcccactgtcctgggctgagttcatgtattcgagtaactcacaaagttgggccttccattctaaggagccaccttaagccttgtgggagggccagagagagaaaaagagagagacagagacagaaagagagaaacagagacatgcacacacaaggggaggggaggagccccatgcacccctgattgtaagtgtgtcccctactttgcccttggcttggccggggccctctagttggtggtgggacggtgagccagagttgagggctggcggctgggttctgagagccgccactgtcccaatgggacacccctgctggacgcaatgcgcctcctgccttgtgagcttcctgccctgggaccaggcccttctttctccccggaatggtccctggaaccttacgggacataagagctgggtcccggttgcttggcagtggctgctacaggcttgctgatggctgacggctgcacagataagctgccttcctcctctcctgccgcttttcttagcacccgcagctgacggtgcctgtgtgacgccctcagtgatttgggtgggcctgggctgcgcagcaaatgcaggttgcccagcaccctgaaggccagtgttgggccagcccctggccttgtccggggtctggccttggggtgagcatagcctggcgtctaccgagcaagccaggaagccaccatttgtgtctgtgatggaggcacctcctgtcacctccacagaaagagtcaaaaccacccctgaaatcactgaggtgctgccacagggcgtcaacgacagcctggccctcgcctttgggtggtgccgctgggccagggaacccacagacctgccgcagaggcctgcaagccgggcacccactgccgggcgtcgttttgtctcctttctcttttatgtaatgtggatgctttcccccagtaaactctacctgcaaacaagccccgtgttcacatcattcgtccggttcctcttccgtcctcaaatcttggtttctattttctggttgtttgcacaggaccatggaatttcggaattggagatgttcctgccattgggttccactctgttacttgcagaaaaactaactctgcagtccagagaggcctggtagccagacggaggccgctctcccggccagcacagagcccacctgaccctgtgctggggcccaggatcttcccagccacagtttcgatgatgatcgtgatgggttttacttggtccccagaagctttctcccagtcagtccatttctcctgatttccccatagaaaagctaagagaaaatttatcagaaattatttctacttttttttttttagctcttttcaccttttgctttgttatgttatgaattgtgacctatctggcccctcaaataaaatgtgggctccttgcagcacaggctctgtctggctgatctttgtattttctttacgcacagcgctcagcatggtgcctggatggtggtgcctgctcagcatcagcctgtttatttaagaggtgtgcatggggttcttatctgccgggtgggaagccctgtgctccacagattgctggcagtgttgggtgaggacttcaccactgttgtttttgattatgttcaactttccttgtccaaaaaaacccaaggaagcaacaaaaagatactctatgagttgatgaatttgaagtgggaatgtgatagggaaggaaaaagaagcaaatgttcccacaaggtcaacagagttcctgcaactaagccttaaggttgcctttgagctcccagaattcaggatgaaaggggaaaaagataagttgagtggggctttataaataaaaaatgcatgtagtaggttagacaaagggaaatgagtgacttgttggttattttagattcccgaggaaatttttgtcaacagtgatgaccagcttgtattgtctttattttcagaaatggcagtcttttacattggatgtcctttatcccaactgtgaaaactttaatcatttacttaaataccataaagacagccaagaagacattttccattgatttatatgtgtgtgaaaactcattgtgaaaaaacttgtaattttccataataataaaaaagctttgattgagggctcaatcactgtgggcccatgacggctgctaggctgggtggtggcgcctggaaccacattctgtttcgagggcagataagcagagaggcagcagggtcatcatcagcctttggcaagaacagccttcccgcatccccacgtggaggattcgcatctgcctgtgagcgaggtctcaccccatcatcttggggttcacgctcacgctcttcccctgcgttccctggatgcttccttcaggctggctcctgtgcacgcagattctccctgttgccatctggtggtgagtactgggttttggatgcagccagtgtagttctgcagagtccagcaaatgaggggactctgtcctggctcataaggacatccctctgcactgctgcgggcttctccactgcgtgcttctggggcccagcctgcctgactgctcctgcctctcctgccgttgttgctggtggccagcccattgcagggctgcactgcagttgcatttcctcagttctctgttgacacaaacggacagatgacacagtgtgagcagctggcaggagagtgagagagaggcaggcaatgttcacagctcacaaaagctaaattacagacacttatgctgcagcaccctagctatcatcatgcaaacacagaacatttgattggaaaggatcctagaaaataccgaattcattggtctcaatttaggaaatggaagcacagagaagtgaagtgatttgcccaagtttgcacagcaggctggtggcaaggtggaatgagaatctgccctcttagtgccccattcgatgtatttttgttctttctgaatgaagagatctcttcagcatttattgtaaggtgggtttggtggtgatgaattctctcagcttttgttcgtctgggaaagaatttatctcttctttgtatttgaagggtagctttgctggatacagtattcttgggtgacagattttttttttttttcctttcaagactccgaaagtatcatcccattttctcctggtctgtatgttttccattgagatgtctgttgacaaacaaattggagctcctttagatgttatttgcttcctttggggtcttctctttgcccttgagctttgacagtttaattattaaaagcctgaggtggtcatatttgggttgaatctggtgttctctgactttcccgaatctggttatctatacctttctcaagtttcagaaagttttctgttactgtttctttgagtaagcttggtacctcttgttctcactcagctccctcttgaacaccagtaattcttggatttggtgttttgaggtaattttctctatcttgtaggttgtctttcattctttgttctttttcctcctctgattgtgtatttgagctcactgattctttcctctgcttaagccactctgctgttgggagcttgtcatgaatttcctcatttcgctaaatgtatttttgtttcaagacttctgtctgatttttaaaaattatttcaatctgttgttaactttctgaattgatttcctggtgttatcttggggatcaccgagtttccttagggctgccattttgatttcttgatgagagctcacaaatcgccactttgttgggccagtcactggttcttggctttgtccgtttggggaggccatggtcccgtctgctgctttctggtttgttgatgtgtgtctgtgtcttggcactgaacggttatttatttatctcttctctgtctgggtgttttggtttttctggggtatgtttgcttaaagattctttgtgatttacctgtggagtgttttcttgctaggttgcagcctcctttttggcactagatggcgccttaagcccaggttcaactcagctctggtcactgatgaaagtgctgcctgtcccaaagcagatgtcccaaaggggatgtcctgataacgtgggaaggctgggaggggacctgggagcacaggtcctgcagcgtggggctgcgagtggccactctgattgagtgcctcctttggccgagttgcagagcagagtttccagggctggggacagtagccccacccccacctttgtctctggccatcctcagggctgtttctcccttcaggcactcaggatgctccccatgggttgaggcagggagaggtctcctgccagggcacccaagagcagggcaagctgttgttatctcacctttctaagtgtagaaactgtgtcaagggaaaatcttttgtgtactggatgccaggcaggttatggggaggggccttgcagatgtgggggtctggttctcctgctgtctgtctgttcggggtttttctgttcctggtggccccaggacctgactcatcctcacctctgggttctcagatgttgctggtgaccatctcagcatctcagcactgcatgtttgctttcaggtttctgctggggtggtgagacagcttgctcctgtcctgccgtttggaaccagaaaccccatttcaattgctgttttctcattgtcctttaatagaactcagaagacagcagatggttttaggtgtgtatgacaagtgtggtcttaggcaaatgtaaagtaagctttcagccataacttcaacattgtgcttagcaagtgaatgtccactcatagttttaggacttgtttacatgagtcctggattttataaagccccgagtgatgtgtcatcttttgactctgaccttaacttctattgtgttgttttctattaaggaaaacagtgggatgctagagtgccccatcagggccaagagtgaggaccacatctgcatcgtggtattggatgatgtggtgtgaggcagggggtgctcccagtgggcagcacggctgtggaggacctcagttttcttatttgtaaaatgaagggtcctgagtgaaatacatgctgctgttctcttcaacttctgataaaaatcttgattattctaaatactaacagggtgtgatctgttggcctgctgttaggagacccggaataggagcgagtgtctggcctattggcccagggtggcctgaatgtaactgggtggcctggtgcaggccctggtgcggcgaaagcagctgccatgttccagaaacagagtaacaggcagagagagccaggcagctgcagctcagaaaggttaatgtctccattcgaaaaatctatctctgctctcacctgaaacatttagattgaagggattgaaagctatatttggtaattctaagagagagttttctttgcagggaagggctaagagctttgaggctcaggtgtgattcgtttttgtcaatcaatattgtactcaggattaccaataccagcctaccccaattacgcctctctgaaatgtgtggggcccagagccttctattcctagctgcacgatgcttctgctgcctgacctcaccttcagggggcaataagaagtttaatccagccacgaatcggctgcagcacgggaggggcctgacccacctcagggtccaggcatcatcacaggagggtgaagcagccattctaatgcacttctggaaaatgcctatcgaagctgatccttgggtcctgctgtgtgcttgtgtaagtttgctccagagtagctggccagggaggggagtggtcaggaggggagcggacaggaggggagcggtcaggagggtagctggcagggaggggagcagtcaagaggggagcagacaggaggggagtggacaggaggggagcagtcaggaggggagcggacaggaggggagcggacaggaggggagcagtcaggaggggagcagtcaggaggggagcggacaggaggggagcggtcaggaggggagcagtcaggaggggagcggacaggaggggagcggacaggaggggagcggtcaggaggggagcggacaggaggggagcggacaggaggggagcggacaggaggggagcggtcaggaggggagcggacaggaggggagcggtcaggaggggagcggacaggaggggagcggacaggaggggagcggtcaggaggggagcggacaggaggggagcggtcaggaggggagcggacaggaggggagcggacaggaggggagcggacaggaggcgagcagacaggaggggagctgggctgggagtgggtggtcagaaaggtgcactttcttctcagtacttcctgttctgctacctttgtagtaaccagctcttctgatggccagagttcaagcccccctgaatgaaaatgatatctgtcactcagaaggctcctcccgtggggccgtgactggctgtggactggcccggctgcctgcatgccagggcaggtgttcacatggagttgttgagttgcactctcttgcccttgagaaggatgaggcgttaataaggtcattccttctgccatttcactcgtaggtaaccatgtttcgtgtagtaagaaacgcggggctaaagtgcccgtaatgttttagcattctttaaaaggccacttactttcacaaatgggagttttgagtgactgtgtcggctgctgtgtgagcaacgaaggaaagcaggtacagtgtacgagtcgccccagacagctgcaggcctgcagggagccctgggcttagactgtgcccaacaattaggaacccaaaagggactcagggatggggcccaactgagggtggctcatggggtgcagtaggagggagctggggaatagtgtgcagtggccaatggtgccagcgggtgagtccccctcctggaccctccttctgaaggggcagaacccctgggggtgggtggaggtggtagcacgagttcctcctgcacctcacccgtgccctcgaggtggcgagagatgccgtcggtgaggtccttctgcctcccgcataacagtttgatgctgacacatcaacacagcattccccaaagcagcttttcatttcgtaatgggataactgtgggctctggaagaggctcaggtgtgccgttgttctctgcagggatttccaggcagttgacggaactggcacctgaatgggccacaggtgtgccgggtgggatttggaaacgctgggggagagaatgagctttggtaaacagcagacaaattgatttgtattccaacatttttttcccttttggaaaatcagggttttttctgcctttggcattttgttgatagcctagaatccagctacttgctccttctgggtctgtttcctcatctgaactgtgaggctgggtgaggtgaggcgaggcactggcctggccggtgatgagcgactgatccactgggcgtggatccagtggccggcaggaggcaggggctctcctgtccctagggcaccttaggcagcagctctggcaccttccttcctgcacagcctggctcacaggcagccctgagatccaatggggtgatggggacaaatgtgttatgggactctaagtcactatttgtctccagctccctcacccccaggagtttcaaaatcattgaagacaaaattgacaggcagattctgggtgcagacggcagtcagacaccagaagcaggcccgcagtcagcatcttctgagcagcctctccatccttctgaggtttcattccaacctccctgcacttcctgggtgaagcaggtaccctgtacatgtttcctgggaacacggcaaccagccagtcctgcccctgcttgggaaagagccgcctgtttcagtggagtttgttcctgccagagggagcggagatggaagtgccggctgatgttgagcatctctcctcgggcagcaactcttagggcctcagggtcaatgctcaatggagcctccatctgtggggcttttgagtaacaatcaggtgaacatgccagggccttctttttacccatgtcttggtacagatcccatacatcttggtgcagccattctgtttgaggatgttttaggggagacacaggatgctgcaatccactttactgagcaccttttgccggaaggaatccgtgctgtatcctgtgacctagtctgcaaaggggaacacgtgagcgctagtaacgcccttgttcttggacatcaggaagggggtgggcctcatgtggcccggggggccctcagggaccacccagggagcacagtgacgtgggccatcctcagcactgccctcaggggccacccaggggtgcagtgatgtgggccaccctcagcactgccctcagggaccacccaggggtgcagtgacgtgggccaccctcagcactgccctcagggaccacccagggagcacagtgacgtgggccatcctcagcactgccctcaggggccacccaggggtgcagtgacgtgggccaccctcagcactgccctcagggaccacccaggggtgcagtgacgtgggccaccctcagcactgccctcagggaccacccaggggtgcagtgacgtgggccaccctcagcactgccctcagggaccacccaggggtgcagtgacgtgggccaccctcagcactgccctcagggaccacccaggggtgcagtgacgtgggccaccctcagcactgccctcagggaccacccaggggtgcagtgacgtgggccaccctcagcactgccctcagggaccacccaggggtgcagtgacgtgggccaccctcagcagtgccctcagggaccacccaggggtgcagtgatgtgggccaccctcagcactgccctcagggaccacccaggggtgcagtgacgtgggccaccctcagcactgccctcagggaccacccagggagcacagtgacgtgggccatcctcagcactgccctcaggggccacccaggggtgcagtgacgtgggccaccctcagcactgccctcagggaccacccaggggtgcagtgacgtgggccaccctcagcactgccctcagggaccacccaggggtgcagtgacgtgggccaccctcagcactgccctcagggaccacccaggggtgcagtgacgtgggccaccctcagcactgccctcagggaccacccaggggtgcagtgacgtgggccaccctcagcactgccctcagggaccacccaggggtgcagtgacgtgggccaccctcagcagtgccctcagggaccacccaggggtgcagtgacgtgggccaccctcagcactgcctcctcctgagggagggtaatgatggaatctgtccaggaggctccaggatggggatggaatgagtgagtggggattagcatcccagaactgttcaccttgttggggcaggagacacagtgacggtctctttgagaagtcctgtgctgtggtggttaggattcgggcctgtggccatcaccatacctcacaactgagcatgaaaactctgtgagggagggaaggacctcaggtgttgggggcctggcccagctcagcactcaggactgcaagtgacagaagccaacacagactcacgtggggcatactggactgtgaatggggaccccagggtggctctggggctgtgaatggggaccccagggtggctctggggctgtgaatggggaccccagggtggctctggggctgtgaatggggaccccagggtggctctggggctgtgaatggggaccccagggtggctctggggctgtgaatggggaccccagggtggctctggggctgtgaatggggaccccagggtggctctggggctgtgaatggggaacccagggtggctctggggctgtgaatggcgaacccagggtggctctggcacagtggccgggatctgcagcatctccccgctgcttttgtctccagtttctctctctttgtgtggtgttgggatggctgcttgtccacctgttcactcctgttcacagggcttagcaaccaatctgcatgaaaagagagaatcttccaccagagaaaagcatgtaggagggggccgtggtttggaatgggtcagggcctgcacctgaccagtgactgggcagggaatgagatgttcttgtggctcctgggccgcaagggagcaagtttagggattgacagccatcctaggataccacaacagcagagggggcacccccaggaatgcaaggcccttgacaagcaaatgccacaacctccatggttcactcaagaaggtgagtgctgccactaaaaaaatgtgtgactgcaatagataggaattaatttaacccagacggtgagacctgtacactgaaaactatgagatggtgaaagaaatggaagacaaggcaaataaatagaaggtatcccatgttcattgattgaaagaattaatattgttaaaatgtccgtactacctagagcaatctatagtttcagtgcaacccctatcaaaattccaatggcattttttttacagaaatagaaaagcaatcctaaaattcatatggaaccacataaaaccctgaatagccaaggcaatcaggagccaaaggaacaaagctggatgcatcacaccacctgatttcaaaatatactatgaaactataataaccaaaacaacgtggtactggcaacaacaaaacaaaatagacacatcaactaatggaacagaatagagagccaggaaatgaatccatgcatttatgctcaattcattttcagcaaaagtggcaagaacacataatgggaaaaggacagtgtcttcaataaatggtgccagaaaaactggatatccacatgcagaagaatgaaattagaacttatctctcaccacatacaaaaactcaaaagggattaaagacttaaatttaagacctgaaactgtaaaactactagaagaaatcacagggcaaaatgacataacattatcctgggcaacaattttttttatttgatccccaaagcacaggcaacaaaatcaaaaataaacaaatgggattatatcaaatacaaagctctacacagcaaacaaaacagttagcagagtgcacagacaacctaaggatggggagaaaatatttgcaagctgtacatccaataagggcttaatatccaaaatatataataagctcaaacaactcaatagcatgaaaatgaaaaacccaattaaaagacaggtaaagaatctgagtagatatttctcaaaagaagacataaaaatggccaacatgtatgtgaaaagatgctcaactgtgctaatcattagggaaatgcaaatcaaaaccacaatgggatatcatatcacacctgttagaatggctattattaaaaagacagcaagtgttggtgaggaagtggtgaaaagggaaatcttgtgcactattgggaatctaaatcggtacagtcattatggagaactgtatggaggcctctcaaacaacaaactaccatatcatctagcaatcccactatgaggtatttatccaaaggaagtaaaatcagcatgttgaagagagatctgcaccctcatgtttactgcagcactgtccacaatggccatgacatagaatcaacctaaatgtccatcgacagatggatggataaagacacagtgggatactattcagtcttaaaaaggaaggaattctgtgatttccagcatcatggatggaattggaaagcattacgctgagtgaaataagccaggcacagaaagacaaataccgcatgatcttactcatatgtggaactgaaaacaattgaactcacagtagcagagagtagaactgaggtcgccagaggccaggggtggagggaatggggagataacaggtggagggcacaaatctcaggggcaattttttgagttcgattgtacagtgtgatgaagataacagtagacggttatacatctcaaaactgctgagagaacaaattccaaatgtttttgccacaaaaatgttaagtatttgaagtgatggatatgttaactagcttgatttaattattccacattgtattcataaatcatagcattgccttgtacccattgatatggtttggctctgtgtccccacccacatctcaccttgagttgtaatccccagcgttggggagggacctggtgggaggtgactggatcatgcgggtggtttccaccacgctgttctcgtgatagtgagggagttctcatgagagctgatggtttaaaagtgtagcactccccccacccccactccttctgccgcctcaggaagaaggtgcttgcttctccttcgccttttgccatgactagtttcttgaggcctccccagccctgtggaactgtgagtcaattaaatctcttttcttcaaaaattacttagtcttgggtagttctttatagctgtgtgaaaatggacacccatatatatatacaattgtaaattataaaatgtgtgtgaccaagtcattttgcttcctcagcctcagtttccccacctgggatgagtggacggcattggaaagctctgggtgaccactgctgccacaccagctttggccccagcttgtagcttcaggaggtttttccacgggggtggaagaccctgtctccttctacctggggcttccaaaaccggtggcctttgtctttgttctttctcttgctccaccctgctcaaaaatacaagtcctcctgagcctccgaagcttactcttcataaaaccctctgtggcctcctataagaacacgctgtctccagacaaagctctggttaccagagtagcccacaaaaaacccaaattaagacaaaacccaaagtaagacaaaaaacctgtcttcccgttggccaggagacaggcagttaggttttctctccttgttaacgtctagtcactcagatgacttctttagtttcaaggctctgctgggaggggtgtttatgccatcatagttgagcagacataggcctagaccatcagtcacgtggactgtgggggtcctgccaggactgctcccaggcagcagggtccaccctcagagatggagcactggggcccaacattttatcctccagaatttctcccgcccactgcggtcccaggtgtccgcaccatactttccctccatggcctaactgaggccttgggtccaagctgtcttctgcctaaagctctgttttgggtatcgtccatcagcttctgggttctcacctcacagggctgacaggacatgtgcaaaccaacagggaagcagtgatttccagggaaacagatgcacaagctggtgcctgatttctcatcagaggagtgccagggtcccctgggcccctctcctaaacccaccgatgaaaggtgctggggtctgttcctgcacattgcaaatcgtgcaccgtcagagcgtcatttctgtcaggactgagcttggggagagcgaccacctccagcaacacagcctcacttgttctttcttggtgggttacgtgtgggacctctttgatttttacatctcactcattcttgggctagaaaagtctggttttccacgttttatgcgattccagattcctgtgtggcatttcagcccagactccagggtgtcttgtattaaatgccggcgagtataattagcattcaagacctgggtgcaaggcgttgcaagtgttaatttaacaggaaattatgtgtcttcagtttggtcgaggagctgcctcttctggaggcctaaacttgaaacagcctcccttgcctgcgactggggccaatgctccccactggacggagctcctgatgatggctcagccccatcccatattgcttctagttactaaactgccttgttcctgctgaagacagctcttcccgagcctggtctggctggtggcttcttggggcctgtgtggggttgctggagcttcccccgtctgtgctgtcctgggtatctcttgggtgaggccctgcgctttgctgctcgttgtcacggcttctaagggcccaggtgctggctcctcggcagggggacattttgtgtttttggaaggtgctggggtctgacactctcgtatgggggtctgggtggcatgtaagaggggctgtctttccctgaatgtgagtttctgggtcttatcttggggtgtggcagtgtgaagtgtatgttcattggtgtgttcactggtcttctttgggagctgaatttaaactcatcctggtgcctggaaatgcagtctagaccctccatggaagcctttacctgagctcgattgtagctgtgattccactgggagcagccgcgacagcccacgtgccacgagcatggctgcctgagcctctgcgcgagccctgcttgcaggtgttgggtgtaaaatcagaaagggggctgattccaccgggagcagccgcgacagcccacgtgccacgagcatggctgcctgagcctctgcgcgagctctgcttgcaggtgttgggtgtaaaatcagaaatggggctgattccaccgggagcagtcgcgacagcccatgtgccaccagcatggctgcctgagcctctgcgcgagccctgcttgcaggtattgggtgtaaaatcaaatggggctgtcggatcatctgctacttccacattgaacttttcccgtgtgctttccacggcgactgcatcaggttacgttcctgcccgcggagcacagggccctattttctccatgttctcacccacacgcgttattttcggttttgcttcgtttcgttttttgatagcagatgtcctgctgagcgggcagtaggtctcactgtggttttgatttgcgttgccttgacgctggtgatgctgggcgccttccctgtgctttcagctgtttgtacatcttctctggagaaaagtctactcaggtcctttacccgtttttaatcaggttttttgttgttgttgtcgagttgtggttctttatgtattttggatacaaatcccttatcagatagatgagggcaaatatttccccactccctggctgccttttcctgctgctaatagtgtcctttgatgcacagaagttttaattttgatggttacattctttctttttgagatgaagtttcactcttgttgcccaggctggagtgcaatggcgcaatctcagctcactgcaacgcagagctggtcatcggcatgtgctggctgaaaagaacccagcacttgtccaccctgccgttctccttcgcttttgaagcccctaaggacttaatatttcctggatcttggctcaagtgagcacgatgatgaggtttcctgagctcccggtggtctggaatggttgatcctgtttccgtacctccctcatgggtgctaagtgtcagtcagactttcctgccgctgcccattcctctatgggctccagcaaggcacccaacctctctgggctctagtttctgaatatggaatggggaccatgacagtttatgccactaagggttatcataaggactgactgagttgactgtgtgagtgatgtctgtagatgtcagctcttatggtgagagtgtgggtgtgagcgacgtctgcaggtgtcagctcttatggtgagagtgtgggtgtgagtgacgtctgcaggtgtcagctcttatggtgagagtgtgggtttgagtgacgtctgcaggtgtcagctcttatggtgagagtgtgggtgtgagtgacgtctgcaggtgtcagctcttatggtgagagtgtgggtgtgagtgacgtctgcagatgtcagctcttatggtgagagtgtgggtgtgagtgacgtctgcaggtgtcagctcttatggtgagagtgtgggtgtgagtgacgtctgcgggtgtcagctctatggtgagagtgtgggtgtgagtgacgtctgcgggcgtcagctcttatggtgagagtgtgagtgtgagtgacgtgtgtgggtgtgagtgacgtctgtgggcgtcggctcttatggtgagagtgtgggtgtgagtgacctctgcgggcgacagctcttatggtgagagtgtgggtgtgagtgacgtctgcaggtgacaccccttctggtgagagtgtggatgtgagtaacgtctgcgggtgtcagctcttatggtgagagtgtgggtgtgagtgacgtctgcaggtgtcacctcttatggtgagagtgtgggtgtgagtgacgtctgcgggcgacagctcttatggtgagaatgtgggtgtgagtgacgtctgcaggtgtcagctcatatggtgagtgtgggtgtgagtgacgcctgcggggcacactcttatggtgagagtgtgggtgtgagtgacgtctgctggtgtcacctcttacggtgagagtgtgggtgtgagtgacgtctgcaggtgtcagctcttatggtgagagtgtcggtgtgagtgacgtctgcgggcgtcagctctatggtgagagtgtgggtgtgagtgacctctgcgggcgacagctcttatggtgagagtgtgggtgtgagtgacgtctgcatgtgttacctcttatggtgagagtgtgggtgtgagtgatgtctgcgggtgtcacctcttatggtgagagtgtgggtgtgagtgacgtctgcagatgtcacctcttatggtgagagtgtgggtgtgagtgacgtctgcacgtgtcaccaattatggtgagagtgtgggtgtgaatgacgtctgaaggtgttacctcttatggtgagagtgtgggtgtgagtgacctctgcgggcgacagctcttatggtgagagtgtgggtgtgagtgacgtctgcatgtgttacctcttatggtgagagtgtgggtgtgagtgacgtgtgtgggtgtgagtgacgtctatgggcgtcggctcttatggtgagagtgtgggtgtgaatgacgtctgcaggtgtcaccaattatggtgagagtgtgggtgtgaatgacgtctgcaggtgttacctcttatggtgagagtgtgggtgtgagtgacgtctgcgggcgtcagctcttatggtgagactgtgggtgtgagtgacgtgtgggtgtgagtgacgtctgcaggtgtcaccaattatggtgagagtgtgggtgtgaatgacgtctgcaggtgtcacctcatggtgagtgtgggtgtgagtgacgtctgcaggtttcacctcttatggtgagagtgtgggtgtgagtgacatctgcgggcgtcagctcttatggtgagagtgtgagtgtgattgacgtgtgtgggtgtgactgacttcgggtgtcagctcttatggtgagagtgtgggtgtgagtgacgtctgcatgtgtcagctcttatggtgagagtgtgggtgtgagtgacatgtgtgggtgtgagtgacgtctgcaggtgtcaccaattatggtgagagtgtgggtgtgtgtgacgtctgcatgtgtcacctcttatggtgagtgtgggtgtgagtgacgtctgcaggtttcacctcttatggtgagagtgtgggtgtgagtgacgtctgcgggcgtcagctcttatggctagagtgtgagtgtgagtgacgtgtgtgggtgtgagtgatgtctgcgggcgtcggctcttatggtgagattgtgggtgtgagtgacctctgcgggcgacagctcttatggtgagaatgtgggtgtgagtgacgtctgcaggtgtcacctattatggtgagagtgtggatgtgagtgacgtctgcgggtgtcagctcttacggtgagagtgtgtgtgtgagtgacgtctgcgggtgtcagctcttatggtgagagtatgggtgtgagtgacctctgtgggcctcagctcttatggtgacagtgtgggtgtgagtgatgtctgtgggtgtcagctcctatggtgagaatgtgggtgtgagtgatgtctgtaggtgtcacctcttatagtgagagtgtgggtgtgagtgacgtgtgccggcatcagctcttatggtgagagtgtgggtgtgagtgacgtctgcgagtgtcaggtcttatggtgagagtgtgggtgtgagtgacgtctccaggtgtcacctcttatggtgcgagtgtgggtgtgagtgacgtctgcaggtgtcacctcttatggtgacagtgtgggtgtgagtgacgtctgcatatgtcacctcttatagtgagagtgtgggtgtgagtgacttctgcgggcgacagctcttatggggagagtgtgggtgtgagtcacgtctgcgggcgacagctcttatggtgagagtgtgggtgtgagtgacgtctgcaggtgtcacctcttatggtgagactgtgggtgtgagtgatgtctgcaggtgtcacttcttatggtgagagtgtgggtgtgagtgacatttgcaggtgtcacttcttatggtgagagtgtgggtgtgagtgacgtctgcaggtgtcagctcttatggtgagagtgtgggtgtgagtgacgtctgcaggtgtcacctcttatggtgagactgtgggtgtgagtgatgtctgcaggtgtcacttcttatggtgagagtgtgggtgtgagtgacgtttgcaggtgtcacttcttatggtgagagtgtgggcgtgagtgacgtttgcatgtgtcacctcttatggtgagaagtgtgtacgtgagtgacgtctgcaggcatcagcttttatggtgagagtatgggtgtgagtgtcctctgtgggcctcagctcttatcgtgagagtgtgggtgtaagtgacatctgcaggtgtcaactcttatggtgagagtgtgggtgtgagtgacgtctgcaggcatcagctcttatggtgacagcgtgggtgtgagtgacatctgcatgtgtcacctcttatggttgagagtgtgggtgtgagtgacgtatgcaggtgtcagctcttatggtgagagtatgggtgtgagtgacatctgcaggtgtcacctcttatggtgcgagtgtgggtgtgagtgacgtctgcaggtgtcacctcttatggtgacagtgtgggtgtgagtgacgtctgcatatgtcacctcttatagtgagagtgtgggtgtgagtgacttctgcgggcgacagctcttatggggagagtgtgggtgtgagtcacgtctgcgggcgacagctcttatggtgagagtgtgggtgtgagtgacgtctgcaggtgtcacctcttatggtgagactgtgggtgtgagtgatgtctgcaggtgtcagttcttatggtgagagtgtgggtgtgagtgacatttgcaggtgtcacttcttatggtgagagtgtgggtgtgagtgacgtctgcaggtgtcagctcttatggtgagagtgtgggtgtgagtgacgtctgcaggtgtcacctcttatggtgagactgtgggtgtgagtgatgtctgcaggtgtcacttcttatggtgagagtgtgggtgtgagtgacgtttgcaggtgtcacttcttatggtgagaatgtgggtgtgagtgacgtttgcatgtgtcacctcttatggtgagaactgtgtacgtgagtgacgtctgcaggcatcagcttttatggtgagagtatgggtgtgagtgtcctctgtgggcctcagctcttatggtgagagtgtgggtgtgagtgacgtctgcaggtgtcacctcttatggtgagagtgtgggtgtgagtgacgtctgcaggcatcagctcttatggtgacagtgtgggtgtgagtgacatctgcatgtgtcacctcttatggtcagagtgtgggtgtgagtgtcctctgtgggcctcagctcttatggtgagagtgtgggtgtgagtgacgtctgcaggtgtcacctcttatggtgagagtgtggatgtgagtgacgtctgcgggtgtcagctcttatggtgacagtgtgggtgtgagtgacgtcagcaggtgtcagcgcttatggtgagagtgtgggtgtgagtgacgcctccggacgacagctattatggtgagagtgtgggtgtgagtgacgtctgcaggtgtcacctcttatggtgagagtgtgggtgtgagtaacgtctgcgggcgtcagctctatggtgagagtgtgggtgtgagtgatgtctgcgggcatcacctcttatggtgagagtgtgggtgtgacgtctgcaggtgtcacctcttatggtgagagtgtgggtgtgagtgacgtctgcaggtgtcaccaattatggtgagagtgtgggtgtgagtgacgtctgcgggcgtcagctcttatggtgagagtgtgggtgtgagtgacctctgcgggcgagactcattatggtgagagtgtgggtgtgagtgacgtctgcaggtgtcacactcttatggtgagagtgtgagtgtgagtgacgtgtgtgggtgtgagtgacgtctatgggcgtcacctcttatggtgagagtgtgggtgtgagtgacgtttgcaggtgtcacctcttatggtgagagtgtggttgtgagtgacgtctgcgggcgtcagctcttatggtgagagtgtgggtgtgagtgacgtctgcaggtgtcaccaattatggtgagagtgtgggtgtgaatgacgtctgcaggtgtctcctcttatggtgagagtgtgggtgtgagtgacgtctgcaggtgtcaccaattatggtgagagtgtgggtgtgaatgacgtctgcaggtgtcacctcttatggtgagagtgtgggtgcgagtgacgtctgcaggtgtcacctcttatggtgagagtgtgggtttgagtgacgtctgtgggtgtcacctcttatggtgagagtgtgggtgtgagggacgtctgcaggtgttacctcttatggtgagagtgtgggtgtgagggacgtctgcaggtgtcacctcttagggtgacagtgtgggtgtgaatgatgtctgtgcgtgacagctcttatggtgagagtgtgagtttgagtgacgtctgcaggtgtcagctcttatggtgagaatgtgggtgttagtgacgtctgcaagtgtcacctcttatggtgagagtgtcggtgtgagtgacgtctgcaggtgtcacctcttatggtgagagtatggctgtaagtgacctctgtgggcctcagctcttatggtgagagtgtgggtgtgagtgacgtctgcgggtgtcagctcttatggtgacagtgtgggtgtgagtgatgtctgtgggtgacagctcttatggtgagagtgtgggtgtgagtgacgtctgcgggcatcagctcttatggtgagagtgtgagtgtgagtgacgagtgtgggtgtgagtgacgtctgcgggcgtcggatcttatggtgagagtgtgggtgtgagtgacctgtgcgggcgacagctcttatggtgagagtgtgggtgagtgacgtctgcaggtgtcacttcttatggtgagagtgtggatgtgagtgacgtctgcaggtgtcacctcttatggtgagactgtgggtgtgagtgacgtctgcgggcgtcagctcttttggtgagagtgtgggtgtgagtgacgtctgcgggcgtcagctcttatggtgagagtgtgggtgtgagtgacgtgtgggtgtgagtgacgtctgcatgtgtcaccaattatggtgagagtgtgggtgtgaatgacgtctgcaggtgtcaactcttatggtgagtgtgggtgtgagtgacgtcggcaggtttcacctcttatggtgagagtgtgggtgtgagtgacatctgcgggcgtcagctcttatggtgagagtgtgggtgtgagtgacatgtgtgggtgtgagtgacgtctgcaggtgtcaccaattattgtgagagtgtgggtgtgagtgacgtctgcatgtgtcagctcttatggtgagagtgtgggtgtgagtgacgtctgcaggtgtcacctcttatggtgagagtgtgggtgtgagtgacgtctgcgggcgtcagctcttatggctagagtgtgagtgcgagtgacgtgtgtgggtgtgagtgatgtctgcgggcgtcggctcttatggtgagattgtgggtgtgagtgacctctgcgggcgacagctcttatggtgagaatgtgggtgtgagtgacgtctgcacgtgtcacctcttatggtgagactgtgggtgtgagtgatgtctgcagttgtcacttcttatggtgagagtgtgggtgtgagtgacatttgcaggtgtcacttcttatggtgagagtgtgggtgtgagtgacgtctgcaggtgtcacctcttatggtgagactgtgggtgtgagtgatgtctgcaggtgtcacttcttatggtgatagtgtgggtgtgagtgacatttgcaggtgtcacttatggtgagagtgtgggtgtgagtgacgtctgcaggtgtcagctcttatggtgagagtgtgggtgtgagtgacgtctgcaggtgtcacctcttatggtgagactgtgggtgtgagtgatgtctgcaggtttcacttcttatggtgagagtgtgggtgtgagtgacgtttgcaggtgtcacttcttatggtgagagtgtgggtgtgagtgacgtttgcatgtgtcacctcttatggtgagaagtgtgtacgtgagtgacgtctgcaggcatcagcttttatggtgagagtatgggtgtgagtgtcctctgtgggcctcagctcttatggtgagagtgtgggtgtgagtgacatctgcaggtgtcaactcttatggtgagagtgtgggtgtgagtgacgtctgcaggcatcagctcttatggtgacagcgtgggtgtgagtgacatctgcatgtgtcacctcttatggttgagagtgtgggtgtgagtgacgtctgcaggtgtcagctcttatggtgagagtatgggtgtgagtgatatctgcaggtgtcacctcttatggtgagagtatgggtgtgagtgtcctctgtgggcctcagctcttatggtgacagtgtgggtgtgagtgacgtctgcaggtgtcacctcttatggtgagagtgtgggtgtgagtgacgtctgcaggcatcagctcttatggtgacagtgtgggtgtgagtgacatctgcatgtgtcacctcttatggtcagagtgtgggtgtgagtgtcctctgtgggcctcagctcttatggtgagagtgtgggtgtgagtgacgtctgcaggtgtcacctcttatggtgagagtgtggatgtgagtgacgtctgcgggtgtcagctcttatggtgacagtgtgggtgtgagtgacgtcagcaggtgtcagcgcttatggtgagagtgtgggtgtgagtgacgcctccggacgacagcgcttatggtgagagtgtgggtgtgagtgacgcctccggacgacagctattatggtgagagtgtgggtgtgagtgacgtctgcaggtgtcacctcttatggtgagagtgtgggtgtgagtaacgtctgcgggcgtcagctctatggtgagagtgtgggtgtgagtgatgtctgcgggcgtcacctcttatggtgagagtgtgggtgtgacgtctgcaggtgtcacctcttatggtgagagtgtgggtgtgagtgacgtctgcaggtgtcaccaattatggtgagagtgtgggtgtgagtgacgtctgcgggcgtcggctcttatggtgagagtgtgggtgtgagtgacctctgtgggcgagagctcttatggtgagagtgtgggtgtgagtgacgtctgcaggtgtcacctcttatggtgagagtgtgggtgtgagtgacgtgtgtgggtgtgagtgacgtctatgggcgtcacctcttatggtgagagtgtgggtgtgagtgacgtctgcaggtttcacctcttatggtgagagtgtgggtgtgagtgacatctgcgggcgtcagctcttatggtgagagtgtgggtgtgagtgacgtgtgggtgtgagtgacgtctgcaggtgtcagctcttatggtgagagtgtgggtgtgagtgacgtctgcatgtgtcagctcttatggtgagagtgtgggtgtgagtgacatgtgtgggtgtgagttccgtctgcaggtgtcaccaattatggtgagagtgtgggtgtgtgtgacgtctgcatgtgtcacctcttatggtgagagtgtgggtgtgagtgacgtctgcaggtgtcacctcttatggtgagagtgtgggtgtgagtgacgtctgcgggcgtcagctcttatggctagagtgtgagtgtgagtgacgcgtgtgtgtgtgagtgatgtctgcgggtgtcggctcttatggtgagattgtgggtgtgagtgacctctgcgggcgacagctcttatggtgagagtgtgggtgtgagtgacgtctgcgggtgtcagctcttatggtgagagtgtgggtgtgagtgacgtctgcgggtgtcagctctatggtgagagtgtgggtgtgagtgacctctgtgggcctcagctcttatggtgagagtgtgtgtgtgagtgatgtctgcgggtgtcagctcttatggtgagagtatgtgtgtgagtgacctctgtgggcctcagctcttatggtgacagtgtgggtgtgagtgatgtctgtgggtgtcagctcttatggtgagaatgtgggtgtgagtgatgtctgtaggtgtcacctcttatagtgagagtgtgggtgtgtgtgacgtgtgccggcatcagctcttatggtgagagtgtgggtgtgagtgacgtctgcgagtgtcaggtcttatggtgagagtgtgggtgtgagtgacgtctccaggtgtcacctcttatggagagagtgtgggtgtgagagacgtctgcaggtgtcacctcttatggtgacagtgtgggtgtgagtgacgtctgcaggtgtcacctcttatggtgcgagtgtgggtgtgagtgacgtctgcaggtgtcacctcttatggtgacagtgtgggtgtgagtgacgtctgcagatgtcacctcttatggtgagagtgtgggtgtgagtgactcctgcgggcgacagctcttttggggagagtgtgggtgtgagtcacgtctgcgggcgacagctcttatggtgagagtgtgggtttgagtgacgtctgcaggtgtcacctcttatggtgagactgtgggtgtgagtgatgtctgcaggtgtcacttcttatggtgagagcgtgggtgtgagtgacatttgcaggtgtcacttcttatggtgagagtgtgggtgtgagtgacgtctgcaggtttcagctcttatggtgagagtgtgggtgtgagtgacgtctgcaggtgtcacctcttatggtgagactgtgggtgtgagtgatgtctgcaggtgtcacttcttatggtgagagtgtgggtgtgagtgacgtttgcaggtgtcacttcttatggtgagagtgtgggtgtgagtgacgtttgcatgtgtcacctcttatggtgagaagtgtgtacgtgagtgacgtctgcaggcatcagctcttatggtgagagtatgggtgtgagtgtcctctgtgggcctcagctcttatggtgagagtgtgggtgtaagtgacatctgcaggtgtcaactcttatggttagagtgtgggtgtgagtgatgtctgcaggcatcagctcttatggtgacagtgtgggtgtgagtgacatctgcaggtgtcacttcttatggtgagagtgtgggtgtgagtgacgtctgcaggtgtcacctcttatggtgagagtatggatgtgagtgacctctttgtgcctcagctcttatggtgagagtgtgggtgtgagtgccgtctgtagatgtcacctcttatggtgagagtgtgggtgtgagtgacgtctgcaggtgtcagctcttatgttgagagtatgggtgtgagtgacatctgcaggtgtcacctcttatggtgagagtgtgggtgtgagtgtcctctgtgggcctcagctcttatggtgagagtgtgggtgtgagtgacgtctgcagatgtcacctcttatcgtgagagtgtgggtgtcagtgacgtctgcgggtgtcagctcttatggacagagtgtggatgtgagtgatgtctgcaggtgtcacatcttatggtgagagtgtggatgtgagtgacatctgcaggtgtcggctcttatggtgggagtatgggtgtgagtgacctctgtgggcctcagctcttatggtgagagtgtgggtgtgagtgtcgtctgcagatgtcacctcttatcgttagagtgtgggtgtcagtgacgtttgcggttgtcagctcttatggagagagtgtggatgtgagtgacgtcttcagttgtcagctcttatcgtgggagtgtgagtgtgagtgacatctgcgggcgtcagctcttatggtgagagtgtgggtgtgagtgacgtctgcgggtgtcagctcttatggtgagaatctggttgttagtgtcgtctgcgggtgtcacctcttagggtgacagtgtgggtgtgagtgatgtctgtgcgtgacagctcttatggtgagagtgtgagtttgagtgacgtctgcaggtgtcagctcttatggtgagaatgtgggtgttagtgacgtctgcaagtgtcacctcttatggtgagagtgtcggcgtgagtgacgtctgcaggtgtcacctcttatggtgagagtatggctgtaagtgacctctgtggtcctcagctcttatggtgagagtgtgggtgtgagtgacgtctgcgggtgtcagctcttatggtgacagtgtgggtgtgagtgatgtctgtgggtgacagctcgtatggtgagagtgtgggtgtgagtgacgtctgcgggtgtcagctcttatggtgagagtatgggtgtgagtgacctctgtgggcctcagctcttatggtgagagtgtgggtgtgagtgacttctgcgggtgtcagctcttatggtgagagtatgggtgtgagtgacctctgtgggcctcagctcttatggtgagagtgtgggtgtgagtgacgtctgcgggtgtcagctcttatggtgagagtgtgggtgtgagtgacgtctgcgggcgtcagctcttatggtgagagtgtgggtgtgagtgacgtctgcgtgtgacagctcttctggtgagagtgtgggtgtgagtgacgtctgcgggcgtcagctcttatggtgagagtgtgggtgtgagtgacgtctgcgggcatcagctcttatggtgagagtgtgggtgtgagtgacgtctgcaggtgtcacctcttatggtgagagtgtggatgtgagtgacgtctgcgggtgtcagctcttatggtgagagtgtgggtgtgagtgtcgtctgcgtgtgacagctcttatcgtgagagtgtgggtgtgagtgacgtctgcaggtgtcagctcttatggtgagagtttgggtgtgaatgacgtctgcgggcatcagctcttatggtgagaatgtggatgtgagtgacgtctgcgggtgtcagctcttatggtgagagtgtgggtgtgagtgacgtctgcgggtgtcagctcttatggtgagagtgtgggtgtgagtgacgtctgcacgtgtcggctcttatggtgagagtatggatgtgagtgacctctttgtgcctcagctcttattgtgagagtgtgggtgtgagtgacgtctgcagatgtcacctcttatggtgagagtgtgggtgtgagtgacgtctgcagatgtcacctcttagggtgagagtgtgggtgtgagtgacgtctgcgggtgtcagctcttatggtgagagtgtgggtgtgagtgacgtctgcagatgtcacctcttagggtgagagtgtgggtgtgagtgacgtctgcgggtgtcagctcttatggtgagagtgttggtgtgagtgacgtctgcaggtgtcagctcttatggtgagagtgtgggtgtgagtgacgtctgcagatgtcacctcagggtgagagtgtgggtgtgagtgacgtctgcgggtgtcagctcttatggtgagagtgtgggtgtgagtgacgtctgcgggtgtcagctcttatggtgagagtgtgggtgtgagtgacgtctgcaggtgtcagctcttatggtgagagtgtgggtgtgagtgacgtctgcgggtgtcacctcttagggtgagagtgtgggtgtgagtgacgtctgcgggtgtcagctcttatggtgagagtgtgggtgtgagtgacgtctgcaggtgtcagctcttatggtgagagtgtgggtgtgagtgacgtctgcagatgtcacctcttatggtgagagtgtgggtgtgagtgtcgtctgcgggcgtgagctcttatggtgagagtcgccatacaagacctgaggattttgtgagttggttgcagaataggacactctgccagtcactccatgtagctatggtgaccgcattttctcagtcagacgctggcatctacagtctaaagtgaaagtgagtctccgtagaggacacagcctcgagcggtgaagtgggaccatgtggacagatcttgggttgcgactcccaggccaactctgagcaagttccttaacctccctgtgccttaatttccacatggcgtcaatgggataataatacgcagtgtcttagtccatgaaggctgctcaaagtaccacctattgcggggcttagaaacagcagacattgatttctcagttctgaaggctggaagccaaggtcaccgccctggcagggttgacgtctggtgtctggcgagtcccctcctggctcatcgacggtgcctcctcacgtgtcctcatgtggctggagcgtgagccgtccttggggcctgtgtaaggaaggccccacctcctcgcctctcagccgtccgcctgctaacagcagcacccggggctggtttcggcacacagcctgttgcatggaggaggagcctcatgggcttggggtgggggtttaaggcatccttaaaggtaaaaggctgggaagtgctgggcgcgctggtgctccgtgagggaggcatgactggctgtgttcttggcactgtcttcactgtcctcccctcctagcctgctcctcacctcccagaagggcctcccacccgccacgcttccccctgccccgcctggccggtgtctgctgggctcctcagtactgccggctcacaccctcaagctgtggcttctgtcgtgcgcctccctcggtgcagtgggctgtgcgccgctggatttgccatcccaggcctcactgggatccctgggtggcgggaggaatggaggccccactcatagtgacttgcagatgtcactcacacccacaatctcatcataagacctgatgcttgcagacatcactcacactcacaagggaagctggcctctcctggatttaccgtcccaggcctcactgggatccctgggtggcgagaggaacagaggtcccgcttgtcgctcagggaagctgggatctcctggatttactgtcccaggcctccctgggatccctgggtggcgggggggggggaatggaggccccgctcctagtgacttgcagatgtcactgacacccacactctcaccataagacctgacacctgcagacgtcactcacactcacaagggaagctggcctctcctggatataccatcccaggcctcactgggatctgggtggtgggaggaatgggggccctgctcctcacacaagggaagctggcctctccggacagtgaggctcccgctgtgggtgcaggtgctgcccggacgtggggctcctccccagtcagagcctcacgctgctctgcagatgcataggctgtgctggccgctcccaggcactgtcactctgtcccctgccttctgctgcctgtcagtggctgctctgaactgtaacgaaatccttgaaaataaaggaatttccagcgatatagggtctcggcttatcttcaggtttcattacgaactaagctgctcagacttcacagcagtcctgccttggacgcagcccacggatccaacggctccttaaatctgacctgggtgtgtggtgagccagtgcctgcttccttgggcctcagaagccattgctgtctctcaggattcacctttggcctcctggaatttttgcagcagttatgactggatgccatgacagcagtttctactccctgagaatgggagcacttttacagcttccttgcagaatgggagcacttttacagcttccttgcagaaatgtgcatggcaggtgcttgatcagttcagataaagggctttttctccctctggagaattcctttcaacagggcagtgattctgagctgtaattacttttccctcctccaaaaatagctggggagatttttttcttgttgctgcacccctggggaccctgatggagcagtgggctcctccgtctgtggtgctgctttgagaagccccatgggaccgagggaaccctggcaacgctgccagctccctgcagggaggggacttcagaggcagctccagtgtcccagggcaccgggatttacagattgaaggtactttggcaaggcagcctccaccaggagggggcagtgggagagaggcagggtcctgagggaccccagcaggggaggcaggaaagaatgaaagggtgacctagcctggtacagcaggacacctggagcatggcggtcccaggctggtgagggctccttctgctattctgagtgtgagtagtgagtgtgtacatgagaacatgtacatgtgtgagcatgtgagaacagatagtgtgtacatgtgcatgtgtgtgagaatgttcatgtgtgtgagaacttgtgcatgtgagaatgtatgtgtgagaacgtgtacatgtgtgagcaggtgtgtgcatgtgagaatgtgtgtgagaacgtgtacatgtgtgagcatgtgtgagcatgtgtgtgcatgtgataatgtgtgtgtgacaatgtgtacatgtgtgagcatgtgtgagcacgtgtgtgcatgtgagaatgtgtatgtgtgagaatgtgtacatgtgtgagcatgtgtgagcacgtgtgtgcatgtgagaatgtgtgcatgtatgtggatatgagaatgtttacgtgtgtgtttgagaatgtgtgcatgtgtgagaatgtgagcatgtgtgtgtgcatgtgagaatgtgtgcacgtgtgtggatatgagtgtgtatgtgtgtgcttgtgtgagaatgtgcatgggtgagaatgagtgcatgtgagaatgtgtgcatgtatgtgcagatgagaatgtgtacatgtgcatgtgtgagaatgtgtatatatgtgagaatgcatgtgtgtgcatctgagaatgtgtatgtgcatgtgaatgtgtgcgtgtgtgcatgtgtgaaaatgtgtatgtgtgcatgtgagaacgtgtgagcatgtgcatgtgtgagaatgtgtgcatgtgtgagaacgtgtgcatgcgagaatgagcatgtgtgtgagaatgcatgtgagagcatgtgtgaggatgtgtgcatgtgtgagaatgtgcatgtgtgtgcatgtgagtgtgtgagcatgtgtgaaacgtgcatgtgagaatgtgcatgtgtgtgagaatgtatgcatgtgagagcatgtgtgaggatgtgtgcatgtgtgagactgtgcatgtgtgtgcatgtgagagtgtgagcatgtgtgaaaacgtgtgcatgtgagaatgtgcatgtgtgtgagaacgtgtgcctgtgagagcatgtgtgaggacgtgtatgtgagaatgtgcatgcattatgtggttgtgtgtctgcatatgtgcatgtgtctgcatacattgtgtgtgcatgctgtgaatgtctgtgtatgtggttgcttgtgtattgtgcacacgtgtacaagtgtgcattaattctcctgctgtactgggcagcagtgtctcgtctcctggcccctcacactggccgactgagtctgccactggcatcttcaggcctgagccagagcagggctcctgagcgatgtctcggatgaagaactggcactgcagggaggcagccacgaggggtcactggtgctgcttggtgctcactggccacctgggtgaccgcagcctctgggccttgccttgtttggatgcagggagggagtgagtgacagaccagcttgaagaagcacagcagggtgccattgtttcatgagaggcggctgtgctccctccctggctgccagactcaagacctgcggcgggtatggcctgtggggccctggatgtggtcccattctctctggaaagtgcgccctgagccctgcaacgttgctgtttctaggctctgggttcagtgcctgggacacccccaggaggccgcgttcccctcctgggcttcccaggtgtgttcccagggagctgctgtgagactgactgcccgttccttttgtctgggcagggtcagctggcagccgcaagagcggatgcatttggtgtttactgtagacagtattctgcaaacctgagtgtctgtctcagcgatggctttgtgacgattctagaaatggtcgcagtccctgcccagccctggaacgtgctagtgcttgctccgccggggttctgcctgcccggtggtttgccgggtgtctctcgcctgcccttcttgtcggaatacagcctcccacgcctctcatctgcaaaggcttcgtaattggggtgccttttctgcccatcccttcttgctcacaattcaagaactttgttctgatagtttccaggcagctgagataaatcagttttcacgtgcataccatttaccttaatatgctgtttacacaaatgattgaataggtatgcgcattgtggttatttcaaacaatgccctaagctaattgcctcactttgaaatactaaattaagtgatcatattgtattcattaattcccaagtcctgttatatttccataaataaataagaaatgttaaaaaaaaaaagacatataagtaaaagtaggtaaagatattagaaaaaggggaaaagcagatggttagttcactggaatctgtgccacaggcgcctgtaagcaggaggtgtccctgcccaggagctggtcgtgttcacggcgtttggtggaaggaagatgctcctggctgggggaccccctgtggatctctgtggagattgtggggcctgggggacccccttggatctctgtggagaattgtggggactggaggaccccctgtggatctctggggagaattgtggggcctgggggaccccctgtggatctctgtggataattgtggggactgggggaccccctgtggatctctgtggagaattgtggggtaacgcagtgagtgacgtttctcagcagatgcacagttagcgtctctgggccatttctcctaggatatcctctagggcaggcctggacgtgtcactcgggatgtcgtttagtgcaggcctgggcgtatcacctaagcaaagtgtggcaagagtactttcctcacagggtatcaaagccaccttgttcggtccacagctttccggtgctccaattggatggttctgggtcagtgctatgggtgtcacagagagtggaggctcagtatctccaagcaacaggaccctctgggggcaccctgggcagcagagccccacccttactctgaagaacagaggtccactaggatcacctgcttcacttatggagctggggatagaaatgctgggggtcaatcggccctctgagcccaagcagagagacagtacgggatggggtggaggcgcatggccacctgagaacttgcgagactcatgccagcccctcctagggtgcccccaccaccagcctttttggtccccagtgagtctttcatccaagtgggtcactgccaggggtgaggacttgtaaatctatgtgagatttcaacaaatgaggcttctagctgatggtcttaaacacttccacggacatctccattttcttttagacaaatgggaaaataccagttatagtcattcactaacatccttttagtccacaccgggggcaaggcactgtaccagatgctgtgggggcgtgaagaggctgtagctgtgatccctgccttccaggaactcacggtgtcaccggggagagggtggtcctgcagggcggtagaggcgaggtgccgtcttgtctatgcggagactgtgtgtgagcgtacgcgtgtgggcgtgtgagtttgtgcatgtgcgcttgtgtgcacctgtatatgagttagtgtgtctgggtgtgtgtgtgtgtgtgtgcacgtttgcaaatgtgtgtgtacgtgctcctgtgtgtgtgtctgcataatcaagtgcatgcaaatgagtgtgtgcacacttgtgtgtgtgtacatgtgttggaatgttcacgtgggtgcgtgtgagtgtgtgtatgtgtgagtgtcccgtgcatgggagaagtgtgtgaaaatgtgtgtgttggttcatgcaggtatgaatgtgcatacatgcaccgtgtacacacgtgtggtgtaaggttggagggaggtatgcagccccacagactatatgagaatagaagtgggctggaagcttggtcctggaggaggcctgtgtttgtgttttggggacagtgacgcttgcgaatgaaattactttggcctgtgggaacagtgctctaaggaccactgtttaaaacaaattaccaagataaatgagctctttttcttatttctccaaaaatccaaccacagaaaatgctcaatattttctttcaaatgaaagaaactgaccacccaattctagattactgttaataaaagtgtctctaagcaaaccttttgctcctcaaagcttttgtgtccattgtcctgggccctgttcatccgctgctctgcatcctgggcattccttctctcactgtctttagcactgtccattccggtcccagaggcagtggggtccagccttctgtctgcacagtgaaggggttgcgtcctagaactctgaaatgtggggccccctggttcactgagtccctgagattggagttctgtggggtccagccttctgtctgcacagtgaagggggttgcatcccagaactctgggggtgtgaggccccccagttcgttgagtccctgatatcggagttccaggccaggcagaattcttgtcgggggacgccttccatgtctcgcctctcccagccagggcagcaagaagcctgccttccttcctgttttggaaaaagactcattctacagaacgtctcccagaatattcccctcccccacaagcctgtctgtgcatgggctgggtagcatgtggaaaggcctggttgctgctgccggcagagggatgtgtgttgtcctaaggttcaccttgcagatggctccagtctatccaggtctctggtctccatgaccaccatcctcacttagccaccatcccctggttggggctgctctgtttacccgccatgggctcctggcaatctccagcccttgccagggagatctgttttaaaacgcagacccattcaagagcctgccctgcctggaacaccacccaagtggaggtggcctcctctagctcctgggatgaaggccactgcctctgattcccgcaggctctgcacaatctgcttgagtggcttgaccagcttggtgtcctctcctgcctgatccagaactgcaaggccttgtccccactgcccactggggctgaccagggccaggtgctgccatgcacggagctgctccctccccgttgcccactggggccaggtgctgccatgcacggagctgctccctcctggccgcccactggggccaggtgttgccatgcacggaactgctccctccccgtcgcccaccggggctggatgctgccatgcacggagctgctcccttagcctggagtgtcctcgatgtcctcaggtcggccgctgttcgttctctgaccgctgggtgaggtcagtgccctctgtcaggtgctctcgtgcccttttttgcagcctgtccacaattataaccgaaccatcagtggtgaacatctgttgccccaggatcctggaagctctggagcatggagcctgcagtgtctgctttttctgtgtgcgtgtctcccggctgtcctggcctggccatgcaagcaggatgcagggcagagctgtggcttccctgggacgagggtgtggggcggaggcagccaagcagcaggcatagcactgacctgctcccagaacaggaaggggctttgcaaggctcaggcaatgctggggacagagatgatgagcctcgttgatgagagcacccaacgctgcagggaagacagagggagaaggcacgaagccgtcatcgaggagcacctgggggttaggcttccgcgcagaggcacgggcagtgtctgtttgccggaagggtttatgatgttggattggcggcatccttgggcacgcacagtaagtttggcagttaaacacgttagcggctgtgcttatgtgcgtgtatgagttagcagctgtgcacgtgtttctgtataaggattgacacgtacacatatatttgcacacatgagtgttttgatggtgacagtagccaaggacgggtggacagggagcccacagttttcataggcaaacctgttctcatctcccatgattttcagacagcccccaatttgaactcagttgccagcagtgagacttggaattaaggttgcgcatggaatgcccgttctggacgaagagcaggaccctggttctgaaagtctcgtggatgggctccatcacccaaggcctcctgcctccactgcggtgcggtgatgcacttccagctgggagctcagcatggcccgcagggctgcagagctggacgggtcagtccgggcttcgacgatagggtcatgtcgacaggctgcagggccatggcacaggaaacagagtccgaagtagaagagagttcatgaggaaaccccaagcaagctcagatcccaggtggggtcctggctgtgtcccaagaacacgaaggcaggagtcccgcagaggaggggcctgagggttacgggctctgggtggtttctagggtgattaaatggtcggcggtgaggcgacttcagtgtgccacttcccgggattgtttcagaggccgcactgcacgtctgagacggtggagctcagcctggactggtgggagctttggttctctggctccggcacccctgctgtgtagatcacccctggcgtcccgactccggagtctcatcgcacctgatgctttcctgattgagatttgactttccagtccttttctctagtatgttcatagagaccttttggggtcctgcctattagccaagtgacccggaagaacaaagcaatagtttcaaaattctggccacataaaaatcaattctaccagatgtatttagaaatttccttaattttctatttcactgctaggcacgtatccatatttgggggaatccagtatccccttaaaatcaagcaggtagcagcgaacctgggcatgatctgtgggagcttctgggctccttccttctggtcacaatcatcttcaacaagccttattgctgagtatttactagaataaaggacacccacatcatgaagtcctttaaatacggagataaggatgaatatcattgttgaaaaatgcattggataaaaaatcatgagataccgatacacacctatgacagcagccaaacgctggaacatggacgcctccaagtgtcacccagcgctgccgaggacgtgggaacacggacgccacccggcgctgccgaggacgcgggaacacggacgccacctggcgctgctgaggatgcgggcgatgggggcgccatcacagctgctcggagtgaaaaatggcacggccaccgttaggctgattgtcactgtggtgaggacatgggcgatgggggtgccatcgcagctgctgggagtgaaaaatggcacggccactgttagtctgattgtcaccatggaggacagtttggcggtttcctacaaaactaagcatactcttaccatatgagccagcagtcactcgtgttggtctttacccaaaaaagtggaaaattaatatctgcaaataccctgtgagggaggctgtgtgtgtgtgtgagggaggctgtgtgtgtacgagggaggctgtgtgtgtacgagggaggctgtgtgtgtacaagggaggctgtgtgtgtgagggaggctgtgtgtgtgtgtgagggagactatgtgagtgtgtgtgagggaggctgtgtgtgtgtgtgagggagactgtgagtgtgtgtgagggaggctgtgtgtgtgtatgagggaggctgtgtgagtgtgtgtgagggaggctgtgtgtgtgtgagggaggctgtgtgtgtgtgagggaggctgtgtgtgtgtgtgagggaggctgtgtgtgtgtgagggaggctgtgtgtgtacgagggaggctgtgtacgagggaggctgtgtgtgtgagggaggctgtgtgtgtgtgtgagggagactgagtgtgtgtgagggaggctgtgtgtgtacgagggaggctgtgtacaagggaggctgtgtgtgtgagggaggctgtgtgtgtgagggagactgtgagtgtgtgtgagggaggctgtgtgtatgagggaggctgtgtgagagaggctgtgtgtgtgagggaggctgtgtgtgtgtgtgagggaggctgtgtgtgtgtgagggaggctgtgtgtgtacaagggaggctgtgtgcgtgtgtgagggaggctgtgtgcgtgtgtgagggagaccgtgtgtgtgtgagggaggctgtgtgtgtgagggaggctgtgtgtgtggggggaggctgtgtgagtgtgagggaggctgtgcttgtgtgtgagggaggctgtgtgcgtgtgtgagggaggctgtgtgtgtgtgtgtgtgggaggctgtgtgtgtgtgtgggaggctgtgtgtgtgtgtgcatgtgtgaggatgcatggaaaatatccctactttccactcaagtttgcagtaatctaaactgctctaaaaataaagtctattaacaatgcactggggatggtgtctgtgtccactgcattcagcacagggatagtctaaggcaaagagaatcaatggttagtttatttcaactgtcaagtagctaaaattattagctaaaactgattttaaaagcacaaactatattatgcattatattgtatatattctaaataaatgtttaaaagaaagttttcaagaaagtctaatataattttaaaatatatttatgacattgtatgcaagaaacaaaatttaaagaatgaggctgttatgcttgagaaatgctttgcttggaacgttccaaaattgataggaattgtcctgggccatttttctttatgaaaagctgaatgatttgatgaggttgcctgggaaggggatcctcagctgcatgttgcgaagcgttggctactcacagatgtgcttctcttatatttggcaccaaatcaccaagccctgtgtgcagacacccggagtggccgagtggggcccggaccagccaggctctgccatgccctgagctggccacgcacgtccaccccgggggtgcattttccaatgtgcgcaagaggccggggagctgcaggcagccggcaccgtcactgctctggggccggccgagagcgccttccttctgagggtggggagtgcagctcgcgggctctgcggctgagtggagccctgggcttctgagcctccctggcctcagggatcggaagaggccgccggccctggcctaggattaggtggtcactgacttgggccccgcttgggggtccaggaacctggcttttggttcttcctggcccgtggctcactccctcctctggggccccaggccttggtcctgaggcctaggattgttctgcattgtgagcacgggagctgggccgtctcgacgtgctgcccagttcctgcttgttgcctttctattttcaagatattttcattcgaaaagcagagtaggaacactgggtatgtttgaagtcgctccttattttccctctttgcccctttctccctcctcccccctttcccactcctgcttgcactgaatggtgcgtgtctgaggaaggcaaaggagcgggcacatctgcctgtgttcccgcctgtggtgcggcctgtccatcacggacggtggggggcgccgggctctgcagacgcgtccccgagagccctccgcctttgtgtggcctcgcaggcatctcgggccggctctcggacaggaggcggcgcggccgggctgcacggagggaaacggcgcgggcctggcgtctcctccttgccattgtccgcccgcccgcgcagctgccaggctgcctcccggattccctgggctttgcaaagtcccatagaaacccgcaggacgcttgcaatactcgaggttattttctgctaatcacccggccccgtcgtcgtgagcatatatgcaatatcagaccagcaattaccgtcagcctggccctgggcaaatgtgtttctgctaattacacttgttgcatttgaatggctttcttcagccaagctgcacggcgaaacctagtgaacaataaaagagaccatttccccttccgccccgcccgaagctgcagatggccgccctgtgtggaagcagtagcgcctgaattaaccttttgtgtgcaccaaagaaggtaatttgaatgtttgaaaccccacaggaagcttgtctcaaagtgaacaattcgccgaataaagactaattggggactaaattaattagaaggtgtggttggaaaggatgttgatgagcagagtctgccatttcagacaaatggaatcgagctaaataaattagtccccattagtcccacaccgttcgccagccccgcgcctctcctgcgccgccggaaaggagcccgggaagccgtgcttgcctcccacgcagcccagggagaggcgtctccgccgatccttgtagctcctgcaaagtaatatttatatttcctgggtgttctgtttttcatctggaaaactggcctggaatgttattgactttgtttttttgttgtcactgagttgtcagaggcaagttttacataaaaaatgtgaaattacataaaaggagggctcggggggtatggaggaaagtggagtgacaacattgcagccacactggactttctctccaccttggcatttgtgttttccgtgatgctcggtttttatctcacaaaccagcatcctccgggtgctcccgggtcctaacagccctctggtgacgccgtgctccaaaacctcacggcggcacatgatcagaacgcattgcaaggacgtgtgtgacaccttcctgctctctgaaaatgaaacgtctcgttctgtcttatctccttcccttctcacagatggagtgtttggaaggtgccagaaggttccggcaatggacttttaccgctacgaggtgtcgcccgtggccctgcagcgcctgcgcgtggcgttgcagaagctttccggcacaggtagggcgggcgtgggccgaggctcggcggctgccgcactgagcgaccgcacgggcttggcttctcctcctgggcggtgaggagctgggacggactgaatccacgagtgtggtggtggaaggggcaggtgggagccgggcgctgggctcatgggtgcttcctactgggatcgtccgttcctgggtttggaggagcccaggcctgctgcctcctgtgtctgagggaggagatgccaggaggctgcagtggcccgcagctgggcctggcacaaagtaggcaggcgtcggctgcttatctgggcctggctgggtccagtgcaggcgtggctcggcctggagagaatcagcctctgcctgtcactgttgtgaaatttttgttgcaggtggtccctgcaggggtgatgagaagataatttttaaaattatgataatttaaaaattatatatggcaacatggtaggaccagggaattcccacagcaccggcccactgctgcgcttctttgactgtgaagtgagggctcttggtcagaagcagtgctgtgtggacaccatggtgatggataaggcgttctgactccacggagggtagttctggcaggagcactgtgcgtagggaagggaaatccacatctggagtaagcgtctagtccagcaaggaccattccccaccccttccacaggggaagctgcctgcggaaccacctgccccccggcggctggctgatcacctcggggaatgatgtcatgttggggactcagggatggtctttgtggtggctgactggggactcaagggtggccacagcagggctggccttgttgagtgggagcccaggcatcacctccaactctgccaccgcgaccaccttgttcatgggcccatggggcaacggcagggtggctggggaaagaggctgactggtgtccacagaacaggtcaccctatccacttggttattaaaatcctcctctgctgaggtcactctttggagaacattcacacgggacattcatatcttagtacttcataccacttcatagacgtctatctaatatgtctcttccccagttgcccttgtcaacaatgtttccaaccatattctctccgagtccctggccctccagccaaaccactggccacagcccattaattcataagtaatcacacatctggccgtttctccttccaggcggaatcaccagccaggtgcactgctggagattctgctcacaggagggtttccaatcacctctgttcttcaggggtcccgggttcacctctgtccttcaggggtcccgggttcacctctgtccttgagggcgtcccgggttcacctctatccttcagggagtcctgggttcacctctgtccttcatggggtcctgggttcacctctgtccttgagggcgtcctgggttcacctctgtccttcaaggggtcccgggttcacctctgtccttgagggcgtcccgggttcacctctgtccttcagggggtcccgggttcacctctgtccttcagggggtcccgggttcacctctgtccttcagggggtcccgggttcacctctgtcctttagggggtcccgggttcacctctgtccttgagggcgtcccgggttcacctctgtccttcagggggtcccgggttcacctctgtccttcagggggtcccgggttcacctctgtccttcagggggtcccgggttcacctctgtcctttagggggtcccgggttcacctctgtccttgagggcgtcccgggttcacctctgtccttgagggcgtcccgggttcacctctgtccttcagggggtcccgggttcacctctgtccttcagggggtcccgggttcacctctgtcctttagggggtcccgggttcacctctgtccttgagggcgtcccgggttcacctctgtccttaagggggtcccgggttcacctctgtcctacaggggttccgggttcacctctgtccttcagggggtcccagcatgggtggtgtgtagtgctacacgtgtctgcttttgggtggtgcctgtgcattacacagaaccacccacaaacaaagcccaagtcacctgagcccaaagtccatggggaaccctccacaaagccaaactgcgggttgagagaaacgcgtgtggcggtgtgggccagggcgccgggcagctccctgatgcacactccaggccacactggactcctgagccctttccccacgggagcctccagggcggcttgggcccagctcctgctccatatgtgccactgtcgtttggcgatggggtgctgtgcgcaggccagtgccaggcttggcagggcacgtagatatgggtatcaatgtagatgacacagacggaatgctgcccacgcagggacaaacatggagcgagccatattgaaggaaggttgtgtaaatattcaactgtgtcacattttctgagtttgcttgtcttgtgagccttactctgtgtttcacccttcactttattatcttgagaagagggaaaagcctcatttaaggagcaaacagatgagcttttgccactctgatggctggacgtgcgagtggaggccaggggtctttcaatgagaatgggcgtgactctttcagaacttcccctgagcgtaatttcagcccggctctaggtatgtatgtagctatcaccatgtgctggcaactggcactgaacatcatcacgtttctgtgctatcctgtgctgagatgtggcgggggcagggtgccggagttcacctgagctcccttgtcatgggagctagtgccacaagggctccggggccctgcctgggtgggcgtcctgggatgaaatgaaaccagagaatgcacaagactctcagcctgacaaactagaaaaaaaccaagaaatttaaggtgagtttcaaaaggagggatagaaaaatatctagtggccccgaattccccaacagagatgagttttctcacctatgattttaaagcaatagctttttctagtttgtctcatatatccatgaatttaaattacatgacaataatctaaccaaataatggcaaaaggtaactcctaaggaaaaccatctcagagaaaattaatattgtgccgagtgtcaggctatgtccacattcctggcacctgttcttgaggataagagcatctttatggagacggagtcccaggcagccccacatggggataggggggtcccaggcagccccatgtggagatggggggtcgtaggtatccttgcatagagacagaggtcccaggcagccctgcatctccagtcttgctcaggccctggctgagcgtctgcccaggtgtatcagaactgcccatggcctgggcagctggagccctctgcccagctccatccccagggactgtgtgtcctgggctgttggactctctagacagtgaaaagtcatcttctgcattgtggggacacagaattgctgacaccttcccagctggttctgacacagctgtggggtgtgtcctggggtgggcatttccagcaaaccctggggatgaccccgtggcaggaggacgaccctgtggcaggaggcctctttggttgccagggccattggtgtgtctagtccaggatgcaggcttctggaaggtgggcatgctgcgaaggcacacgtacctgcacatgcattcacatgctcacgtgtagacacagacacatttgcacacacacttgcacactcatacacatgctcacatgtagatacccacacgcagacaaacctgcacacacattcacgtgctcatgtgtagatacccacacacgcacacacctgcacactcacctgcacacacacatgctcacatgtagacatgcacacacgcacacacccctgcacactcattgacatgctgacatgtagacatccccacacatgcatgcacacctgcacacacacatgctcatgtgtagacatccacacacatgcacacacacccatgctcacgtgtaggggatatctacacgtgagcacgtgaatgagtgtgcaggtgtgtgtgcgtgtgtgggtatctacacatgagcacgtgaatgagtgtgcaggtgtgtgtgtgtgggtatctatatgtgagcacgtgaatgagtgtgcaggtgtgcatgcatgtgtgcaggcaggcacacatgcatgcacacttgaaggaaagaatctcaaatcctggtgtcttcctgagttttgtcagcctcacatggggggagtgtttgagtagggaggttttgcgtgtgggtgtctacactggagcacatgtgtgtgcaggtgtctgtgcgtgtgtgtgggtgtctacacgtgagcacgtgtgtgtacatgtgtgggtatccacgtgagcatgtgaatgagtgcgcaggggtgtgtgcatgtgtgtgtatgtctacatgtgagcatgtgagtgcatgtacaggtatgtgtgcatgtgtgcatgtgtgtgtgtctacacctgagcacgtgagtgcatgtgcagatgtgtgtgggtgtctgtgtgagcacatgtgtgtgcatgtgtgcgtgtctacatgtgagcacgtgagtgcgtgtgcaggtgtgtgtgcatgtgtgtgggtgtctgtgagcacgtgtgtgtgcatgtgagtgtctacacatgagcatgtgagtgcatgtgcaggtgtgtgtgcatgtgtggctgtctacacgtgagcacgtgtgtttgccttgtgtgggcgtctacatgtgagcatgtgaatgagtgcacgtgtgtgtgtctacatgtgagcacgtgtgtgcatgtgtgtgtctctacacgtgagcatgtgaatgtgcaggtgtgtgtgcatgtgtgtgggtgtctacatgtgagcacgtgagtgcatgtacaggtatgtgggtgtctacacgtgagcacatgtgtgtgcaggtgtgtgcgtgtgtgggtgtctacacgtgcaggtgtgtgggtgtctacacatgagcatgtgagtgtgtgtgcaggtgtgtgtgcatgtgtgtgggtgtctacacgtgagcatgttcatatgcaggtttttcaggattccagaaatgattctgtcttggtaactgcgcttgaaacagagttgatcctgtgcttctgcctgtcgtcttcatccaggccacttcttgcaggtgcagttgtcagattcattgacagacagctgcttgcgcggccttcagagtcttctgcacgaagaggagggtaaatgggagttaatttcacaaccttcttcctccaggtagatgtgtacatcacagaacaaaatacgttcactgtgtttttaccattcttgtctactacaggcagcattatttcatgggcagacacactgctctctcatgtatgatttttttttaaatacatttcactttttctgacaagccattaaaattcagcatttaaatgtcactcgttggcatgcaatttgctgtcatgaaaacgactgtggattcatttcctggtaagaatcttctgacttattgagctgcatgtcagaagcaaaaagcaaaaaaaccaaatatgtacataaaacagtgttatcattccttaaaagagaaggaaaataaatccctaaataatgtggactggaacacagaaatccaaggctggccgcacgggtcctggctgggatggcatccggggagctgctgctggggacgtgcttgccggcacaggtcaggggagccgggttctgcctcctccttgcccactctatttgcgccctccctgtgctcgcctgtcttgttttacctcccatcctgggcccttggagcttggaggctttccttcttgctgagaggagctgagatccaccccctacccgacctccaggcagatgtgtggtgtggggttggggagggagaacgtctggctcacgtctggtgagcacaggtgggtgtgttggagtcacgcgtggtgctcaccctccgtgtgactcgcgctctgtcaggctcagggctcgccctccgtgggatttgcgctctgtccggctcagggctcgccctccgtgggacttgcgctctgtccggctcagggctcgccctccgtgggacttgcgctctgtccggctcagggcttgccctccgtgggacttgcgctctgtccggctcagggctcgccctccgtgggacttgcgctctgtccggctcagggctcgccctccgtgggatttgcgctctgtctggctcaggctgcgcagggcaatggaggaacctcccgagcaggcccagtggctccttccacccagcccccatctccggccggccatttgtgaggccctctgccactgaggtgcactgtttccaattcctcattcacaagctctaccttccacaggagcccagagcatgaacgcattcggccatggtcctcaccactctgcgaggagcacagcctcttctccaccgtccgatagtgtgttcctcctttcccaggcctcacagaatgctctgtctgcatcctcccagcattccattcatgatggccgagctgttctctaagagatactgctttgtcttccttttgatctctcaacacaagcacttttaaaaattcatccatggcgaaggaggcttgttccagcacacacctcaagactcagcctcaacaagtttcccagacccaaagttgcttctgcatttttaggaatttgtcacagccgtgctgctacttcccggtgccaatttttctcttgttcgagttgctgtcacaaaaatcacatggcgtgggtggctgaaacagcaaacattgatttctcagagctctggaggctcccccatatttggtgtctggtggtgggtggcttcctggttcatgggtggcatcttccccccgtgtcctcatgtggcagacggggcaagggagcgctctgggatctctttcgtatggacactaatcccacctgcatgggcgccgtcttcatgacctaattacccccaaagccttcacctcctaatgctgtcacactggggatcagaattccagcacgtacgtttggggaggatgtcaacattcagtctgtatcatagcatgtgtattctatgaccatagtgtatctcattggttagtttttatatttgaactaatcttatattcctgggataagtcttacttgaccatgctgtataattctttttatatgtttctggatttagtatcttagtgtttcgttgagaatttttatgtccgtatttataaaggatatctcttaatcttttgatatctttggttttggtattatagtaatacataacttgtcaaatgcattagtcagggttctctagaaggacagaactaataggatagatgtgtatataaaggggagtattttaaggagtattgactcacgatcacagggtgaggtcccataataggccctgaggagcaaggaagccagtctgagtcctaaagctgaataacttgaggtccgaggttcgaaggcaggaagcatcccgcaggggagtagcgtgtaggctggaagactaaactacttttgtgttcttctgcctgcttttattctggccatgctggaagctgattagatggtgcccacccagactgagggtgggtctgcctctcccagtccactgactcaaatgtgaatctcctttggaaatgccctcacagacacacccaggatcaatactttgcatccttcaatcccatcaggttgacactcaatattaaccatcacatcaagttaattgaagagtattctttctttattttttttggaagactgtgaaagaatgatgttaattcttccttaaacatttgaagtgaagctattgcaaatggaagccatctgaccatgggcttttctttatgaggttttaaattactcattgaatttccttaattattataggcatattcaaattttctatttcttcttgagtcagcttcagtagttcatgtcttcataggaatttgtcaatttcacctagattatctagtttgttggcatatgattacttatagtatttctgtatagtccttgtaatttttatgtctgtaagatcagtaataatgtcttttcattcctgattattttttgagttgctttcttagtgtttgctagaagattaatattatttaattttattaacaccaagttaatattaatttaattattaattcaaattaacattaagatctttataataatctagttgaattaataccaacttaattttcaaacactctctgtcattttttctctttccctcctttgtgctgttattgtcatgaaaattatatctttatagattgtatgtttatcaacatggatttataattattgctttatgcaggttttttaaagaaaattaggagaaaataaatgttacatactcaaatatttgttctgtctttcatatttactaaataatgacctttactggtgctgtttatttcttcatctggatacaactcactgtctaatgtcctttcatttttgcctaaagtactccatttagaacttgctagggaagggttgttggaaaaaattctctttgttttttgtttgggaatgtattgatttctcctttagttttgaaggatcgattttctgaatatagaattcttggttgatagacttttttcttttaggactttgaatatatcattccactgcctcttggccttcatagtctcagatgagaaattagttgttaatattattgaggatcattgcctattttctgttgcttatcacagaatatctgaaactgggtaatttataaagaaaaggaatttatttattacaggtatctgggctgagaagttcaaggttgaggggcagaatcaggtaagggtcttcttgctgttggggactctctgcagagtcctgaggtggcacagggtatcacatgatgaggaggctgagcatgctagtgtgctagctcaggtctcccttcctcttcttagaaagtcaccaggtcccctcttgtgataacccacatgaattaattcattaattcatgagtggattaatccattcatgagggcagagccctcatgacccagtttcctcctccctcctgatactcccaaattagggattaaacttcaacatgagttttggaggggacaaatatctagtccataacatgtgtgacaagttgcttctctcttactgctttcattagatttactttgtctttgggttttgaaggtctgattttgatgtatctaggtgtggctgtcttagagtttattctacttggagttcattgagtgtcttagatatgtagattcatgttttccatctagttttgggaattttgggtcattatttcttcaaatattctttctacctcattcttcctctcctacatctgggacttcctttacgtgtatctcagtacattggatggtctctcacaggtttctaattttttattattctttttttttctgttcctcagactggataatttcagttgacctatcctgaagtttgctgattctttcttctgctgctaagatctgctgttgagctgctgtactgaatttttcaattatttttgaaatataatttctatctttttattcatattctctatttgatgagacactattttcctacttttatttagctctttagacattgttcttacagtttttggagcacattaaaaatagctcatttagtctgggcacagtggctcatgcctataatcccagcactttgggaggccgaggcgggtggatcacttgaggtcaggagttcaagactagtctgcccaacatggtgaaaccccgtctctactaaaaatacaaaaattagctgggcatggtggtgcatgcctgtaatcccagttacttgggaggctgaggcaggggaatcaattgaacttgggaggcagaagttgcagtaggctgggatcacaccactgcactccagcctggatgacagagcaagactctgtctaaaaaaaaaaaaaaaaaaaaaaaaaaaaaacaaaaaacagctcatttaaagtctttgtcttgtaagccatttggcttccccaagaacagcttctattgttttcctgtggaagaggcacatttgcatgtttctttgaatgcctcaaaaatttttagtaaaactcaatattttaaataacatagtgtggcaactttgaaaaccagaatttccctctccttaggtgttgttgttgttgttgttgctgtttattgttgtttgcttgcttagtgactattctgaactaattctgtaaagtttgtgttttttcatcatgtgtggccaccaagtctctgctcagtttggttagtggtcagatgaccagacagattgccttaaatgcctagaaacaagcctcagtctctgctgagggttctgtgtgagtgtggggcataccttcagccatcagacaggcagttcacagctctgttgtagccttcacttcatgctggcccagagcctctacatcagccagtggtgagagcttagagcctcatgtcttccctgagtgtgcacagcctgggcaggcacacagccctccatgtgttgtggccatccatattccaaggatcgtgtcagagctttgcaaagcacctgtgcacatctcattttccagcttttccttcaagctttctggttagcctattgtttgtcccaaccattatcctctacctcaggtggctggtaagtaaaacattgtctctaaatgttttcaacaaatgcccccagggaaagacttttcacatatgtgagctttgagttggatgaaataaagacagcctttccagtgggtcctccagggaacaaccagacaggtcaagtagtgacaattctctgggaatggggctttgaaggcactctaaccccaccctgtgctttctggtggcttccaggctgttggtttttactgccattgtgggctgctcattttcaagcctgtggcagagctgaggagagggagctggaaatagggtgagttaagatgccaggaagttcgctgttcttgctgagattcagccatttctttctttttctttctttctttttttttttttttgagtaaattgctctgatttctgctagcctttagttaatttccagagttctgtaaaagttgattctgatatttttgggtggttttctcattgcttttatgaaggagggaatgtttaaggttctttgccattttcactgatgtctacagctacttcctaaggctgcttttctctggtcctctcctcaacgttcatctggacatcgccttggggatcactagctggggacagcttcacttcagtttgatttaagtgtgatcttggtttgttgatttccttgtctagttgctccgtctgttttatgtgggaattggggaatacccaaaaacaatgctgccatggccacatccatctttttttctctttctctctccacctccctccaccactgtctccctccctccctctctccctctatctttagctctatgttttgtctaatataaaaatgaatccctattttttctgttgtcctttccttgttaaaaatatccgttggattcctctgcactgaaggaaagaagccactcttggctttagagtataaaccaaaaataaaattctaagtcccccagccagctgaatggacccttcctcttggccaagggcactctaaagtaaacctgaaacactagttcaggccatgatgggaaggggtgtttggacacaccttatcctaccctcctcccttggtgtccaggcacagctgaccagcgttaacattggaacagaggcgtgaagacagacaaagcagaccttttgcagctataaggtaccaacatggcagattgcaggccctgaaagaaatggaagtattttaccccaaaatatatttctgcgatatatttaaatggcttgcaaagctgtctctcctgggaaatgtctacattctgtagagaatcccttttcctttccaggtcttttccctgatccaagagggaattaattaagagtctggcaccttttcaagtctgataaacattgaccatctattctctctgaagcctgcaacctggaggcttcatctgcataataaaaaccttggtctccacagtcccttatcttaacccagacactctttctaccgattcccagtccttagataaactcaaccaattgccattcagaaatctttgaattcacctatgccctggaagaccctgcttagtgttttcccatctttctggaccaagcctgtgtacatcttagggtattgatgggtgtcttatgcctctctagcatgtagaaatccaagcctgtgtacgtcttagcctattgacgggtgtcttatgcctccctagaatgtagaaatccaagcctgtgtacatcttagtgtattgacgggtgtcttatgcctccctagcatgtagaaatccaagcctgtgtacgtcttagcatattgacggatgtcttatgcctccctagaatgtagaaatccaagcctgtgtacatcttagcatattgacgggtgtctgatgcctccctagcatgtagaaatccaagcctgtgtacatcttagtgtattgacgggtgttttatgcctccctagcatgtagaaatccaagcctgtgtacgtcttatgtgtattgatggatgtcttatgcctccctagcatgtagaaatccaagcctgtgtacatcttatgtgtattgatggatgtcttatgcctccctagcatgtagaaatccaagcctgtgtacatcttatgtgtattgatgggtgtcttatgcctccctagcatgtagaaatccaagcctgtgcacatcttagtgtattgttggatgtcttatgcctccctagtgtgtagaaatccaagctgaagcccatccaccttgggcacatgatcttaggctctcctggggctgtggcctgggccattggtcacccacatgtggctcagaatacatttcttcaaatagttttcagagtttgaccctcttcatcaacaggagcagtagttgtcagccctgacgttatattaaaataacttgggagcctcggaaaccatggtgtctggggcttacccttcaaagattctgaattgatttgtctcatatgaggcctgccatcagcatctcctaaaaattctccaggtgatttcagtgtcttcatatttattttcttccatgaataaaatgggactaacactctctgaagcttgttttatataccaacaatatgaatggctttcttcttattcctgtcttaaatttttatccagctgttttaaggtttacacattgcaagcttaatgacattttaatcctgtatggtaaattagtataatgcattttgttaaaattttcatagaataatggagaagggaatactggatatagtatagagcagtaaaattttaacagtagttttaacttacagaattctactggtgctttccttttgctgtagggaagttacatctctttatttagcagattaaagagacggaatcacagagggattacagggtgttcctggggtccttcggctggtgtggaatggagagcggaattccaaactcccagcagcagagtgcagagccgtgatttttaaaatgttgttctcaggatcacatcctattattgaaaattactgaagactccaaagaatttttttttttttttttggtgggttagtgctatccacatttgttaccttagaaattaaaattgccaacactttagaaaagctgtttattaattcactttaaaataaatcataaaattatttcattataaacacagtagctatattttccaaaacataaaaaagtgctaagtgtgacatttttgttttacatttttacattcttgtttcacgcttttgcatatctcattgtttcatttaacagaaaacacttggattctcatctctgcctcccactcattctgtgtcatttcctgccacatagcctctggactgttccaagttctctcataaaagagtacacgtgagaaaggcaaagtatgtcttagtattttatgaaaatagttttggcctcatggaccacttgaaagagcttaggggcctcttacagttgcaggctgtgctctgagcattgattgtggagagacaacagggtggccttggagtccggatggagtttaagttccagctgcggcacgtgtgagtcgtgccatcttacgcacatcacgtaactgccctgttttggttgtttatcgtgaaacgagggtggtcctacatgccctaggttgaatgtgctgggaccaaactctgagacagagatttgcatgcagtcggtgactgggggtgatctggggtaacccccgtacaggtgagggaagctgaattgggcagagggagaaggtgagctggaatgcagtttaagaggaccgagctgatcctgtgaggtgctctgcagccggagctggggttccccttcagggttgacccaaccaaggctgggggctaggcctttgtgtcccacatgagggatcactgatggtggttcacctccagggagcaagagactgtaacttagggagtggctgttcccttgggctcaggtggtgatggggagggattcagcggctaacccctagccctcaacagctggtgtctggggagaggatgcagagtccccaggaagcagcagtgtggctgtcacagtacccaccaccctgaatgtcatcatttctcaggtgtgtattgttttcccatcactgaaattaggaggcatcttttataaatagcacatcatagtttaactgccagcgggtttgtttttccttagcagtactagagtaatggtctgtcttgcaatcaatagcttcctagattggaggaggtcataccatctcatgggacaggggattgctttttttgagacaggctcttactctattgcccaggctggaatacagcggcacaatctcggcttactgcaacctctgcctcctggactcaagtgatcctcccacctcagcctcccaagtagttgaaactacaggtgcaaaccaccatgcccagctaattttcgtattttttggcagagatggggttttgccatgttgcccaggctggtctcaaactcctgggctcaagcaatgcacctgccttggcctcccaaagttctgggattataggaatgggccaccacgcccagcaaatgggattgttcttaagattaatttagatggtgccactcattaaatcctcaggaagtgtgaatgcactttgcttatcagtactaagtgtggtagaagcttccctaatgatgttgaaggttcacataactcaaaccagcaagagctggggagtggtgtgtaggttaaccgggaagctgataaatacagagcattctgctaagcacctcgggagctaagacgatgactcagaattgggagttctagttagctgcttgggaattctgaataaatacatctgttcagcttcttacaattgagcgcatattaatgcaaacagatcagaacagggaggaggggagtgtgtcaggagccgttaacacagagcctcgggacagctgagttggtcgtggttcgtctgtgttcatgccctgcaatgctgtctgtttaatttgcacggcccgtgcaaagtgcaaatacaggtccttagttcagaaatcaaggaaaagtgcccctaaaggaactagttatagtataagatgtttcctttcacaatctccgtcttgacttgtcatgggatttttatttgctattcagcatcattctaaaaacattaagatttttgaattattaacatgaaggttaccattcatctgtatatcgtgcgttgctggtttcaaatgcaaatgaaagaacatttaattcacatgcagaatctgaacaactacatagttcatctgtcacagctcaaacatgcatatgtatttcattctcattacagcggtggaaatgctgtgtgaaactcactcggctgtgtttatttcccttcatgaaacagcccctgtccaccgagattctccacctttgctcacacatgagaaggactgtgggctgcccacctcccctccctccacacggccacgttcagcataaatggtggcttatgtgggaaagcaatgtgagtgggagagagggtgggacccttggtcgtttgtgtttcttagaacactgttgcactttgtggtttgcagcaagctctgggtaagcagaggagtggcctcttagggccacatgagcacagacagacacgtggggggcgaggcgctgcgggactgggtggcgggcgaggcgctgtgggcgtgcagattggggtgtcttctctgcaggtgcgcgcaccacgtcgcctcatgggatgtctcacacaaaatataggttgggagataaaatctttgagaatttcaagacagcaacagcagcgtgtcaaagcaaatgagaaatttttctgcacacaggcccctggcgactacctaggtccatgctcccgtgaggctgcccaccttccaaccctagccgtcggatcagacgatacgaggggacctttggccgtttgctttatggccttgactccaagggctaggggtagagcctgactgtcaccattgggaaatgccacagtgggcccatccctcataattacaatcatttccgcatttgtttctatgaaatggacttcagttaagaaactttgcttcttcattgacccatatcatcatttcagaggcattctctgtggttcaaagtgacataaattgcttgctgccaaaacatcctaggtttctacaaagtaaacaaatattttcaactgtcagacagtgggaaaaatgtgtttcttgggaggaaatggtgctcgttttgcctgctctgaccccatgaaccattcagtggtgttaaccggaaaaggcctttccagaacctgcccctgagctgctaatactgtccaagggcctttcagggacgttctcctcccagaccaaggtgctcattttgctgggttctggggtaaagacccaaccccagcaagcacctgccagggcttccctggggggcctgggaaccgccaactgctctgccacttcctgagggaggtgagggagctctgtggcagtgaaggatgaatgcagccagcagctctaggactgaggaatccatgtctgctgaaaactgtcagagaggtgagaagctcatttacagctctcagaaggccctggctatctgtctttgccatgttaatgagctaaaaaaaattgcttcctggtcaggcgtggtggctcacacatgtaatcccagcactctgggaggctgaggccagcggatcaagaggtcaggagtttacgaccagcctggccaacatggtgaaaccccatctctactaaaaatacaaaaattagccggatgtggtggcatgcacctgtagtcccagctactcctgaggctgaggcaggagaattgcttgaacctgggaggcagaggttgcagtgagccaagaccatgccattgcactccagcctgggcaacagagtgagactccatctcaaaaaaaaaaaaaaattgcttcctgagagccctgcgtgcatctgcagaaaggtgggaaggacagacttgcatggcagtttccccagggcagcccaggtctgcaagctattcagtaaccactgagatttgtctcgggaatatgccagtcttgggtgggataaaaagcattgattagtgtcaaaacttcccctccagtttgaatttaataatgcactgacatcatcgctcaccagactgctgtgacgttctgtccattagtgtctgcagggaggtcatgaacatcctgctggatttgaaaacgggctgagctgcaccctccttcctgtgcggttccctgaaggcccctcccaggacaatcggcagtggctgtcagggccacagaggcatcgtgttcctgtggctcaggaggtatttgggtgctggcccaggaagaagtgatgacatgaattttacccctgggtctgggctgtgctgtttttacttttttgaaggtgggaggtccttggacccaggggctcagcaggaagaggagagaggacaggcaaccccaggaggtgcttggaggtgacattgtggggcctgatttcctcctgatgtgcccgagcacaactttggcacatcctgctgggcccttgcgccctcctccaatctgaagcctcacagctttttcacttgggaagtttctcggccattccttcagaggtggcctcccccgcaagctcttcattcttttcttccagattcacggcacataaactttgttatgtgcacaaaattattaaaaattacataacattaccttcaggccttctatataaggtataaggaaacacaagtaatttcatgtttcgacttgggtcctgtccccaagatatttcattatgtacatgcaaatattccagaataaatccaaacatatctgaaatccaaagcacttctagtcccaaacatttcagatgagggatattcaacctgtgtcatattattttattcctttttgtgtgcctgaaacgtttcataataagaataaaaggacgaacaaagcaagcaaaagacattaaaaagaagaaaataatgaagacaagagcagaaaatactgaaataggtacgaagaaatgagggcaagcatcaagaacacaaacagcagaaatatctctgggtctttgaaaagacttacagagctctttttaccgacaatgacaaaaaagggcataagtacacaattaatgagaggaaaaagggaattccaccataggtaaattgaattcaagaatcgtaggaaaacactactaatgactttgttctaagaaatttgaaaaggcaattagaaaaaaaacctgtaagttgataaaagtgactcaaaaagtaaagaaaacttgagttagtctatattcattaaaacatgcattccttaaattttcagtcaacttgttttgtaacttcagtaagagtagtccacattcacaataggaaattcattctgtccacaaaccatcctattgtgatattctccaaaatatatgtggagaggtgagggaacagcataactggggtatgtggttaggtaggatgggggttagttattttaaacataggcacgtgtggtgtgcacctgtagcactcttaacctctaaacattggccattctctgttttacaagaaacctgattatattttttactaagtccatatttctttgggacctgtccttaatgactctgaaagacccctccttactgctgggttttgtagtcaaaggagaaatgagggctgtacgtgaagacccttcccaagacaagatgcttctgtgtctgatgaagaatgaagcctcaagtcaagctcaccaggtcatgggctgagggttgctgaaccacaaggagataccgtatcacaaatgaacggactttgcagtgtcatcactgtggctccaggggcgtcttcccttcccaaagggtttctggcagatccctttgaacagagagtttctctggtacatttcagaataggttcccagattgttaacaccaggacagaacggctgaaagccagagagttagcagctctctctgaatgatgatcaatctgaaatgaagagaaagtcattctgtagctaggaaacatgatcagtttttaaaagcttatgcccagccattggcagaagctgtatatgtgctgtgctggtccctccgggactggatcctgagagctcccaggattttcaccgttaccgcttcagaagcagaggaactagtaaggcgcacgtttgtgtttggatggaatgctatccatggacattccaaatgttgcccccggccacatctgctggtctctcctgccccaccaccccaactgctccaccacccaagctccacctcccttagagttccctgagtgccgggcgtgtccacctgtggtcttcccatggtcttcctgtgggccaggtggccatgtgcctctgtgaccacagcctacatgcttggctccatctgctgcctcagaaaggccaactgccacccagaagagagtgggtcaggagggttgagatgaagtgaaacaggaaaagttcccttattcccctcacagggcgtgcgatggaggagtgggttgcttcttcagtgccccactgctcccacctgcaggggagcatacagacgggcaggctgtgggctcagaccccacggccgtgtctaggggtgaatgcttacagctcctaaagccccagtgggcgtgtgttacagggtgcttttttagtttcgccgtctgtgggcggcttgtgttaaccagctcaattagaccctctgccttattgcaaggacagggggctttctgtgtcctggagtttcttgccttggtgtactggaagaatcagatcgcacatgggcttggagaatgagcgcaaggttttatagagtggaagtaactctcagcaggagccagagggagatggactgggaaggcagttttcccctggagtcgggccgctcagcagccaggctctcctccaactacctagtctgctggtgcctgtcagtgagttcttctgccggtgtgctcctcttgacatccagcccttgtgtctttgcccactagggtcttggggagctgcttgtgtctctgcctgctagggtctcagggtttttataggcacaggatagaggcatggtggaccagggtggtcttgggaaatgcaacatttgggcacaaaaacaaaaatgcctgtcctcgcctaggcccatgggaaaggtccaggggtagagcccttgccagagacccgcccttctccacccagcacttccctgcccatctcccatatcagaagcaatccaaactcatctttctgtttatttaactaagcaaccatctcagacaaggtgcctgatgatgtgaaaatgaaaagtgagaaaatgaggattcgacagctcacctcagctgctagtgcacaactgggtgctatggagatgtggggcagcatctgggcagacaggcagggtcagcgggcgccgtgggcttggaccctcagaaaggcgggtgaaccgtgcggatggagagtggtgcagtgtttgggcagacaggcagggtcagcaggcaccgtgggcttagaccctcagaaaggcaggtgaaccacgatgtggtgcagtgtctgggcagacaggcagggtcagcgggccccatgggcttagaccctcataaagatgggtgaaccacgcacatggagagtggtgcagtgtctgggcagacaggcagggtcagcgagctccatgggcttagaccctcggaaaggtgggtgaaccacgcgcatggagagtggtgcagtgtctgggcagacaggcagggtcagcgggctccatgggcttagaccctcggaaaggtgggtgaaccacgcgcatggagagtggtgcagtgtctgggcaggcaggcagggtcagcgggccccatgggcctagaccctcagaaaggcgggtgaaccacaatgtggttcagtgtctgggcagacaggcagggtcagcgggtgccgtgggcttggaccctcagaaaggtgggtgaaccatgcgcgtggaaagtggcgcagtgtctgggcagacaggcagggtcagcgggccccatgggcttagaccctcagaaaggcaggtgaaccacgatgtggtgcagtgtctgggcagacaggcagggtcagcgggtgccatgggctctgaccctcggaaaggcgggtgaaccatgatgtggtgcaatgtctgggcagacaggcagggtcagcgggcgccatgggcttggaccctcagaaaggtgggtgaaccatgcgcgtggaaggtggtgcagtgtctgggcagacaggcagggtcagcgggcgccgtgggcttggaccctcagaaaggtgggtgaaccacgcgcgtggaaagtggcgcagtgtctgggcagacaggcagggtcagcgggccccatgggcttagaccctcagaaaggcaggtgaaccacgatgtggtgcagtgtctgggcagacaggcagggtcagcgggtgccgtgggcttggaccctcagaaaggtgggtgaaccatgagcgtggaaatagaagcacactgaattctgggcgacccgtgctcccaggtctccttgtggctggatgtctttcctgcctctcactctcccccgggaacactcctccctccccgcttgctcctgcctggcctggctcagccctgcctctcgcatcctcctgtgtcagaggcacacgcatgtctgatgctgttgctcagggatatcagttgaggagctgagggccgggaattacgtgacttattcccaaatgagtagatggaagaaatggaacgtctgtgattccaggccaggagggaatagttgacgccagagtaaacctttaatttacatgaaaaacttacaaaaaatatgggagccagacatgaaaacaacaaactctcatgtaatttcatcactttgggggaaaacaaaaatccttcttatttttatgtatttgagaatcaagcttttgtgtctcagaaggtccttagatattcttgtaggttcaagtgatgttgagaaactgtaaacagcaagcacaacataacaatgtttccaccagcagcagatcgcgtacatgatggtggtcccatatggttgtagtggagctgaaaacccctgtcaccgactgaccttgtggccctcatgatgtcacagtgcagtgaattacatgtttgtggtgatgctggtgtagacgagccaactgcactcccacttgtatgaaagtctagtctagctgtgcacggtacatgtgtatttgctgtacttttatcattattttagaatgcactctttttacttattaaaaagcaaaactaacactcacacagactcaggcaggtccttcaggagatatgccggcagaaggcattcttctcataggagatgatggccccacatgtgctattgcccctgaagaccttcctgtgggacaagatgtggaggtggaagacagtgatattgatgagcctgccctgtgtaggcctaggctagggtgtgtgtttgtgtcttagtttttttttttttaacaaaaaagttttaaaagtggaagaaaagtgtaaataggaaaaagcttatagaataaggatataaagagactatttttatactgctgtactatgtgtttgttttaagctaagtgttataagaaaaagttaaaagtagttaaaacatttataaagtacacaagttactatttttttttttcgagacagagtcttgctctgtcacctaggctggagaacagtggtgcgatctcagctcactgcaacctctgcctcctaggtttgaacgattctcctgcctcagcctcccgagtacctgggattacatgtgcacactaccacacctggctaatttttgtatttttagtagagacggggtttaaccatgttggccaggctggtcttgaattcctgacttcaggtgatcacctgtctcagcttcccaaactgctgggattataggcgtgagtcaccgtgcccagcccaaagttactatttaaaggtaatttattattgaagaaaaaacatttttataaatttagtgtagcctaagtatacagtgttgatagtctagagtggtgtacagtaatgtcctcggccttcacactcacccaccccaccctcactgatgcactcagagcaaatttcagtcctgcaggctccattcatggtcagtgctctatatagctgcaccattttaatcttcttttttagactgaatgtcactctgttgcccaggctggagtgcagtgacgtgatcttgactcactgcaacctctgcctccgtggttcaagtgattctcctgactcagcctccctagtagctgggattacaggtgcctgctgcctcgccaggctaatttttgtatttttagtagagacagggtttcaccatgttggccaggctgaactcaaactcctgacctcaactgatccacccaccttgacctcccaaagtgctgggattacaggcgtgagccaccatgcccggcccatttttatcttttataccatatttttactgcaccttttaatgtatagatgatacacagatacttaaccttgtgttacaattgcctgtagcattcagcacagtaacttgtaggacagatttgtagcctaggcacaatgggctttaccatccagcccaggtgtgtggcgggctgtcccatctgggggtgcgtaagtgcacccgtgatgtttgcacagtgacaggatcacctaatgaggaattactcagaatgtacccctaccattaagcaatgcaactgtactactcttaggattaaaactacatggcttacctgtgaatgctttaaaagcttgcattttcttttctgatgcaacccacagtttttaccttttaattttaaagtatgaggtcagttagacttcatccctatttaaaactgaaaagcttgatttagggcattctttagtgttaatggaaaagcctcaccaggaggcgggctccatctgcttttgaacatcctggaataggggcagtctttgtttaatagaagcttcatttcagacaaggaagaaccgtcaccctcaggagaattagatgtctcaacagaggaggaaattgagacctatcggaactggaagcttaccagatggcagcacagaaaaccctggcatttctgaaagaagcaggaaggtggggagaggagggatccatttgcgggctgtatggaatgtaatcttgtcttaagcctcactaaaagctagacaggtcatggagacaatcaggcttttattctttgaaataattcacattacaggcttgtgtattactggccttatcaaataaaagcctttagactcatgtgggcagataattacaaattgatgtctgggcctcttgttttggaaatggcttttacactcccctcttctttctctccctctttcatctctctcttcttgagttaaactttcttgtgattttgttagggttctggtagtgttagctggctctaagagtaaatggcaaagctatatgaagaagtcacttttatttgaagtcaagaatcgagttacaaagtgcaggaacattggtgcagacagggaatttcatttaacactgtattcagcctcagaaattattacaaatcagaagtaataagtcagacaaccaaagacagcagcactgtccagggtcagtttcatctgtcagggttgtttcttgccacagaactctattttactttacccagtgaatcttaactttaaagacaaaaaccaatgaataaacactttttggaaaacattagaaatcaaccaaaatctagttaatttataacaattgggggaggggaagctcctagagcttagactaaaaaaacccaaacaaaatataaattccaataaatgatatcctcatatccctattgtttctccagatcaacaaatatgtgtgattctgtatcatatgactttgtatatcaagggaagagtggatagtatcagaaaaatccctagaaccctcaagtgtgaaaatgattagacatcttgaataatacaaagcaacacagctagatccacatcaaaagagtcatgaagaccaagtgggttgatcctggtgagtacattttgaaaactgtgaaacacaaatggaagctgttacatcatcaccaagtggggtggaatgaaggcaagccttggaaactcctcctgccatgaggttctcaactccccaccccagagcagaaatgccccatctctgcatcctgctcttggctcagcagacctcctcctcctctgtcaaagagcatccacattttatctgctgacttcttaaagaatcagatgctcctttccctgaatattttaaagagagtcacatagtcaacattcgtcagagatggacatcagcaaggcagcaggagaggactctccattgctcatccatcacagaaacaacaatttgaacatctatctgtgtgcaaaaataccttcacaagtgctaaggaaaccaggtgagaggtgatagcacctgggcatggcacagaaataagatgcactgaaaaggcagaaaaaacagttttgcatgactgggtcccctctcacccaggcctagcagcatgttgtggtgagagatgccctctatgtgggggaaggaaagagaagtgagtaccagactttgcttctaactctaaaactgcctcctgatcccccaccaaccaagttaaacccagcaccagacatgcccccatagcttcctactccaggctggtacccaaggacggaggcttcaggcctgccccaataccaggtaggatcatgcaggcccaggccccacacctgcccagtggacttagtctctgggcccactccgcatacaggttgaccccattggcctcaggctccacatcatctctggcaccaggctggccctgcagctccatggttagcagacaggacccaggcctatcctggtaggccccagcactgaaccagccctcactgacctgggctccaggagtgtccctgtggactcaggatccaggctggtccccagtgctccaggctccagaactcagagtccaggcccactccaatagacccctggtgccagccagcccctttggacagaggctccaagaccacttctgcagacttaggctccaggccaacccttgtggatccaggacccaggctcacccccacaaattcaagctctgggcccaccttagccccaggacagccccttcagactcaggtatatggcctaccctagcaccagtcctgccttaacggatgccaggctctaagttcacccttgcagactcaatcaacaggtccactccagtggatccaggccaaggctcactcacctgctaacccaggcattggaccagcctgcgtgaggaccccaatagcaagcctacctatggagcatgccagatgacgcccagaatctgcatgggcttattgatgaagggcttacccaggcgaagccattctacaaagaatagaataagtccctacttcccaaaatgtgcagacatcaacgtaaggcaacaacaacaacaacaacaacaaacatgaaaaaccaaggagacacaacaccaccaaaaaccacaataatctcccagcagcagactccaaagaaatggagataaacaaatggcccgataattcaaagtaagtgtttgaaggaagttcatgaacttcaagaaaatatagaaaaacaattcaataaaatcaggaaaacagtaaatgactgcaattagaaattccacagagaggtataaattattttttaaaaattctagaaactctggatgtggaaaacacaataaatgaaatgaaaaatgcagtagagagtgtcaactgcagaattgatgaaacagaatccgtgaacttaaagacaggttatttgaaaacatacagtcagaggagaaaaagagtaaacgggaatgaagaaagcttatgggatttgtgagataacaccaaaagatcaaatatttgagttacaggtattcaagaaggagaagagagaccaagggactgaaagcatatttaaataatatgagaaaacattccaattctggggaaatatataaatatctaggtacaggaagatcaaaagtctccgattagattgaatccaaataagactatactgagatatattataatcaaactgtcaaaaatcaaagacaaagaggatcttaaaagcagtgagagaaaagaagcaaatcacatataaaggagttacaggaaggtttatagcagacttctcagcagaaaccctataggcaagagagagtagaatgatatattcaaggtgctgaaggaaaaaaatggccaaccaagaatactgtacttggcaaagctgttcttcagaaatgaaggagaggaaaagaccttcctagccaaccaaaagctgagggattaatcaccaccagagctgtcctacaagaaattctaaagagagttcttcaagctgaaagaaaagaatgctaactagcaacatgaaaacatacaaaagtatagaactcactgataaaaataagtatacagtcaaattcagaataatactgtaatggtggtgtacaaatcacttaagtctttagcatgaaggtaaaaagagaaaactatcacagtgatagctatgaaatttcttaaataatagctacaacaaaaagatatgaattgtgacattaaagtttatgcgtggggtgggtggagtaaatgtgtagagattttaaaaatgtgatcaaagttaagctgttaccaacttagaaaagcttgctataactgtaagatatttttatgtaagcctcatggtaactacaaagcaaaaaccttagtagatatgccaaagatagaaagtaaggaatcaaagcatatcactagagaaaatcacccaatcataagggaagacagacacagaggatgaaaggaaaaaggacttagaaaataccagaaaacaatgaacaaaatggcattagtaagaccctgcctgtcaataattactgtgaatgtaaatggattacattttctaatcaaaagacagagtggctgaatggctgaaaaataggacccaactatatgctacctacaagagattcccttcacttttaaggacatagactgaaagcgaagggatgaaaaagatatttcatgcaaatgaagaccaaaagagagtagaagtgctatacttaaataaaatagacttcatgtcataaactgtaaaataaagtcattatacagtgataaaggggtcaattcatcaagaagatataataattataaatatgggctaaaaactggagaacctaagtatgtaaagcaaatattaatatgtctgaagaaagagagatggactgtaatgtagcagtaggggacttcaatacccactttcggcaatggacagatcattcagacagaaaatcaataaggaaacatcagtcttaaactatacttttagaccaaatggacataacagatatatacagaatataccatataatggtagcaaatacacattcttctgaaacacagagaacattctccaggatagatcacattatgccacaaaacacattaataaatttaagaagattcaaatcacattaagcatcttttctgaacatcctggtatgagactagaaattaataacaggaggaatttcagaaaattgacaaatatatggaaattgaacaacatgcttctgaaccaccaatatgtcaaagaagaaattaaaaagagaattaaaagatctcttgagataaataaaaataaaaacaaagcataccaaaacctatgggatgcagcagaagcaggtctaagagggatgtttatagtgataaatgcctacatcagaaaagaagaaagaatccaaataaacaacctaatattacacctcaaggtactataaaaagaactaactaagcctaaatctaataggaaagaaataataaagatcagaacagaaagagattacatcgaaactagaaaaacaatagaaaagatcaatggaactaagagtttgtttgttgaaatgataaacaaaattgaaaacctttagactaagaaaaaagagaaaagtcaagtggaatgagaaatgaaggaggaaacattacaacaaataccacagaaatgtaagggaccatgagactatgaacaattatatgccaaaaattggataacccagaagaaatggaaaatccctaagcatatgatacctaccaagaaaaattatggagaaacagaaaatctgaacagaccaataacaaatatggagatttgattagtaataaaaagtctcccataaaaagagttcaggacctgatggctttactgctgatcttacctaacatttaaagaaggactaatactcatccttctcaaactcttccaaaaaactgaagaagaggaatacttccacactcattttacgaggtcagcactaccgtgataccaaagctgacaaaggcactataagaaaagaaaattacaggccaaaatccctgatgaacatagatgcaaaaaccctcgaaagaataccagcagactgaattcaacagctcatgaaaaggatcattcaccacgatcaactgggatttatccctggtatgcaaggatggttcaatatatgcaactctattaatgtgatatgccacattgagggaaggataaaaaccatatatcatctcattagatgtataaaaaacatacaacaaaacacaacatcctctcataataaaaacactcaataaattagatatactgtagaagggatgtgcttcaacataataaagaccatatatgacaaactcacagataacatcatacgcaatggtgaaaagctgaaagcttttcctctaagatcaggaaccagataaggatgctaactctcgccacttctttcaacactgtattgcaaaacctagccagggcaattaggcaaaaggaagaaacaaaaggcatccaaattggaacaaaagaagttaaaattgtccctgtttgcagatgacatgatcttacatatagaatcctaaagatgccaccaaaaacactgttagagctaataaattcagtaaatttgcaggatacaaaatccacagacaaaaataaagagcatttttatacactgagaatgaactgtctgaaaaagaaatcagataataatcccatttatagtagctcaaaaaatataaaatacttaggactccatttgcccagggagcctggagaacatgtgagagctggagggcatgtttcccgatggctgttgataaatgttcattctcgtggtctgccctgctgcttgttaatcccaacaccaggaattggttgtgtttagcttgctgcatagcagacacctctgtgtggctggatccaacctcagaggtgtgtggagctctctctgtgaaacctttggtgtcctctgaggggtgtggacacaggtatagagcatctctacttccctagctcagaggcgaatggggttgtcacctgtctccctaacccaaggactgaggttttgccggagttagccggtgtagctgacatagacagcccgcgctctacgctgttccactcctcattccaccctgatcagacaaggttgagagcataagggctcttcacacctggcctcttacagcagcatgctctgtggtgtgggaatggcaggcctgatgaggagaagctgtggaggcagggctgggacacaggatgctggtgtcagaggagggggctcagctgcctgctgtacccaggcaagagcaggtccagcctcctggggcccgcctgcaggagcagcatggatggaggaggacctgagcgctcagctctgcttgtgctggggttgggcgggagagttgaagccggcgtgggcacatccctgtccttctgaggagagtggctattgtcatttgctggtctctcctgcagccttgcattagttagcaatgcttggcctttggaatgtcttgttcaccaggagtcctggcaccttctcctgtccctacatagcacaggatcccccagaccactcttttgtttggcccatgggaccgcgagtgcccttttcttcccacacattctgggcaggagcgcagtgaaggtcatttcacaatggcaggatacatttgcagcatggcccaaagcctgggcacgtcagaaatattgtatgttttccactgagagcaacagcaagacagatgcagggagaaaaacaaaacaaaaaacaaacaaaagctcccagggaattactgagatgacgagcgtgatgaggagggttcctgtcatcctttttgtacccagtggaggataacgtcagcatatgggcacagccgggctcgtgggggcacaggcagactgctcaccctatgcaatctaggcaggcggcgtgtgccagccaggccaggcatattgaggcactgctgctttaaaagtccagctcaacgagctcaggcagcatgtggtagatacacatatgtagtagaagttccaaaattattggtgatagtacattcatcgcctgcacctgctcactccattggatgcgggcagaggagctgggtgggaatgccttcctgcgggaggtgtgggtagaggggacagaggtgggatggcagggagggtcaggaataagcggagtccgtacgccaaactatggagtgggacaggaaggggcacctgagagcctcctaaattctcattaggaagttcagaaagagtccataatttctgtcaaaaccaccgacagtggctctgcctgagctcaaattctcactcttcctattaccagagtggcactgggcaagggtttgcagagtggatctctgtctcagctttagtacctgtgaaatgggtgtgtcccagcagcacttactcatagagcatcaagagggccaagtgcattcatgtacactgactcggagagtgcctggcacacacacagtgcccagtgcccggctgacttggagagtgcccagcccacaacagtgcccagtgcctggctgactcggagagttcctggcacacaacagtgcccagtgcccaccagctgtttgtctggattctctctaaatgtaggacgctgccaatactgagtcttgtgagtccggtgcacacttggattgcacctgtgcacgacacacattggacacaaaaacacacaggcaaacaagtgtgtgtgtaaacgcgcttgagagaattgaagagcatcagtccatgttggaaaatccaacgacatcgaatatagctatgaacatgtctttcaggcgttcttaaacgtgtgattgattaacgtgtgatctgatcttgatgcccgaaccctggaaatgttttaggagcaggacacagccctcctgaggaaaaggctcctacgctggctgcctttgggtttgcttctctgtgaggtggcgattctgaacgacgtggtgattctaggtctgtgctcacagtgtgttctgagacatgctgtcacccctctgcatttctggtgctcaggaggccattagggaggggctggtggctttgagtggcctgaggagtggtggtggcctgtctctgtggctgccacggcactgctgatcacctgcatgggcgtgtccactagggctgcgggtggggtgaggtccggtcattatgccattggcggccaacaccgttgatgattaaagcttccatcagggtgccgtggacatgctgtgaccccggcgggtggccacagcaaggtccctatgtccttgtcacctgcatgccattccctccaccatgggcagctgcagactccacgacgtggccagtcagagctcccgtccctgcggcaagcccctggttctactgagaagcctggttaccctctcagtggtggtctcagtggttttgctctgtctcctgccccgtcttggctacaagaggctgggctctgggacggatggcagacggtgtgaactgcagacggggcctgctcggtcactgctccctctcctcttgggggtctggggagctgcctgaggctcacagcctcggttcatttcccacataggagtttgtttacctgtgacggctgccgcctgactgaagtacttgcttggttttcttattgtggcgaatacaaaagcatggcatgaacgtaacaagaagtgttttttttcatgcgtgttgtcgaatgcgtcttcccctgacatcagcgctacctttcctcagttctcttctctcaagagtgttttcctcctgagagctgaggcccctgcatgtgggagcacgaggagggatcagccatctgtgtccggctgctgtgcgtgtgggagcatgaggagggacgagccgtctatgtcctgctgctgcgtgggagcacgaggagggaccaccgtctatatcccgctgctgtgtgggagcatgaggagggatgagccctctgtgtcccgctgctgtgtgtgggagcacagggagggacaagccatctgtgtccggctgctgtgtgtgtgggagcacgaggagggatcagctgtctgtccggctgctgtgtgtgggagcacgaggagggatgagccgtctgtgtctggctgctgcatgtgggagcacgaggagggatcagccgtctgtccggctgctgtgtgtggagcaccaggagggacgagccgtttgtgtctcgctgctgtgtgtgggagcacaaggagggatcagccgtctgtcctgctgctgtgctcacttcagcagtgctgtctccttcagaactcaacatgccctgcagagtaagtatggctgccacagctcacaaactcagccgcagcctcgaccccgctgctctgcccgcggcttcctggctgtggacatctgagccaggccagactcctgatctgcgtctcctagacccacacacctctgacgcatggccccgcagtacttctacattcactggcaagttcccacattgtgtagtcaaagacagttgcttcattatagagtttaacaataaaatactcttttttcatcttacttttgataagctactttcccaagacagacggaaaagaccagttactcaattgttggtttttatatcttgggtttactatgctgagtgacgatttgtctgaaaatagaaaggaaaaaaaaaaaaaaaggcagagccactcctgagacagttgggttcttagcggcaaaggaccctgttaacacaggctcagtttgacttgagttcagggcttctcaggagaggatcctgaggcctgactgtcccttctgggaacacagtgttctctaaccctagacaggaggccaggtctcttaagaggcagatttccatgcgacccaaaatgtctgggagacgatggctgggctttgagctgggagcctctggaaggagaaatggcttttgaccctgtaaatcctgctcctctggtgaccaaagtgagttatgcggggctcagagtagctgagactgttcacacctcaaaagaactagcagggtttattctggctttacccatggttgactcagacctttgtcaagaaacttcctttctaggagcatggatggggattttgggctctcctggctcctggactccttggggtttggggcgtggcaggaggtgggtgcaaagccagcaccaatgcaaagggccccaggcatgccacacacctgagcgtttgcacgggacgtggcaggaggggggtgcaaagccagcacaaatgcgcagggcaccacgcacaccacacacccgagcatttccatgcacctctgtgctcttagccagtctggatctgtgtcttcatagcagactgtgggcatatgacaatgtctcttatactgtaaagttacatgcaaatggctgtgcccatccgcttggattttggtgactatgttcttgatgaaaacacacaaagcatgcactcctggtattcctatttgcctttgttatttaggagtatgtgtatgactctactactgttttatatgcttttaaaccatacacaaaatgtatttgcttattttcatttttattttttgagacggagtcttgctctgtcacccagactggagtgcagtggcatgatcccagctcattgcaacctctgcctccccggttcaagtgattctcctgcctcactctcccaagcagctgggattataagcgcggctaacttttgtatttttagtagaggtggggttcactatgttgatcaggctggtcttgaactcctgatctcaagagatctgcccgactcggcctcccaaagtggtgggattagaggcgtgagccactgcgcccagccctcaagatttaaatggaagctgtgatgacgagcacatggctttgagcctgcaccacctctttagactctcgctagcctatgtttccagagcaccgtgtagccgtgggccggcgcagggcctggcgcctgttcacagcgtgctggttctgggcacagctgccgtgaggcctcccctcccgctttccatctttgtcatttcagtctcgggagaccttctatttctctactttagacagttgagctctctctgcaaacaacacttccattgttcaacatttgggaaaattttaaaattgataacacgttcctcagcaaaaaaggggtttaatgacggtggagaaactccacggccgcgtctctacgcagtgtcgggccgcacccgtccggctcccccaggctctctcggctcctcctttcatctcctggttctctctccatctgccctctccacccggtatctcagggctgctatgaaaggtcttcaaagacctagtttcaaaaaacatcccctggagaggaccaattaaacgcagaaggatggtttgtgtgcagaggctgagccgtcagagtagagatgatcctgcgttcccaggtagagccgcggctcctgccctcgtcgctgtccctccctgccggtgtcagaccaaagccagcgtccttaccgacccccaggcaggctctgccggcctcccctaggcagccatggcccccgacggggttagccaccttctcatggctgctgcctctcttcgcagcttcaggccggagaggacctgctttccgattgggcccgggaaaaccagatgtgcttgaaggctgtggatttaggatttggtgttccagatatggaagggacacaattcatattatgcggtctgtgaaacaatgatttgacaggccagttaaagcattagacgagtttaaactgcttgagagcaaactgctgtgtcttggtgcagtttgggggcagcggtggggcgtgggggccgccgcggggctctgtgggttcgggggcagcggtggggcgtgggggccgtccggggctctggattaagtgcacagacctcgactgtcttcacggaactaaggagacctttattttacctggcacaccgtggggtcaagtccacattgagaggtgataacgtgctagcagccctcgctcactctgggcgccttctctgcctcggtgtctgctctggccgggctcgaagagcccctcagcccgctgctgcactgtgggggcccctctctggggcttgctgaggccggagccggctccctctgcttgcggggaggtgtggagggagaagcgcggatgggagccggggctgcacacggggcttgtgggccggcgcaggttccgggtgggcacgggcttagcgggcctggcactccgtgggactggccggcacctgctgggcttgattggaggctggatcccgtgagaggactgccattccctcttccctgggtcgttggccatgatggtgggtctctgtctctttctcgcttcccctctttttctcttggttgtctgggacgagctcccattgggctgcctggagtgcccgggctaggggccacaaagtcctgcagcgagtaccagtgagaggtgaagctggctgggctgctgggagggtggggacttggagaagttttctgtctagctaaaggattgtaaatgcacccatcagtgctctgtgtctagctaaaggattgtaaatgcacaaatcagcactctgtgtctagctaaaggtttgtaaatgcaccaaccagcactctgtcaaaacggaccagttagcctctgtaaaatggaccaatcaactctctgtaaaatggaccaatcagcaggatgtaggtgcggccagatatggggataaaagcaggctgccagagccagcagcagcaaaccggttgggtcccattccacagtgtggagggtttgtttttttgctgttcacagtaagttttgctggtgctcactctttgggtcctcactacgtctgtgagctgtaacactcacctcgaaggtctgcagcttcactcctgaggccagtgagaccacaaatccaccacgaggaatgaacaactccggatatgctacctttatgagctgtaacactcactgtgagggtcttcagcttcactcttgaagccatagagaccacgaacccactgggaggaatgaacaattctggatgcgctgtgtttatgagctgtgacacccactgcaaaggtctgcagcttcactcctgaagtcagggagaccatgaacccaccggaagaaagaaactctggacacacctgaaggaacaaactctggacacaccatctttaaaaactgtaacactcaccgcgagggtccgcggcttcattcttgaagtcagcgagaccaagaacccaccaattccggacacaacatgtccatctacatcaggaagttgtgggttctgggcttattggtttgtattgattgttggtttcgagagagaatttcagtttgttgcccaaatggtgcgatctcagctcactgctaccggttcgagcaattctcctgctgcagcctcccacgtagctgggattacaggcgcccaccttcacccgcagcctcccgcgtagctgggattacaggtgcccaccttcacgtccagctgaatttttttttttttttgtattttagtagagacggggtttcatcatgttgcacaggctggtcttgggatttgaccttgtttcctcctccctggggtcagaggtcccctggcaggtggtgggtggtccctgcattcgattcccatttccctgtccactgggaagtgtattctggaaggaagttcctacatccttctggctctaggaatgttctagacatgttacgtgctgaggctggtggggcaggctcaggcctcctgcagacgcctgttttctcataggagccatacttggtccccggccaccccgggccttggatctgatgattctctgggtgtgtcagacaaggacctggcctccctgttatgtgctggaggtcagggaggtcaggagcagggctggcacctctaactcccatcccccccttgtgtgcctggtggtcctgcccggctgagagcctttctcttagactctgccgcagccgtgatgccagacaggagaagccagggagggcatgggctgctccctgaaggcggattcctctccccaggtgggaggaggagcctctgtagctgccctgggctgctcctctttcccagggtggcctgaccacaaccccggccgggcaagggagtagggaggaccgtacagagtttctcttccccagctcattgttttggagacagacttggaggcaaggccagagctatatgtcccagcccctgcgtgtgcacctcgtgcagcagtgtggcaaggccctgacagtgccttcaaggggtgcttctggcaggcctcgggagctgtgtgatgaggaggagacttgggagagcgcgggttaggtcctggcactgtagccgcctcctcttgctgatttcaggggtcagtgttttcagggttcatctcctttatagggcagacttgagggcttcaggtacaaacgtccgtgtctccatcaggcctgggcccggcctcctccgtctggagcacattcctctgtggtcttcagcattggtgcccgtggagtggctgaagccctgactgcccgttgtggctgaggtgtgggaccgaatggcgaacagagtgggcaggaccccgaggaggctggaggccgattcgcacaggctgccgtcatctcaccgctctgacagttcttaaagcaacagtgcaagagaaatccactgcgacgtgagaagagcatgtttatgtgcacgtgtatgtgcgcgtgtgtgcgtgtgcgggcacgtgtgtgtgtgtgtgcacgtgtgtgagaggatggcttctgacgaaggggctgttcatggagctctgatcagccactcttgcccgtggggatcttgcagggtccgaccagtcagtgccccccaccccaccctgttagaggggacggagcccggtcctcaccccgctgtgggctgcctgagagtttggcttctccctccagagctgatagacagcacctgagcatatggccccctcggccccagctcacagtggcatgcctcgcaccctccgcccctgcctccactacgaggaggccgcccgcacacctggggaggcatatcctgccagctgagcgtccccaggccgacgtccttcccagccatggcatcagggccccgcagcagctggtgtcatagcacccacatccatcagcttccctggagcccctggcacagtgctgtgtgggcctggaaacgctggaagcatggtttcatccctcaggaagctggtggttaataaatggggccaagttaataaagaaggaagctaccaacaaggccatgcggtcaccacgactgcccagggccagggtgtgggggtgctgccttacagcctgtcggggccggggtgtgggggtgctgccttacagcctgtcggggccggggtgtgggggtgatacattacagcctgttggggccggggtgtgggggtgctgccttacagcctgtcggggccggggtgtggggggtgatacagcctgttggggccggggtgtgggggtgctgccttacagcctgtcggggccggggtgcgggggtgatacattacagcctgtcggggccggggtgtgggggtgctgccttacagcctgttggggccagagtgtgggggtgctaccaggaccgggatgtgggggtgctaccttacagcctgccggggccagggcaggagctgtgcttcaagggcagagaggctttccaggtggacaagggacgaacacttggggagggagggaaggttcagatggaagaggaagctgagaggagacgcacccctggaggcagctggctgaccggtgggctcccaggagactgtaggatttgtgcagataaaagtcaggcagcagagtcagagggcagccatagcacgtgtaaggcggcggggatgctgacagcaagacgttttctggagaatctgggttttactgcaaatacaaattcactgttctcaggatggcggagggaccagctccttgggaaggtcacccccttggccacctgttgtccctgaggggctgatggagggaggaggccaccttatgaactgcaccaggtccgtggctttggcggtggaggccccatcactgcaactcttcttctgggagttcggctctgcctgccacacgtggaggtgcgcagggtgggggccagccctggcaaacccaccccacataacgtagtacctcgattctcaccaaagaacaaaaattacttgcgattacgtgcaattagcaattttaaattattaatggtggtgaaagaatgtgtctattcaacaagtaatttattgcaatttttgtaattgaaagtaatttctagcaattaaatcctaatttagagcattttctgggcgacgcctttattcatggggtgcacgccagttttattgttggctgctttgttccaggcactttgtccagtaaaatttgctgggtaggctctttgggaagagaaaaatagccgaactctaggcaatgtagaaaaaacagagtgggtctgccagcacagtgaagctgtggcttccctggagaggcgtgaggaggtgcgcgccttcccatggagacagccctgcagcttgttcagaggccctccgaggaagtgggcaggcacctgggccaacgtccagggagcacgtctctgtggccccgaggcgctgtccccactgtccccacagccacggtgctgtccctgctggaggctggtccaggcttggccactggcttgagctcttccccggggctcctcggcactgctgccggcccctggggacttcattgttctgtctcctctttcctggtaagaacaccctttaccctcagaaggcagctttttgaaccccacaatcagaaagtgctccctattttggggggagacaggactctgctacgccccaggagttgatctgtggtggatttgaatataaaaggcagccaggagatggtctttgtcgagatcttatccctgatgaagtctcttctttgtcaagtagcaaataaatattcggaatgaattcttcagaaacaaaatgacctgtgtttctatgtgaaatgcaaccacgttctcctccagaaagctgcagtcaggctccctgtgtgtggccacagcgtgattcctggtcatggggtgactccccccgtagggtacctgagcccctctgggccccacacctcaaatgcagatgcagtaatgtcgtcccaggcagcaggaagccacgcggcccctccacacatttccacagcgttcccaggaaggctgctgacaagctgggccgagcgcctcgggctcgtccacacacgctagatcccggagtgtgagggtgtctgtggctccccctgtgcctgcggctcccccgtgcctgtggctccccctgtgcctgcggctcctcgtgtgtctcctcctgtgtctgcggctccccgtgtctgcggctcctcccatgtctgtctgcggctccccctgtgcctgtggctccccctgtgcctgcggctccccctgtgtctgcggctccccctgtgtctgtggctctcccgcgtctgcggctccccctgtggctgcggctccttgtgtgtctcctcctgtgtctgcgtctccccctgtgtctgcggctccccgtgtctgcggctcccgtgtctgtggctcctcccatgtctgtctgcggctccccctgtgtctgcggctcctcgtgtgtctcctcctgtgtctgcggctccccctgtgtctgcggctccctgtgtctgcggctccccgtgtctgcggctcctcccatgtctgtctgcagctccccctgtgtctgcggctccccctgtgcctgcggctcctcgtgtgtctcctcctgtgtctgcggctccccctgtgtctgcggctccctgtgtctgcggctccctgtgtctgcggctcctcccatgtctgtctgcagctccccctgtgtctgcggctccccctgtgtctgcggctcctcccgcgtctgtctgcggctcctcctgcgtctgcggctcctcgtgtgtctcctcctgtgtctgcggctccccctgtgtctgcggctcccccatgcctgcggctccccctgtgtctgcggctccccgtgtctgcggctcctcccatgtctgtctgtggctccccctgtgtctgcggctccttgtgtgtctcctcctgtgtctgcagctccccctgtgtctgcggctccctgtgtctgcggctcctcccgtgtctgcggctcctcccatgtctgtctgcggctcccccatgcctgcggctccccgtgtctgcggctcctcccatgtctgtctgcggctccccctgtgcctgcggctccccctgtgtctgcggctccccgtgtctgcggctcctcccatgtctgtctgcggctccccctgtgcctgcggctccccctgtgcctgcggctccccctgcgtctgcggctcctcccgcgtctgtctgcggctcctcccgcgtctgtctgcggctcctcccgtgtctgcatccacgacgctgggacagggctgcaggcagtgcttctgcccttggttctgcatctcctggcctccccagcaggcaaggagctcacagtgtgggcttgcggtgggtgctcactggccataaacgttcggtgtcattttcaagacagagaaacagcacacgcagggccctggagaggctgcctggagctccacgtgccctgtcctaggagggttcctcccctgcgagctcactcccgaagggcactcgaatcctgcagctggggcctgagtcctctctccccttcgtcccacagccctgggtcttgtcttccttgtggctggagttgcagctacagcacagagctcttcccctttacattctgagctgtttggaggcccatggccactttcatattccctgatgctcaataaatgatgaatgagtgaaacgagagtcccaaaccgtgggactgtcagcagagtctgcatgcaccgggctggggggcaacacagccaagccccatcagctattgactgtagcttcctcctggtcattcctgatccttccatccactcagccttcccacctctccttctgccggcggcacctccccgatggccctcacacctatgaggccctggtttcacctcactctgcagtctggtgaaagggatctggcagatgcgactgtctccatcctgagggcttatcccggcagtggcgctgagacctcccctcacctggtgctccgagatttgactctgtgaggttggctcctgcctggactcaggctttcaaccctggtgtctggggtgcaaggcaggtgggccgcgtgcggtgtctttgaggtgggctgccgttctggtagagagtgaggggatgtggaagttccatgcagactgtattttctgggcaaacctgctcagtgtttttggtaagtaatgcctaaaattcaggactctaattgaaggtatatccctacttctgactcaaaccacttgaaaaactcagtcaatagacagtgacgttgggacccaagtctttaaagctctgctgcaattctcatccttgaccgttggtaccgggcagttgcaaaaggctgagcaagtacagcccaggcagggagaccacagggcctgcccgggccccggagacgcggctctccgaagacaagacgtcccggggggctgtttttccatttggaccagttccacttggcttgagatgggcttcactctagaccctcctctgccagctcagcacgaagtgtgcatagtcacctgatggcaccctgtgatcattttcacgttgtaggaggaaaaatcgttttaaaattggcttaaatgaggagggaacaacctgaccgtcttttgatggtgcagcttttaaccctaaaagaatgtcaaacgaattcatttttgtatataagtacaaattacttattagtcacaattgccatagcgactgaaggtttgtgtccgcctaccccacgcctccagttcctacatggaaatcctcacccaaggccatggtgttaggggcctttgcaaggcgctgaggccctgaggaagagcctcacggatgggctaatgcgcttctgaaagaggcctcaggacgcttcttcaccccttctgctgtgagatgacaggggaaggcccaaccaaaaagtgggcgctcaccgacaccgaatctgtgggtatctccagaactgtgagaaagaaacctctgttgtttatcaattacccaagctatggtattttcttatagcagcctgcatgggctgagacacctatcaagtgagttattaacgtttattaaaatttggcacaaactaaaagccagcagtgtctgcagagaagctggattgccccatggggcttggctgtgttgcccccgtcccgtgcatgtggactctgctgagagtcccacagttttgggaaggaccctgatgaattgtgaccattggtattgcttagcgttgattgtggcttttcattataaattatgtaattgaatactttaatgataagttgtggctagtccagcttcaacagtatggatctgccgattgtcggatattcagttaattatgcagtgtgtggagaggatatatgtgcatcaaaagcatttaatccaagaattccagtgactgggtgtcatttggtgttttgcggctgaccgctgcattcacaacacaagagaagcagcacgtgacctctcctggccacccactagagtcgaattttgtttccatcccacagttactccctctggcacaccccaggtggagggggtggtccaggtggagggggcagcccaggtggagggggtcgtccaggtggagggggtggcccaggttggggggaggcccaggtggagggggccgtccaggtggaggggtggtccaggtggatggggaggcccaggtggagggggtggtccaggtggaggggtggtccaggtgggggggtggtccaggtggggggggtggtccaggtggggggggtggtccaggtggagggggtcatccaggtggagggggcggtccaggtgggggggcggtccaggtgagggggtcatccaggtggagggggcggtccaggtgagggggtggtccaggtggaggggtggtccaggtggacggggtggtccaggtggagaagacggctcaggtagagaaggcaccccagggagaggggcagcccagtagaggggtggcccagcaagctcccagggagagggacagccaggtaaaggggttggcccttctgcagctaacagtggtcgaaaccttcccttattactgccctgaaaggactcagtttcccctggggtgttcagccctcaattgtgatagcagcacccactgcagggggcctggcctggtcataggcagagggagccagggggtcgggggcacgttatggccagtgagtgaggctcatctgtctccggtaggatcaccctctgtgaaggtagcagcttgcaccttgttgaccagtcaccagtgacatggagtggggccaaggaggcgtcctcaccccgagaaccatgcctgtgctcccagtgcccccgcctggctcccgctctgcacctataaagctggcctttgtgctggcccttctgccttctggccatgacttgccttgctgacctgcccttggccggtggagccttccaggcagcctctgcccacggggctctccaggccctgagtcactgctggcctgaccagttcaggtgtcctggcttttgctgtggggcgtctgtcctgggtctcctgatggtccagctctgggctcccctccacagtgagcagcccctcctgcaaaagctctggttggggcacatccaaggtcagaagaggcagattgcaggtcaggcagagagtggacgggcaactgctgggactctgtctctgctgttctctggctatctctgtctctgattctttctctctgtctccctgtgtctctctatctctgtctctctgtttctctgtctctatgtctctgtctctctgtctctctctgtctctttctgtctctctctgtctctgtgtctccgactccctatccctctgtctctttctatctctgtctctgtccctctcctgctccctttgtctctctctctgtctctgttcctctgtctctgtctctctctgtctctgtctctctgtttctgtctcttggtcccagccgtcagctgactttgctgtcctcctgggccctggcagaaccacctggcaggctcccgtcctgtgccatcctggacccttcaccattgttcctactctggctcagagcactttcttcttgaagcatcctttacccaccccagggacttgaaaactggatttgaaaatgccaaatagttttaaaattagagctgcagaatgtcttccccagagcccagacttcccaggtgtctgggaagcaaagacagccagcctgggctgcaggtatgccccggggactgggcacaggatggcagctgctcacatttattggcagcaaaggtcaaagcagaaaccaggtgtgatgacggggatggccgcgcctcctgaggctggtgtttgggcctttctgcaccaggcatggccttggcattcagggttacactgctaggtgagggccgtctccttgttctccttccatagatgaggagacgaggtttggcgatgggagggagcatctggggcggggtcgggcaggggctcctaggaggcccctttggggcattttccctgaaggccactccaacagaaggtgggggtgaccggaggcaacagtggcgactcctgaggggccttggagctcctcctgtgctcctccgttcaaagttgggcagcagccgccacgtccttcctagaaaacaaagccggggaggttcagtgtgtgcgttcaaaaagctgcgattttcaggcccggcaacggctttcaacaacaatgtggctgcgatatttcacacccgccctgtgtgcacgcggctgggatatttcacaccccactctgtgtgcgtgcggctgggatatttcacacccgccctgtgtgtgtgcggctgggatatttcacacccaccctgtgtgcgtgcggctgggatatttcacacccgccctgtgtgtgtgcggctgggatatttcacacccgccctgtgtgcggctgggctgggatatttcacaccctctctgtgtgcggctgggctgggatatttcacaccctctctgtgtgcacacggctgggatatttcacacccgccctgtgtgtgtgcggctgggatatttcacacccgccctgtgtgcctgcggctgggatatttcacacccgccctgtgtgcgtgcggctgggatattacacacccgccctgtgtgcgtgtggctgggatatttcacacccgccctgtttgtggctgggctgggatatttcacacccaccctgtgtgtgtgcagctgggatatttcacacctgccctgtgtgcatgcggctgggatattacacactcgccctgtgtgcgtgcggctgggatatttcacaccccactctgtgtgcgtgcagctgggatatttcacacccgccctgtgtgcgtgcggctgggatatttcacacccgccccgtgtgcacgcgtctgggctgggatatttcacaccccgctctgtgtgtgtgcggctgggatatctcacaccccgctctgtgtgcgtgcggccgcggctctgatgcttttgcaggcggcattgtgtcactgattcacttaggggctctctaattagctggcggctcaatgagctgtgattgcaggtgagacacagacttgttgacggtgctgaggatctcgtgccttgaagagcgctcaaatgggctgtcacaccacgagggtgaaacagttacccaaatacagtcactggggcagcatctctgtgcacataacccagtgtgcgtttaaatggcaagctgggaagagtcaactgcatcagcttctctctaaattacgggctggaggtggcagggaggtgaggtgaaggaggtaggaaacagtgttcctaagtccgtggtcacagctggtcacgtggagagatgcccagagctcttgctgtagagtcaggaagaacagaagctcagcctggcatagaggttgggttttttgctgcccttggtttgtacacagcactaaaaatgtttctgagtttaatctacttaaatgatggaaggatatgagagaggtgagagagaaggcctgcagaagcttaggctgtgcccacaacggctctaaccaggagctctcaggggcgaggggcaggcccccaggccacggtgatcccgctcagatgctcagtcacccccgtgtaagggttcccactgccacctccttgaggtggaaggtggggtgtggagcccacgtccatcatctccctgaattcctatcgctttgacacctggaattcctctgtgctgcaggcagggtctgggcgttgtccacaatcaacactcacacaaaaacatgctccctggcttccaggcggctccagatggagagagcacacaccctccccagtgtcccttctaacaaggttgctgtgagcaccacgcccccggggttccccgcgggaaccagctctgccgggccagccggtcaactccagcacccagcacccatcatcccgtgtgctcacagtgcctcgctgctcggctaacaagcaggttggcaggtcccttttcctgactggctccttcctgattaagcagcttttaaaattccacgcaaagtgtcaacatttctagatctcttaaatgcaagagcttcccgagtgccaggcgggacctgccgcgggtgtggggctgtctgaggtgccagtcactggagacgacgctgcagatgaggcacctcccctgcagcttccccgccctttagtgacacggaaagtggaagccagacatcttggatgtagacgtgggagggagctggggtggaggcagctgggccaccccaccacccctgaaggccggccccacagcggcatctgaaccaccagccagggccactggagcccactttcctgtttgtgcagccaatggatgaagttttaaaaatttggcatatttgaactccattttttaatggggtcaggcaatgtactttgaattatttatcagactgaattcaatcttcaaaaattacagaactctcatctctctgcccaggttaaagccgggaagtggctctcgtctctctgcccaggttaagccgggaagtggccgttgtgcctgtcctgaggccgctgctgctgggtccctctgtcaggctgttcctcagttcacggaattcaggcctgatgctcacagccacactggccccggctctttctgccagacatcacaccgcagcagacaccgtccccagcctcactgccagacatcacactgcagcggacaccgtccccagcttcactgccagacaacaccccgcagcagacaccatccccagcctcactgccagacaataccccgcagcagacaccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacaataccccgcagcagacgccgtccccagcctcactgccagacatcacaccgcagcagacactgtccccactggtcctccagaccaggggtccccaacccctggggaggcgaaggagccctgcgcctctgtggggtctgagcatgctagagagagaagctgggcaaacagatggggtggacgcagcccccacgcagactctgattctgtgttccatggcggggctctgtgggcctccacccaaaggcagggctgaagctcctgctgatggggagccaggcggcctctggccaccgcctttgatgtgtgcctggaccatgtcctcatggtgcctctgctcattcatttccagctgtactcatcaaatgccacgctgtgtacccggggctgtgctgctgggcagcctcacacagttctgccaggcctcctgctgaggcacttctctgagggctggtgatagactgatgatggcaccaggtgatcccttcacccagagtctgggaccaaacagaaatgtgcagagggcagcctggcaagggggctgtgcagagggtggacatggggggatatatgcacctgtgggtgggtgcctgcaggtgggtgcctacctccaggtgtgtcccgtcggtgtgtacctgcctgcaggtgtgcccacaggtgtgtgcccacaggtgtgtgcccgcaggtgggtgcctgcctgcaagtatgtgcccataggtatgtacctgcctgcaggtgtgcatccacaagtgtgcccctgcaggtgtgtgcctgcaggtatgtgctcgtgtctgtgtcaggggcctctggggaccactctgagccacatgggggtgtttccagcaccaggagcatagtggatggcaggtggggagccaggtcagtgggaggccactaccgagaggccttgctagtttctgagcaagtcactgctccaccgggccaggggcctgcggaacacatacgaagcatgcactaccttgggggctgggaggtagcctacctggagcagatagaaagtgacctgggggaatgtcaccaggcttgggggctgtggggcctggagtaggagagcccatggccaggagggctgttgtgaacaggcggacctcgactgctctagcaggtgagggtcagggggctcttcgtgtaaaggcagaaaagggagggaagaggaggaggaccccaaaactccatgggacagctcctcccgggcatcaaggaaagtgccagcaaggaccagggaccccacgtgagaagcagcatcgctgttctggaaccctaccaggaacaagaaggtgcaagctggcttttcggaatggggcagttttcagtgcacacttgaggcagtcctggagcctgggcatggaggaagagcattaggagagagcccacggctcctggctcccggcctttggtccccgcaagggacctgagaccatttggagtctcgaggtgaatctggggcagtgagtctcttcctagactgttgcaagggccatctcgatggtccccactgtcacctgctgccaccggctgctgcaggtacccatgcacatgtcacgtgtggcccatggcgatctgtcgtatggacaggagtgtggcttaggcggtgaacttcaggctgtgtgtgtccagcatgtaggaagagctcagcacgatctttggaccgtgtgtgtccagcacgcaggaagagctcagcaaactgccctgggaagctaccttcactccacggtgctttgagtggtaaatgattgtctaacttgagatgtcagtgtgccagcgtctcagtgcagttccatctggatatgtattttatttcccctactgaattgcatggttttatttctaccacgacattttcaggcggtcgttaccaactctaaacagaggctcattctgcctgacgcgctgctgcggctgttcgttagggacaatgttatcagcaagccttgactagaaggtgaggaggcttggactttcaccatgtgacctccttctaaataataaccgtttgccgctccaaagtcctgcactggaagatgaaggtgggaagcgtgagagtggcaggggtagagttggacttgaatttagggagcccagtggctctagatgaagttggtcagctggcccacatcaccgtggagtttgctgagtgacgcgggtgttcagccacctccgctgggtgcagggtgtgctagggaggtgctgctctctggctcggccgtcattgcagccttgctttcacattttcaagtgcctctcactcagtgtcccatgcagggaggtgtccacaactggcaggaggttctccccaggtgccacgggtgctttggaggggtccctggtgggaaaagggccgttgaggtgctgggcgcccacccatggctgtgccttccccttagccagcaggccacagaagccaggagctggaatgcccgggagaggaatttggaagtagaccctcacccagcacccagaggctctgtggcagagcgatgggaaatacacaaacaacggtggggcaaagtcctccagagcaagctgagcagatgctgatgggcctgccccaaacccaggcagcatggggtgaggaagcccctcctgtgggatgcggtcgggagaagatggctgtgtgtgtgtgcctgtgtgtgtgtgcatgtgtttgtgcattgtggatgaatgtggatgtgcacgtgtgtgtacagtgtgcatgtgtgtgctcatatgtgtacacatgtacatgtgcagtaggtacagctgtgtgtacacccacacacggtgtgcacatgtgactgtgagtgcaacacgtgcagtgcatgcacaagtgtgtaaatgcatgcatacagtaggcacatgcgggtgcacacaggtaccgcatgtgcagtgtgtgtgaatgtgtgtgcagtgtgtgtgaatgtgtgactgtgtgcagtgtgtgaatgtgtgtatatgtgtatgtgtgtgcagtgtgtgtgtgcagtgtgtgaatgtgtgtggtgtgtgtgatgtgtgtgtgcaatgtgaatgtatatgtgcattttgtgaatatgtatgtgtgcactgtgtgtgaatgtgtgtgtgcaatgtgtgtgaatctgtatgtgtgcagtgtgtgaatgtgtgtatgtgtgtgaatgtgtgtgtgcagtgtgtgaatgtgtgtgcagtgtgaatgtttgcagtgtgtgtgaatgtatgtgtgtgcagtgtgtgaatgtgtgtgaatgtatgtatgtgtgtgtagtgtgtgaatgtgtgcagtgtgaatgtgtgtagtgtgtgaatgtgtatgtgtgtagtgtgtgtgaatgtgtgtgtgcagtgtgtgtatatgtgcagtgtgtgaatgtatgtgtgcgcaatgtgtgtgaatctgtgcagtgtgtgtgaatgtgtgtatgtgtgaatgtgcgtgcagtgtgtcagtgtgtgcagtgaatgtttgcagtgtgaatgtatgtgtgtgtgcagtgtgtgtgaatgtgtgtgaatgtgtgtgctgtgtgtgaatgtgtgtgtagtgtgtgcagtgtgtgaatgtgtgtatgtgtgcagtgtgtgaatgtgtgtgcagtgtgtgtgcatgtatgtgtgtgcagcgtgaatgtttgcagtgtgtgaatctgcgtgtgcagtgtgtgtgaatgtgtgtatgtgtgtgaatgtatgtatgtgtgtgtgcagtgtgtgtgaatgtgtgtatgtgtgtgcagtgaatgtttgcagtgtgtgtgaatatgtgtgcagtgtgtgtgaatgtgtgtgcagtgtgtgaatgtgtgtgcggtgtgtgtgaatgtgtgtatatgtgttgcagtgtgcatctgtgagtgtgagtgcctgtgtgtccatgcaagtgtgtatgcttgtgtctgtgtttacatcaggaaagcaggggagggaggcaggagtgaaccggggaggcctcagactttggggcagtcactgtggcctcgagggtgtgacccttaacatcccctgctggacgtaggagctcttcgtgctctgggaaccgtaggtggcctccgtgctgcagccactggcacctgggaaccaggggctcagggcggctgtggcccctcctgttgtcacagtcaccgcgggaggaggggcagaagtacggcgcagccaccacgggctttagggccaagtgagctcctagattcctccctcctgagcactaactgtgtggggaattagcttctcctgaaataacgggaagccccgtcagaatattcgaaatgcaacagacacaggtttcctaaaatcgtccgtagtgcctggagctcaggttctgagggtggctcatggcggtgccctgaagaggcttctgcatggcgtcttccacagagctgctgtgtcctggcggtgtgcatgcccagacagggacccatgtgtgctggggggagcctgcggtcccggagtgcaccctgctgttttatcctcttcgtgtgctctatggagtggacgtccacattctggctcaggatgggtggctggagtcccccaggcaccaagcctctgtctctaactggcaggggagccatcccttcccttctcacctgtgcaggacagggctcagtttgcagggagtcgctgggccctgaagcccttccttggcccatcgctgcctgtgagcccctgaggcttgggctgggtccctgccaggatcacacagttgggaatctggggaagggattgtgtctcacaagttcgtgtgctttattatttcccaggggctgttacctccctccccctgactccttgccctgtccaagctccatgtggcctggtgctcccatctttccgggagcttcttcccgctgcccggcctgcttgtctgcatgcaggccgaccctggcctctgccacctgctctctgagctgcccgtaggcagggtcttccaccttccaccatgtcctggggtgcgctgggaaagagctcgggatgggcactgttgctgacgctgacacagactcagccagtcggagcctcacgccccccttgctggataccccaggtcccatcacagtgcagcttctcagaggagtcactgtatctattgtgcccagacctcctacaagtggctctgagggctgagctgaccctggagggacaggccccctcctgcccgtctgcctcctctctcctcccctgtctctcctgagacattaggagctcacactcctgcctgaggacctgccagagtggcagggcatgctgggtcccggcctgtgcgactgatcagctttctctcctggcttctgggtcaggaggaaggagccgtctctgccagtcttccccttgtgtaggcgtggcagcgagggtgttttctggaaatgccagcctgaggcttggggtcttgccatcttcagccccacggagcgctagtggcaacagccagtttgtgtttgtgtgtgggtgtgttatgtggacggggattttaaccttactatcagcattagaatgtccgtaggataaatgtcatggttgttttgcttttgttttggggtattgtgggagtgcatactttggattctataggccctctgggctttattcaaatagactctttttctaggccttctgaagaagtcgtatccggttgtgtctctgcttctgttaaccatgatttatgaatgcatgcattactatacattactgacaaattatttataaagcaaacttttgtgtataaagtcttatttccccatggaattatttaataacatttgagctgtgtgctgagaaggtgtttttgcaggcactgatatgaaagcttttgtcaagctagctgacttgggaaggcagcctagggcggcatcctggcctgagagtcctcagcattgctaattggctttgctttgtcgtgttttaggcagcctggtgactgtactgatgtgcttctccaaaccccacagagagacagcaggcatcttgtctgctaggcatgcaggcgttctggttctcatgtgcagaatatgcacacagacgtgcacgcacatacacacaaatatgtgcatgcacacacatgtacacacaaacgcacatacatgtacaccagggacacatggacacacaaacacattcacatatgtgtacacaaagggacgcgtggacaaatacatatgtgtataccagagacacatggacacagaaacacatgcacatatgtgtactcatggacacatggacacacaaacgcacatacatgtacaccagggacacatggacacacaaacacattcacatatgtgtacacaaagggacacgtggacaaatacgtgtataccagagacacatggacacaaacacatgcacatatgtgtactcatggacacatggacacacaaacacacatacctgtacacccgggacacaaggacacacaaacacatgcatatatacatgtacacacagggacacatggacacagccatgctgctccctggtgaggagtgggagcaggtgggatccccgggaagagtgagtcccactcttgggctcttgttataaatccacctttggcagacacgccctcctctaatttcccaaggaacatgccagccgttggtgccgacggtctttggtggagcctccagagcctcctttaggcttttcccaggggctctgaggggtgtctgtgatgtcactcttccctgcagcacagcagcagctgcgggttgtgacgtgggatgagaggccgcttgccctgcccggaagggtggctctgtgccctgcatgggccacctgcttccctggctcttctccgtgtcctgcgtggcctgcctgctcccatggcccttctctgtggcctgtgcctgtggccctttagcattgtgttggttatcaaactgccatttgtcatttatttgtgcatctgccttgagcaaccttccacttccggtgtctagaagttctgctccttgtcactccatttggaaactgagctctcactcaagagacgtttgcagcatcaggcagcagaggcatcaggggtcctcacggggacatgcacaaggggtttcacaggcgttgctggtgctgctgcctcaacccgtcctgctcctgcttcctgcctccctgtaccgacgctgcacctccctcaccccactctggatcctttagttgaaatcaactcttccacattcgtctcctagccggtgtgtctacccagcacgaccacgcagtgcaggcctcgtggacagacctcgcgtggctgcaggagacttctggcttcctgggaccttgtgaaaccagatccccaaatgttcctccctaaagcttaacaatatgaacaacaaataggccaaaacaaacagatacagaagcaacaaggaaaaccctggatgccattccagcagagccaacggctggtggttgctgaaaaagcaagagaatccaccttccaggaaaggcttcagggaaggccctgaaacctctgaaatctcccccaaagctgtgactggggggcaggggaggagacacagacccttccacagaggtggtatctgatgtggtcgcccccatcctaccagaggctggatgcagaggatcagcagggcggccacccaggcagctccctccgtggagaagcacatgcacatggagtgcgtactcacagggtcgtctcgcggcgattcatagaaatttaaattaaatgcagacaacagaaaagacaagaacttaagaactggagcaggaaggaggctgatgatagcagagtgtgagacgcaccagagccctttccacgccagtcgcgcagggcaggggctgcacgtggagatgccgggggaggcgtcagcggctgattcaggacggcctgtgttcaccctggagcaggctctgcagcagacagagcggaggaaatgtggtgtgtggacgtcgggaatgctccaggagaaatcccaggtgagaaggagccggggcagccatgctgtgagctgttcttacgtgcccgcttggagattagttctatttgggtctcttaaactgtcaggctcccgcccagttatcttacctgaagcagagtaggattcaggctgcaaagtgaaaactgcctctcaagaaagccttaggtaaaaaagaatggatagaaggtagctatgatgagacccatcccactctcagctcatgtgatgagctgaggcagcgctcagaggaagagctgctgtcaccgcgaagccagggtactgtcagctgacagcaaggagcccagcaggggagggcatgggctgtggccctcaccagctcctctgcaggcgggctcacccctggcacgcacgccatccctgtgattctcatcatcagggcagttccaggtcagcgccgtggggctgggcgggggcagtcaccgccgcaggtcttggtcagtcctccaggagcggagctgcagggttggatcctttgtacagtgggtgagacccaggctgagcgaagtgggcttgaagcctgggggctcagacatttctcgctgctgcacgcttgctcacccaactgggggctcggggtcgtccagcaccacagtcctcttatcctatgattcccagagcttgagggccccccagaaggaagagcagagttccagattgaatacaggatgcctgactggattcgaatgtcagagtaacaagaaaaagacgtttagcgcacgtacagcaggtcctcaaatcacgccatctcattgtaacgctgaggagaaaagaatcagccaaatctgggatgtagactctctgaacatttggttcctgtgtaagtttttatttaaaggaaggatcctaccccagaaacacgccacaggtttctgtgatcaaacctgaggggtcgggttccgcgtctgactgcgtcctgagcagccgtgtgcccgggtctctccacacgctggtccagggcaaaccccgcctgctgacctgggtggtagacagaggatactcgaaacctctttgagcatgattctggttgtccgggtccctcattcaactccatttcaacccagatcccagggaaagcagggatctgactgggctctcagtctgccttagcaggttgtctcatgcctgttccagggaactaggggtccggaatttacaggggatcttctgaaacccaagctcccagacggcaaaaagctggtagcttgaaggaccttattcctcgttttggcagaataaactcacatccatgtttctttttgcataagtttaggttatagatagatttgattattccacaatttcttagagactatattttttgggaaaaatactcttttctactccaagaaagataaattttattacagatggtgaatcattccataaacttcctattagggctgagtttaattttaagctcgggcaaattctattgctctcaagccaccagggtagtgcatggttgtccaacatggagcttctgctgggcgcccagctgcttgagtcctgccctcttctctgccgtcatcacttgtcctcacgggagctgcctaggttcccccccgcccccgccagcttctgtctcctccaccacctttcctcaggtacctgaaccaataggtaggtcttccggggccttagtgtatttctaaaactgccaatggtccaccatctaaaactttttaaaattccacatggcgcggaccagaataatggccctgcacttgtgactggctggtgaccttgctccaagggtgcacgtgacaactcctctcagagtgaggagaagcctcggtgccctcttgtccccctcagcagaggcagccgcggggtccctgccacgtccactttcctcagccagtcggcatcagactctgagtcccaagaggtcagtccattgtgtgggggacagagcttggtccaaagctgtgcctatgggagacaacagaagaggaccatcaaagcatcgtcgtcaacactccctgcccacatcacctttgcacagagattctgcaggcaggcctcccccgaaggtcctgcagtagacacgggacatccctggatgagacagaacacacagcacctgcagggttctgatcacggcatccaaaatcaaacccgctgagaagctggagtcagcactggctctcccagcaaggggtttcctgtggcatctaagtctgaggacagaggtagttctgaggctgggtagttctgagcatcgtctggtttagaaggttttgctcagtgggtccagctggaacaggcagagaaaggtagtcaggcagtgaggacgggtgccctgaggcttagtgccaagccccagggacaggagggcccattggcctcatcagctggcgagcccagggcagccagaaaagagtggccaggagcttggtgcatggggtgggagggtgggtcagggcccagtgcaagggtgcggcggacagcacagccccagcgggaatggagtcctcgaaactgtgagactcatagtttggtaaaaacatttccaaagcatcctgaatggacagagggctcaacacccctcactccacaaaaagctacatgattgtgtaattctctgtacacacatactgtcctctgcagttccccaaatccgtgaaccacttttaatcctgaagctgtcgtgctgaggcaagttcaggttaaatttcagcaaggtggttcggccgcggatctttggtggtggagtggccgatcctcttgttccccacaggaaggcagcattccctgttccctgtggccgtggactcctgccctgggcctactttcttccagagcccggcccctggaggctgaaccaggccttttggtttcctctgtggtgtgatttgagagatgcttgtagaaacggtcagataagccccaaacatcttcctcagctgtgctcgcgtgaagtcttgcccttggtgatcttgttgggtagatcattgccttgtctgggtctttagccaaagaacctcccttgctcacacgtcgtgaagcctgcaggggcttctgcgagggagcttttgggttgctctgtgtcactcaacaccagaagacaggaacctctatacaaagaacaggtcctggacgtgggtgagcagggaagggatgtcctaggaaagacagcaggggagggacatgaatttctccttttctgcagcttcttcctgggcctgggccatgcctcgggattttccctgtaacaccatgcttcgcatttattattcgtgtccagatctattttgctatagaaagtagacatgtctaagaagtaaactgcaggatgagaaagtttaaataatttgtttcttcaggtgcaaagatgactgtcgtagtttcctgtcctgtagggaggtgaaactcatgccctctgctcctgaacgcagagagggagggctgtacatttttactgctgtgtgcagcggtggctctgtgccactgtccagttacagggatgctcctgaacgtggagatggagggcgggtcgtgccgtgggcagtggctctgtgccactgtccagttacagggatgctcctgaacgtggagatggagggcaggtcgtgccgtgggcagtggctctgtgccactgtccagttacagggatgctcctgaacgtggagatggagggcgggtcgtgccgtgggcagtggctctgtgccactgtccagttacagggatgctcctgaacgtggagatggggggcgggtcgtgccgtgggcagtggctctgtgccactgtccagttacagggatgctcctgaacgtggagatggagggcgggtcgtgccgtgggcagtggctctgtgccactgtccagttacagggatgctcctgaacgtggagatggagggcgggtcgtgccgtgggcagtggctctgtgccgctgtccagttacagggatgctcctgaacgtggagatggggggcgggttgtgctgtgggcggcagtggctctgtgccactgtccagttacagggatgctcctgaacgtggagatggagggcgggtcatgccgtgggcagtggctctgtgctgctgtccagttacagggatgctcctgaacgtggagatggagggcgggtcgtgccgtgggcagtggctctgtgctgctgtccagttacagggatgctcctgaacgtggagatggagggcgggtcgtgccgtgggcagtggctctgtgctgctgtccagttacagggatgctcctgaacgtagagatggagggcgggtcgtgccgtgggcagtggctctgtgccgccgtgcagttacagggatgcttcctctgctcgataaatatggatgccagcggctcgagaatctgttgcccagctcgacttctgcgagcctgctcttaaaaagagttattccgctcttctaatgaatcattttctcaatttccttcctcaccattagagtatttttaaagcactggacaccttgttattcaaggaagtccccagtcttgcctcgcctgtgtgccgcattctgcagattctcatggaagactcaaggccaacctgaccaccgccgaggggaggggacagattcctgtggggcgcggtcctggcctgggtttcgggagtctggcgtgtgctctggagacccggggctgcccctgccctagatggttttgcagtgggttccttgtggaagcaacaggcgcggcaatcacccggtgactggaaacggaaggttctgttgagtgcttcctcctttctacgaaatgcagcataaaacacttctgtgaaaggagcacgttgttaaaagaaacacgcgaaagtgtatttaatgggcagagccccgcccgctgtgctggccccggtcagtcctcgagtcctcaggcccccgcccgctgtgctggccccggtcagtcctccagtcctcaggcagcttcagttatgcacatccaggctcagtcgcctggaaaatgagactggcccaggtagatctggtggatctgccagtttattagaagaaaaggctcatgtatttatttaagtcctcccagcattagtgcttgacacatatttaaagcacttggctaaaaaacagattggaactgtggttgggtttggtctggacaacgaggtctggtccggggaaaccacaccctccgcatgccagcctcagttctgagtgccgtgggcatgacaggaggaacctcgggccacagggactctcactccgccagcccaagggtgagggaagattaaggtctcctttgagaaaccaggctctgctttgtgatatggggtcgttttccggcatgttaatctccccatcaatcgggggtggtgggggtggctcatgttggggaggattggatttggggagtgagaggttcgttctctggctttgcatgtgatgcggctgattgtcgggatgtgctgtgtgattttgctgcttggactcgatctaactgggctgtcagcctcctccttgggcttcagcactggggtgcctgtcacgcgtctgtgcagctggcgtggtggcttccctgaaagccaggtgcctggagatggggtggtggggccttcctaccctgtcctgtcctgccatcctttggagaaacgtgtctcttgtttgtctttggtaactggtgcagggctggggctggggggtagtgagggatagggctccgggctatcaggtccgcctggagtgctcaccaacccacacactaattcaggagcagtatgcttgggtctgcctgcctagaaaggctccattcccgctgcccagttggccgccttcatctgagccatccgaacggtgacaccactcaccaccctgggcacggggatgattccatttttcctccaagtaattggcactgagagattatgggagtggtgtggcaggagcttctgcgactgctctgattctcgccgcagaggtgatggggacgaggcagagttgtcaggccactggtgctcaagtgctctcgcgttcccacccactccaagcagctgaggcttgaggctgtgcggcaaccagagcagagttgccatggcaactggagaggcaggctgcttaggcgaaggatggatggagggaccaactttgtgtttctggtaaaatgggcgtgtcccacagacgatgaggaggccagagccaagaaggggctttgctgggacctgccctgagcctggggcaggtatgtggtggctctcgtttccctgacctccccttagggagccctgcttgtgtgtccccaacaatggaatggaggcttcaagtcacaggtccagttttacagcgtttcaggatttgcacacttactgtgctgagcatactctgggctttattaaggtgtgtgtctgtgctctatacgcatgtgaggtaatgagggggacacacacatgcatacgtgcaccatatacatccattgcacacctgtgcacaccacacgtgcaccatagacatccattgcacacctgcacacaccacacgtgcaccatagacatccattgcacacctgtgcacaccacatgtgcaccatagacatccattgcacacctgcacacgccccacatgcaccatagacatccattgcacacctgcacacaccccacaggcaccatagacatccattgcacaccccccacatgcaccatatacatccattgcacacctgcacacaccacacgtgcaccatatacatccattgcacacctgcacacaccccacatgcaccatatacatccattgcacacctgcacacgccccacatgcactgtatacatccattgcacacctgcacacgccccacatgcacacataccgcatgcacatgtatcatatccgtgcagtaaggaggacatctgatctctgctgggagaaaggcgaggttctcctcggctcaccaatgagggttccaaagcaccccagggacctcagcaggcaggacgggagcccagttctttgaccctgagcacttgttcccattctcctgaagatgagcacattattaccgtcatgctgtgtggttcttgagagcctgctaagtaacagtacgctttgtgcgtgtcccattaccctttctatgcattaggatttcatgccagcctagatagggaattgtctcctagagtctactttatgtgatttccaccgagatttccagggggctttaacttccgtacttgttacaatcaagtaaaaatgtgctcatctcactgtgcgtaatttcaccttttttcttttggaaaatttccccacaaacactttaagaataagcgaattgttaattttttctctaccagatagcaaagcatctggaattgtcttttgtggcaacatggttaggaggacacatttatgactggttgaaaatgatatgaaatagtgatagcacagtgctgctaagagtcagctgatgttgatttgaaggaatcaggactacggcgcaacattcaaacatgttttgcatcacgtcaaaaaacagacgagagagaaaccacaacaattcgggggtttgagattttgcaaagaaaatatacctgtcttataaaaatcgttgttttctatcacttctgtttctgtgtggatgtgggggggatgtgtgtgtacgtgtgtgtgtgcatatgtatggaatgtgtgtgtacatgggtgtgtacatgtatgcagaaaagcaaaacctgagtctgggttaagagcagatggagaggggatgaggatggggaggccggttcccttttgctgttctgtgcaatttctgccttgttttgataccatttcaattttcttaaataggcatgcattatgctataaatgtataacaataaataacctatatgcattagaaagaatctgaaaattatgcaacagtaggaatgagagaatatccacattcatacatcctaaaaatgagggcttaagtgtcctactttatctgagctcaggttagaggcagggaccaccccatagatccgattgtgggtcctgttgttcggctttccttgatagtataagtattttctttattataatatttccataaatatgtgaagcatttagagctgatgtaccatacttcaacaattcatctgttgctttttactttggtaagagtagaccataaatgcatctgagtgtcaagtgtaggaaactcgtgtgtgtgttgtgcatccactgagtgtccagtgtgggaaactcgtgtgtgtgtcgtgcatccaacacgtgttctctcacttgcattacactcagatgcatttatgacacaatgacactgcacgggtcgttgtgcacacacactgggggagggacgtggcgtcttgctggagcacaggagaagcagtttaaatgggaatgcattcagtgcatgtctgtcaaagttatgagtgaatgatgcttggcaatgatgtcacagagggcatctgaccgctgagataaagccctctgcagtccccaggggatggggcttttctggtcctaaagcctcactgaccataggaaacccctcttccacattttattggctgcatagacgtcacaactgggagactcatcagccaatccaactcacaggtatggtgcatgtgtgtgatgcgtgtgcatgcagggtgtgtgtgtgcaggtgtggtagatatgtgtatgtatgcatgtatggtgtgcatgtgtgtgatgcatgtgcatgcagggtgtgtgtgtgcaggtgtggtagatatgtgtatgtatgcatgtatgtatggtgtgcatgtgtgtgatgcgtgtgcatgcagggtgtgtgcgtgcaggtgtggtagatatgtgtatgtatgcatgtatgtatggtgtgcatgtgtgtgatgtgtgtgcatgcagggtgtgtgcatgcaggtgtggtagatatgcatatgtatgcatgtgtgtatggtgtgcatgtgtgtgatgcgtgtgcatgcaggatgtgtggtagatacgtgtatgtatgcatttatgtatggtgtgcatgtgtgtgatgtgtgttcgtgtgtgtgctgtgtgcacgtgtgtggtgatatgaatatgtgattcacgtgtggtgtgtgtggcatgttcatgtgtgtgtgtgatgtgtgcatatgtgtggtgtgtgtggtgtatgtgtgtgatgtgggtgcacgtgtgtggcatgtgtgcacgtgtgtttatgtatgcacatatgtgctgcatgtgtgatgtgtgcatatgtgtggtgtgcacgtgtatgtgcatgtatgtgatgtgggtgcatgtgtgtggcatgtgtgcactgtgtggtgtatatatgcacatatgtgctgcgtgtgatgcgtgcatatgtgtggtgtgtgcatgtgtatgtgcatgtatgtgacgtgggtgcatgcgtgtggcatgtgtgcacgtgtgtcatctatatgcacatatgtgatgtgtgcgatgtgcacatatgtgtgatgtgtgtgcgtgtgtaggggcatgcatgtgatgtgggtgcatgtgtgtggcgtgtgtgcacgtgtgtggtgtatatatgcacatatgtgctgtgtgggtgtgatgtgtgcatatgtgtggtgtgtgtgcgtgtgtatgtgcatgtatgtgatgtgggtccgtgtgtggcatgtgtgcactgtgtggtgtatatatgcacatatgtgatatgtgtgcatggggtgtgtgtgggagtgttttgttttgttcagtcctacacagtattttgaaaattttgaatttattgcaaacattttaagatttgaattcaagtaaatgagaaacaagcttcctggcctcagttccttcagggaaacactggctgccccttgggagggctgtgtccccacgtggtcggggtaccccactccttcctggctgcatcttggggtacgcaggtgcttgctgcatagctggcagctcagcggcttcttacaggagagctgggagaaaagcaaaggcttttctcctctgacatttgcctccagcccgatggtttgagtgtcaagacggaaggggtggggccgctcctggaaggacagcatgacccgcctggccttagtgggctctgagcaaagccccagctttaggatttcatcttagaagcttgttaaagcatcactcattctctcccattttcaaggagtctctaattctttaccctcagaaacgatgtgctgtgattttatgagacaagcctttgggatctccctaataatggggggataaaggcctccccctcccgctcctctctccaggctggggtcttgtgcgaggtatggttaagaacacagatggtaggctgggcgcggtggatcatgcctgtaatcccagcactttgggaggccaaggtgggtggatcacctgaggtgaggagttcgagaccagcctggccaacatggggaaaacccatctctactaaaattacaaagttacccaggcatggtggtgcatgcctgtaatcccacctactcaggaggctgaggcaggagaatcgcttgaacccgggaggcggagattgcagtgagccaagatcgcaccatagcactccagcctgggccacaagaatgaaactccatcttaaaaacaaacaaacaaaaaaaccgcagacacccaagtcccctttgctgtgtttgctgtgtggctggagagggagcaagttacctgtgtggagtgtttaggacggtgtctgagtggcccagtgcccagctgcccacgagccgtggacatgggcgtggtggggaagcaggggcgccgtgaagaagagcacacctgggacgggcacccctggccactccttccctttgcgcccctgtatcctttgcttagacacgcagacacggtcaagagcgccctcctccccacttccccacctcccatcacggccttctcctgtgagaccccacgtgggttggaaatctccttccagatcctggcgcctgcccccttcctccacccctcttggccagggggcgtctcagagcccagcgtgcgcctcggtgctcctggccatgctggggggtgccacccacgggccacgctctgtgtagtgagatgcaggggctatgtgcagatatggggatgggcagccgggaagcccacacctcctcattccttgaggcagcccgtgccagggatggtttctcaggctgcctaaccccatcgtgcgtcctcacacatgtctcccagcccaggcctggcatggctgcacgcttgctctgggaagctccatgcgctctatgagaagtgcgtggagatggcttctgatggcctcatcacagaaactcaacaggccgcgcattcctggtgtagcccctctcagtcctgtttgaccagctctgaagctgtcttgtgacttttcccatcgtgggtcacgtgcaccatcagtggattccggcatgaccacggattccggcatggccatgggaagcacacgcctgggggacgtcacccctggattcactgtcgtcgttgctgtcatcagagccctcccacacattggtcggccttgcctgtcagctctgtaaggttgaattagcaataaaaccatatgcttttggttgcagtcactttctgcataagtctttaaaaaggtcaaaaaggaagaaaacgcaacttctttaaaatacagattgtcctactttgaaaaatcccgtggacaaggacaatgaccacccacggtgacttgtgaaacgctcacattttcttatcgtcagcagccccagcatcctccttctcccgtgtgggacttcctgtcctgtggaccacacggagttagagctgggggcagtgagagccgtcttcttccttcttggtagagagacgcgtctcgactccaaatctttaagcctctgtttctctctccatctctcacctcccaggatgtctttggtcaccaggagacccacccattacgctgccatttccataacatggatttttccccctcttccttcaagtgatgagttttttcaagtgataattttattcatgtggggtatttatattttgccgtatgtgccgagaagcttacgagaaaggtgtattttaaataaatcaaattatcaatcaatcaatcaatcaattagtgaatgcagcctggcccagaatattcatttttaatgaattttggtttcacacaatcctgggtcatccctggagggtaacatcatgcggtgtttattgtcgcaggtggggagggcaccctgacggtctcgctgctgccaaccaggccctgatttgtgtctcagtgactgaaagttagtagggtaagagcagctttccagtgtgcctgcgagccagactgatgtccagctccatgcctgtgagtcagcagccccatgcctgtgagtcagcatagggataaccatggcaccggggttggcggatagcatggtggccacgcacaagcgacctactgtgtgccggccctgagccggctgcttccacatccccactcacctgttcacacagccacgtcatgagacgctgtgcctgactcctggggaaactgccagaggggcctagaaggcagctcccatccatgcgaatttggatgtgcagagttgcctttgtatcaacccaaacaaacccagtctggaaaactccctccacctagtaatggatcagggtgcaggtcccactctcggcaaggagacctgactctacgtcaagaggtcggctcggatgaaaggcccctggtttgactcaggccagggcggcccatgcgctctatgagaagtgcgtggagatggcttctgatggcctcatcactgaaactcaacaggccgcgcattcctggtgcagcccctctcagtcccgtttgaccagctctgaagctgtcttgtgacttttcccatcgtgggtcacgtgcaccatcagtggattccggcatgaccacggattctggcatgaccacggattctggcatggccatgggttccggcatgaccgtggattccagcatgaccacggattccggcatggccatgggttccggcatgaccgtggattccagcatgaccacggattccggcatggccatggattccggcatggccacggattctggcatgaccacggattccggcatgaccatggatgtcagcctctgtgctgaccacgctgcagatgcagggctggacgcctcatctcatttcatgcccaccgccgcctcacgaggccatcctcaagacgacgtcacttgtccacatgacacagccagggagcaggggcttcgaactgctggcctcgctcaggcctgtcgcttctcccacggcccccaccccggggcactggggctctgtcacactgggagacactgagctcagagaaaaagtttaatattttatataacacacgccccccatacactcacatgtgcacaactcacactcatacacactctcacacacaactcacactcacacaactcacacacacccacacatactctgacgctaaccacacaactcacacacacacacactttcactctaacacaactcacaaccacacacactcacaacttacacagcttacagaactcacacaactgacacacaaaacaatcacaagtcagctcacacaaaacacatacatagcttgtacacacaactcagacaaaactcacgctcacacactcattttcacacaaaacacacacaaaaaacatgctcattcacacacaccctcacacacagctcacacaaaaactcataaacactcatagcttatgcacagctcacacacaaaacacgctcattcacactcacgcaaaacacacagctcactgtctacagacactctgtgtatctgttcctttttcatgaatacctgaaaggtgtgtttttgaggcttgttcagcctttttcttcaggacactgccttgacctttcaccttttaatttgcgtttccaacttctgtgctactaccccctctgaagcattaatgggaaggtcagtttcctgcacttctgagtgaagaagcaggagctagctggaaggacttcagagcctggcctttcccttctggctgagcaggaaccaccatggaagtcctgggggaaggaggcagcttgttctcttcccagggactgggtgctgcattggtggtcagtggggaaaatgggccacattgtgaggaaggagggaggacaggaagtgatgtcagtgactcggggtgggagggatcagcactaagtagagactgttgcttaggaggtattagatacgaagtagggactgtgacttaggaagtacttagtatttagcagtacttagaactaagcaaagactgctacttaggaggtagtttgtaattatcattaatagtactttgtactaaacagactgctatttaggaggtacttagtgcttagcagtagttagtactaagtagacactgatacttaggagatatatagtagtgactagtgcttagtacttagcagagactatgactcaggaggtacctagtactaagcagagactacaacttaggaggtacttagtacttagcactaagtagagactactgccaaggagcagagcctgctctctgtgtggatggatctggtttgtaggatgttgcttcttccaaatcaacctttgtgggcttcctgcagctcctggccaactctgaaggtggtatctgtggtggagtttggctgggacagcgttctggggtccacagaaccatctggaaaacacgagtaaccatctctccactgagcatttcttctcatgaaaccagacagatctttttttcctctcactacagtgaccagacttttaaaccacaatgtccaggctgttgtgctcacatgggaatcatttttactagggttgggcaagagaaacaaggtgagaagtgccagtgtgaagcagtgaaatggtctgctcctcttgcattgattaattttgggagagaagactttctttgcctcttttcagctctgagtctggtatatggaaatgaaagctttcctgctttcctgctgtgtctgctctgatcacaggttgaggctgaagtgaaggcgtctgtgctttctagctggaatcttctcactccagcttcctgggttagcttattttgttttctaatcaacctaacattacaccccaaggcactaggaaatgaagaacaaactaagcccaaagttagtggaaggaaggaaataacaatgattagagaagaaacaagtcaaatagcctagaaaaacaataggaaagatcatcaaaattgggagttgttttgttgaaaagacacaaaatggacagatcttcagctagactgagaaatgagagaagactcaaataaatagaatcagaaatgaaagaagaggcgttacaatggataccacagaaacaccaagggtcatgagaccactgtggacatttatacgccaagacattggacaatctggaagaaatggagcccttcctagacacatacaacctaccaagactgaatcatgaagaaacagaaaaacagactgtaacgagtaaggagattgaatcagtaataaaatgtctcagccaaaataatgcccacgaacggatgttttcattgctgaatcctaccagacacttccagaagaactaatacccatcttctcaaactcttccaaaacactgaagaggaggaaacacttccaaacagattttacgaggccatcattaccctgatgccaaagccagacaaacactccagggaaagaagactacaggccagtattcccgacgaacacagatgttttctgaaaggagttgaactttgtgaattccctccctcactcttggccactgattgcaatctttagaggagattctcatcttttgaatctctccactttgcagacacgcttttgatttagaattctctctaattgaaaagaagcggaactaagaggttggagaagtccatgcctaggcaggtggaaagtggagcttgagatagaagactggagatggaaatgaaaataaacgatgggagaggaaggtgcagaggacggggcggggaggaggttgtactggaaactttaggttcagctcctttccctccagggatgaatggttacaggctgggctcttgggctgctaggagccactagcatggctctaccgggtgggtgaacctgccttataggccaagtcagagtcagttaagatttggacaataacagaagcaagcaaacaaggctccacagcaaaagcaaagctagtttagtgaagataaggacccctcggtttgcgactgtgctgtctagaaatatgggcctgagggggtttcagatggcagctttggtagagctgtggtctcccttctccaggaccatatgcactttgtgggaacattcgagccatctgtatcatttccttgacttaaaaaaggtcccaagatgttttcttactcagtgatcatttggggaggacctcagagctgtgattaggagaacggggagctgtagaacgttagctgtaaaatcaatcataagattcaggtaggatatgagaaaacagaacagaacactgcctcctttcctggtatgcccaaaacagggcgtgaacacttcagaaaacaatgtcttcagagctgaatttgggtgtgatgattcgtactttaaagtctgtgtcaggggaagtgaaggatttttttaaaatttaaatttaaattttatttatttattaattctttttttgagatagagtcttactctgtcacccaggctggaatgcagtggtgtgatcttggctcactgcaacctttgcctcctgggttcaagccattctcctgcctcaacctcctgggtagctgggattacaggcacctgccatcatgcccggctaattttgtattttttgtagagatagggttttgccatgttggccaggctggtcttgaactcctaacctcaggtgatcctcccccttggcctcccaaaatgctaggattacaggtgtaagccaccacgcccggccgaaagtgaaggattctaattaaagtccgtcagcaaatatgttatgaaaggaaactatagccgaactggagaaagggaagagtcacctggtaactgaaggaatttctaaaatgggttaaccaagaacactttgatgcttccaccatgaagctggaactggatgctggctggcccaagaccatgatccacgttcacagggggccctgggcctgagggcacctgcccacggggctgccttggggcatctttattcagaagtgggctcctgacatggttcctgggcaccacagcagaggcctctgcctggaaagccaggctcagcttctgcttccacttcctgtccacaaacagtttgatggccttagactgagaattgtatctcaattattcaatgatgtttttcttctttgctgttagcaaaatatgcctccccattgaatcaatattaagatctagcaagggtaaagttcgaaggaagccttttgccattagaaagaccaaacacctgcccaggcacagtggccacacctgtaatcccagcactttgggagtcccaggcaggtgaatcacctgaggtcaggagttcaagaccaacctggccaacatggtgaaaccctgtctctactaaaaatacaaaaattagccgggtgtggtggcacacacctataatcccatctacttgggaggccgaggcaggagaatcacttgaccccaggaggcagtggttgcactgagctgagatcacgctactgcactccagcctgggcgacagagtgagagtccatctcgaaagaaaacaaaaacaaaacaaaagcccacacacctggtctttctgctgtggcaggctgtcctggtcgtattcgaggtctggactaatattgggtagtattcttttccttccctatcttcctctgcatttttatttaaaagactaatgtgctagttttatgttcttttggctttctctctctctctctcttttttggtatattccccattgttttactgagacctgttaataggagagagaaattaaattatactaagccaacttcctccacacttatcaaaaagataaaaatggccatcctaagaaacaaagacactgcttgttccatcaaataatgcacataagccccaagtgcccgtctgacctgcctggaggttccagtggtatttttctccctctctctcctttaactagtaggagaggcgctggaggccacctcccctcctttcctttatgcttgggattatagctcacttcgccagttcccactcttagtctgtgtattgcccgcaccacaccctcaacgtgtcatctacgttcccttcatccacctgctcagatccgtgattgtttatagcatcctccagtgccccggccaggattagcaaggatttcgtgacccaatgggcgtggaggaagcgtggctttctttcatttcaccaggaaatgactgacgtcttgtcttggcgtgcatccagatgtgggaagtgcagcgttgcttgataacagaatcttattttgtgcagcttcccaggcactgaagcggggctgctgggagaagggcgtgaagtggtgtgacatcatttgatgtgtccttgagctccgagaggagaagcttttgatggtggcgagtgcagtggcaggggccgcagggatgcagacaaagccacgtccccattggtcctgctgctgtgagaatggggaggaaagtgactgcacaccctctggaaccttctgacggccaggggactttgaatagtttgccccacacggcaggagggtgggggccgcgctacggagcgttggcttgtggactgaaacaaagcgccccaggaaagaacaagctccgggataccagctccgggctccttgctggctgcaacttgaacgtggtctgagagtcttggttagagctggaggtcgcgtctgctccaacagagagaactgctgactcttccctgcacagagagacagtgccccaaggggaatagctgacgggttttaccctcctgaggtttctgcaccatcctgctgtttggaaaaggcgcagaggaacatcgaccctctggctggcctcagagaaggccctcggtcctcagggcatggtggtggcccccaccccggggtgatgggggctgtggcaccttgaccgagcaaacaccaggctcgggtggcagctgcctgcctggctttccgctcccctccacggccctcacgagagcctctgaggccagcaccctcttctccattcaggagtctggggagccgcgtggcttagcataggccagcctgtcctgggggcgtcctgggggctgcgtggccttcacacctctgctctcacctctgcccttgtagccaccgtgtcagggtccctggttttgtctcccttcatggggccttgttgctccagacttgcaggggagtcctccttgctgtacctaccaggacctggtctgcccctcaggactgaatccgtcggtccctggaatcctgctgagctgtcatgacctagagccagtcccaggtcccaggagcctctgtccgtgtggagctgcgacccgtgcttcctgggcacccacttcttaataacatgacctgggaagttcccgtttaagacaaggaaagtaaagcatcctggagcaatggttaacaagacctgaatctaaaataaaataagttccaacaaacatgatgttttgggtgatacagaaaccgtgaatgtggctggattaagagggacagtggctgagggcggaagaaaggtttctgatgagcggcagagaccagaagccttgctgtggcttccttccttcctgtgccccgcgtctcgcctgctgtgcttttggtgccacccacaccccccgctttattttatagtaactggcaggacctgcttggcccagggcaggagggaggggaggacggtttcctgatctgcgatggccatcaggtgtgctgggctcctctccaggcccagctgtagggagggatgccccccagagctgagcttttcccctgtggaccctctggcctttcctcccagccaagcccagggcgtccttttccaatcagagccggacacgggcgtgacttagcgacttagccgccccgagaggcaggacggggcggacgttcccagcaggaggccgcggctgcactgtggagattgtgtgtgtgccccagccctgccggaacagctggcctccagggacgtcgggagcagccagcacaggtgtggccacagaaatcacagacacttgtgtcctgtgtgtatctccatggcagccgccgggctgcgggcaactcctgcaggctctgtgctgagctcagcgtgagggaagggtgtccttcgtgcactcccatgtaagcgctgtgtctgccggggggtgttcagaaagagggggagcaggaaacgagaagccagcatcagtgcaatggcagcatgggtggcggcgaagtggcagagtgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgtgggtgtttctcgaagagggggatgtgtcagggtcacaagacaattgtggggagagggtcagcagacaaacatgtgaacaaaggtctttgcatcatagacaatgtaaaggattaagtgctgtgcttttagatatgcatacacataaacatctcagtgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccctcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcctgcaccgcccttaatccattcaactctgagttgacacagcacatgtttcacagagcacggggttgggggtaaggtcatagattaacagaatctcaaggcagaagaatttttcttagtacataacaaaatggagtctcctatgtctacttctttctacacagacacagtaacaatctgatctctcttgcttttccccacagcagagtggtcgggcagggacaggttctacctggtaacagagtggctgggtggggacgggttccaccaggtaactgggtgaccaggcggggacaggttgcaccgggtaactgggtaactggggggccaggcagggacaggttccactggccctgtggggagtcccactgagtgccatcacgtcttcacggcggctccatgaagacatacttgaggcatctcgaggctcacagctggtgcatgtcagactgggatcagactgtgtgcccccaccccacagacgccagggcagaccccaccttcgggcagctttgcttgaggttctgagggcccagggcccaggcagccttacccacccctcaacgtttgtctggtgtggcttctgaatgagcacggtggctagaggggtggcctgcgtgaagtttttccttcatgccccaagggagcacaagcggccctacctagatctgaggaggagaagggagaggagaagctggggctcctctgaagacattgcctgcctgtgtggcaggcaccacgtagcaatgtcagcagcatcttcatttagccaagcgtttccacaccatcccctaacgtaccgtaaggggctctgtttgcgatgaccagagatgacggccagcaatggcaaggacgatggtgatggtgcctgggatctactcacagctcacccagccccttcaacaacgctgtgggctctgcactgtcgtccttgggggagttctgggattctccttcttcagtcaccctgcagtttcccccacgacgtctccgtgtcctagaatgctaagcagcccgtaatggtggttttgggaggtgtggtcacaccggctgcttcctgcttgttgtggaggtgccgagtgtagaaaaatgggctctctagaaagcttttctatattgatacagaatcgatgtacatattttcagggtacatgtgataatttaataccattgtataatttgtaaagatcaaatcagggtgattgggatcttcacctaaaatattcatcttttctttgtgccaggaacagtcaagctgttctcttttggctaatttgaaacatacatacattattgttaactctagtcaccctgttgatctatcaaacactaggttttatttcttctgtctatttgtagccattagtcaatgtctctccttccttcctcccagctccccttcccatcctctggtaaccaccaatctcaacggaggcaccctcatgagatccatttgttagctcccacatatgagtgagaacatgcagtatttgtctttctatgtttggcttatttcacttcacataatgacttccagtttcccatgttggtgcctatgacaggcttgcacccttttttatggcagaatactattccattgtgtatatattctgcattttctatatccattcatccattgatggacacttaggtcgactccatatttttgctattgtgactagtcctgcaataaacacaggcatgcagatatctctttgatatattgatttcctttcttttggatacaaacccggtagtggaatttctggatcatatgttagttctagtttcacttttttctgagcaacctccatactattctctatagtggctgcgctaatttacattcccacccacagtgtccgagggctcctctccacatccgtgccagccatttgttattttctgtcttttcaataagagccattttgggccaggcccggtggctcatgcctgtaatcccatcactttgggaggctgaggcaggcagatcatgaggtcaggagatcgagaccagcctggccaacatggtgaaaccccgtctctactaaaaatacaaaaaattagccgggtgtggtggcaggtgcctgtaatcccagctactcgggaggctgaggcaggagaatcgcttgaatccaggaggtggaggttgcagtgagcggagattgtgccattgcactccagcctgggagacagagcaagactccgtctcaaaagaaaaaaaaagccattttaacgggagtgggatgatatctcattgtgattttgatttgtatttctctgatgactatatctgttggccatttgtaagtttttatttgatgactatatctgtttaccacctatatgtttttatttgatgactatacctgttggccatttgtatgtttttatttgatgactatacctgttggccatttgtatgtttttatttgatgactatatctgttttaccatttgtatgtttttatttgatgactatatctgttggccatttgtatgtttttatttgatgactatatctgtttaccatttgtgtgtttttatttgatgactatatctgttggccatttgtgtgtttttatttgatgactatatctgtttgccatttgtatgtttttatttgatgactgtacctgttggccatttatatgtttttatttgaaaaatgtctattcagatcttttgcccatttttaaattagaggtttgttttttttttgctgttgagtgttttgagctctttatatattctggttattaatcccttgtcagatggatcgtttacatatattttctccattctgtgggttgtttcttcacttttttgtttcctttgctgtgcagaagccttttagcttgatgtgatctcattttatctttatttgctttggttatctgtgcttttgaggccttaccaaaaaaatctttgccctgatcaatgtcctggagtgtttccttagtgttttcttttagcggtttcatagtttcgggtcttatatttaagcctttaatccattttgattcgatttttgtatatggtgagacataggagtcttgtttcattcttctgtgtatggaaatccagttttctcagcaacatttattgaagagattgtcctttccccaatatctgctcttggtgcctttgtgaaaaatgagttggttataaacgtgtgaatttatacctggattctctattctgttccattggtctgtgtgtctgtttttatgccagtactatgcttatttggatactatagctttgaagcatatttcgaagtcaggtcatatgagacctccatgtttgttatttttgctcaggattgctttgggtatttggggtcttttgtgagcttatgtaaattttagagatttttctttctgtgaagagtgtcattggcattttgatagggactacactgatgtctacagccatgcccaccctgaacaagccccatctcatctaatagggactgcattgaatctgtcaattgctttgggtagtatcgacattttaacagtattagttatttggatacatgagcatggaatatctttccagttttttgtgtcgtcttcaattgttttcttcagtgttgtatcgttttccttgtatagatcttttacttctttggttaaattaatttctaggtatcttatattatgtttagctattggaaatagggttactttattgttttttagattgtttgctgttggcatatataaatgctgctgatttttgtatgttgattttgtatcctgcaactttactgaatttgtcagttctgacagtgttttgaagtctttggtgttttataaatatgataagatcatgatgtctgcaaataaggctaatttgactttttcctttccaatttgggtgcctgtatttctttctcttgcctaattgctgtggtcaggacttcagtgctatgttgtataaaaatggtgaaagtgaacatccttgtcttgctccaaatgttagagaaaaggctttcagtgtttccccattcattatggtgttagctgtggatttgtcatatatagcgtttattattttgaggtatgttctttctatacccattttgatgagtgttttatcataaagggatgttgaattttatcaaatgcttttttagcatctattgaaatgatcatgtagttttgttcttaattctgttaatgtgatgtattatgtttattgatatgcatattttgaatcgtcattgtatccctgggatgaatcccactcgatcatgttgaatgatctttttaatgtgttcttgaattcagtttgctaatattttgttgaagatttttgtgtctatgcctatagtcctcctttttttttgtcttgtcttttcagcttttggtttcagggtaacactgacctcatagaatgagtttggaggtattccctcctcttcaattttttgaagagtttgagtagaattggtattatttcttcaaatgtttggtagaattcatcagtgaaggcatcaggtcctgggcttttctttgatggtaaatttttttattatggctttgatctaattacttgttattggtttgttgaagttttctatttcttcatggttcaatcttggtagtgtccaggaatgtacctatttcttctaggttttcccatttcttagcatgcagttgtttataattgtctctaatgatcctttttattcctgtgatctgagttgttacatctcctttttcatttctgactttatttatttggatcttctttccttttttcttagtctagctaaaggtttgtcaattttgtttaccttttcaaaaaactttttgttttattgatttttctgtatattttatcttaatttcatttatttctgctctgatttgtattatttctttccttctactcattttaggtttggcttgttcttgctttccttggtccttgaggtgcatggttaggttgtttatttgaagtctttctatgtttttgatgtaggcatttattattatacacttgcctcttagtattgcttttattgtatcccatagattgtagtatatttcaattttcatttgtttcaagacatttttaaatttccttcttaacttcttcattgactcattggccatttagaaggaggtttaattcccatgtgtttatgtagtttctggggttcttcttgttattgatttctagttttagtctatggtggtcagaaaagatacttgatatgatttctgctgctttgaatttgttgagacttgttttgtggcctaagatgtggtgtattctggagagtgcttcatgctctgatgaaaagaatgggtattctgtagcagtcgggtgaaatgatataaatgtcagtcaagcctatttggtgtagtgtatagtttaactctaaagtttctttgttgatttcttgcctgaatgatctgtccattactgagaatggggtgttgaagtgccctgccattattgtattgcgggctatctcttcctttggatctattaatgtctgttttatatacttcagtgttccattgttgggtgcatatatatttataattttatatcctcttgctgattgacccttttatcactatatagtgatgttctttgttgctttttgcagtctttgacttgcagtctattttatctgatataagcacagccgcttctgcccatttttggtttccacttgcatggaatatcttttttgttgtttctgagacagggtcacattctcttatctcagctgagtgcagtggtgtgatcatggctcactgcaggcttgaccttccatgctcaagtgatcctcccacctcagcatcccaagtagctgagaccacaggcacatgccaccatgcccggctaatttttgatttttttatagagatggagtctcactgtattgcccaggctggccttgaactcccagacacaagcaattctctcaacttggcctgtcaaagtgctgagattacaggtgtgagcctctgtgcccagcctgaaatatatttttctattcctttcagtcaatgtccatctttatagatatggctggtttattgtgggcagcttatagttgggtcttaattctttatccatacagccattctatatcttttaattggagaattgagtacatttaaattcaatgttattattgatgagtaaggactgactactgctattttgtttgttttttcattgttttgtaactcctcattcttgttgccttgcttgctttctgtcttactttgtggtaaagtgattttctctgctagtatgttttaattcattgctttttatttttagtgcatgtgttacagtttttttttattgtagttgccatgagacttataaaaaacaacttaaacatataacaagttatcttaaagagataactgagatcacaaaagaatagaaacaaagaaaaaaatgaaaaaaaacccctctgtattttaagtccatccccccacactttgacttcctattgtctcaatctacatatttgtatgctgcctatctcttaataggttgctgcagctattattgtttttgacagatttgtcttttgggcttcattctacggttatgagtggattgcaccccacaattacagtattggagtattctgggttagtttgagtgcttacttttaccggtgtgttttataccttcaaatattttctttttgcatgttacttttttttctttcagactgaagaactctctttagcatgatttgtaacacaggactagtagtggtgaattatctcagcttttgtttgtatgggtaagactttatctctcctttatagttgaaggaatgctttgctggatatagtattcttgggtgacaggtttttcatttttttctccttccagcactttgcaaatgtcatcctactctctcctggcctgtatggtttctgttgagtagttggttgccagacaaatgagagctgctttaaatattccttgcttcttttctcttgctgcttttaggatctctctttgtccttgacttttgagagtttgattattatatgccttacagtagtcttatttgggtcaaatctgtttggtgttctctgaccttcctgtacctagatgtttatgtctttctcaagttttgagaagttttctgttattgtttctttgagtaagctttctaccccttgttcttgctcagcttccccttgaacatcaatcattcttatatttgatgttttgaggtaattttctgtcttgcaagtggtcttcatccctcttcattctttgttctttttccatccctgattgtgtattttcaaatagcctgtctttgagctcactgattccttcctctgcttgatccattctgcttttgagaggctataatgaatttttcagttcagcaaatgtatttctcagttccaagatttctgtttgaatttttaaaaattgtttcaatctctttgttaaatttctgaattgcttttctgtgttatcttggaaatcactgagtttccttaaaactgctattttgaattcttggtccgagaactcacatattgccatcttattagggccaattgctagttccttactttgtccatttgagaaggccatggtttcccatttgctgctgtttcttgttgatgtgtgtctgtgtccttgcactgaaggattatttatttactccagtcttgtctcctggcttgttttagtttttattggatacatttgcttagagagtcacataatttacctgtggaatttctttttctcccccttctaggtccctgtctccttttcggcactagatggcaccttaagcccaggtttaccttggctctggttaaagatctgagtgctgcctgtactgaaggttaaagatctgagtgctgcctgtactgaatgggagaggtctcaaaggggatatgccagcagtgtgagaaggctggctggggcctcgtgctgaggggacctgtggagcattcctgctacagggtggtgctgtgagcagccactctgatggagtgcctctttgaccgagttgcagagtagagtttgtggggctggggactatagtcccacctcccccttttatctctggctgtcctcagggatgtttcccttcacacatttgcagcgcttcccatgggttgaagcaggaacaggtctccagccagggcccccaagaggttggagaagctgattgtccacctcaccctcactttttccagcatagaagctatgagttgaggggaaatttcccatactcttgatgccaaacagattatgaggagggatggtgcagacatggtggtctgatgcttttgctgtctgcttggggtgttttcaattttctgtgttcctgggaactgtctccttttgtatttgagtgtgtggccattgctgggattgtgtcagtgctgtgtgtgtttttgcttctctgtggagcagagtgaagtcaccttgcttctactgcaccaccattttgggaccagaagtccctcctagtagaaatttccaacaggtgtagtggaatatgaaatgtatctggagaaaatattttcttttcaaaaatttcaccttggaaagcttctgatgttgctcagaaaagtttaaaattcttctttgggatcttccttcagtaacctggtagagggcgatctctgaacattctcagtaatggtgactcttctttttgaaggcagatgcatgaggatgtggcataaagttagttgataccaggtgggataaataagttatttgcatcccagtcattgactaagttgattgtcacactgttttcaatgtaaaagtgaagtgtgaacatataacaacaagactgatttattgtctggtttctaaactgtctttgtaaatgtgttccaaagagacataaaatatcaccaacaatgctaccacctttgaatacgcatagagctttttaatgtcttgaatgtataggttccatttctatttgatatacatgtaaagccttaactactttatagaaatgctttgcatttttccagggattgtgaaaatgtgagttaaaaccatgtcaaggagtctgtgctggccctgaccaggcctgggacaggcacccccactgtgcacagttgagcagcccaggaatggaactatgaccctgtcttctctgattgggaaggagagcccacctgatccctttaattgacttcacgtcatcttcttaaggagtgtttcctctcagttcacaaagcctacaggcttcctgcatgggatcatccttcacactctgctcaccagccctttccttgctgatgcgagggcaagctgcacattcatcttccgtaaagagcattttgagcatgagtttactgctgattagagtgccactgtatttttttatatagtcgtgaattctactcataaaatctagatcctgcaatgtgctgaccaccgcctttccccgacacttcttcctcgccacctggggtcttcccgtcacacgtcaggggctcctcctcagccccatttcaaccctgaccacgttcatattttgaaatcagcctctcatttacagctttcctgtaggcaaaataaaatgctaatagatttcatttctgattcttatcactctgatttatctctcagtattaccgcgtttgaaatgaataccgcctctctctcacccttgaagctctctcttctcctggctcctgagcacatgaccttgggctgtctgtctttattgtcgattttgctcctctgctcagcacctcttttttattgtttttctcctaaaacagatggaggatctatcccatcctctttactttgacagattttctactgttccattttctcacaccttctcccaactgacctccctcctcccatttatccacgcacagtgcactctctgatgagtagctctgaggcctccattcgtcctgtgacccagggtcctctcctggagctggtgccactggagcctagcttggcagtcagtcatcttcagcttcacccccaaacctttgcatctctgttcctcagcctggctccctcctccctccaaacagcctgtcgcctggatccagtgtgtttgaaactgcaagccacagcccattaatgaccctgagagagttttagggtgttgcagccagaaattttaaaaagtgagacagaagagaataaatatgatataataggacacagtgatacgtgagaggctcccacgcgattagggtaagtgctgtgttgtgggacttccccaggtctcacttcaagatgcatatcttactcttggataccaccggaaaaaaaaaaaaaaaaaagggaagcgctgtcttcgttcctcatatgcagcgtgcaccttggtttctgtccttgctatgcccttgcctgcttaagtgttgacgtgttgcatgcaagccgggaccaccatgcacgctgccaccacttgctctgccgcctccgtttccctctcagcagtctgtccctggcattctccacctgcccctcccacggggatctcctctgccacacagttcagcctgcagaagaaacaaacgtcgtccccacccacaaacctggtgtgttcccagccttccttctttgtgatttcctcttccccagtgacctagccaacctctcttgcagttaaccttgacaccttgttctcctttaatcctgcatatactgattatttttaccaattctgcttctcaaactatccacactagtgttctctgagtttacaaccttatcatctctctaatgaaccgtttttgtaactcttattgaatgccttcccttctccctattatctttaattcattattcacaaatcctgaggattaaaataggaaggacttagaatagtgctggctcatagttaaggctcagcaaatagaaactgctatgtatctttaaatttttaattttaatattgttacttttatcctccttctgggacacagttggatgatatttctgtccgatgcagagcttttactgctccccactgtgcacagatgcaccggtgcttcctgatgtagctttgacgtcctcctgtgactatgcaactcccctccctctgttcctgcactgcccccacctccctccccatgtcatacaccatcccctgagtgcaccactcagtgccacagccccaagtcccttcccatgctactccgttatcttagagttcctcccctaatccatccccacctgttagaattctatttatctttccagtcttagttcaaataccacttgtttctatgaaactttcttaactttccaacacaaattcacctcttcatttctctattcccttagcagtttgctcataactttattatataatgattgcactccaacttggatcttagctaattacgtacctgcattccacactagactgcaaacttgaggaagatgggtgctgtggctgccctcaaaccgtatgtgcctcccataggacacaagagttggttatgcaggtgttgtctagatgaaattatatagcatctatccttcttgaattggctttttgcctcagcacagttccggggagattcagcgaggctgtggtgtgtactaatcgttctttccttcataaccaagtggtgctccgtggtgcagaggtgctgcatggtaaccatccacctgctgagggactcggtggttcccagtttggggctattctaaataaaactggtgaacattcatacacaagattttgtttgaacataagtcttcatttctttgggatgaatggtcaggggttcaatttttgtgtcttatgataagtatatgtttagtttttaaaggaactctcaaaccattttccagaacaaaatttgacattcacagtaaaaaagaaaaaaaaaagtaacagtgatacagtttttctgaatccaaatcctttccagcatttgatgttgtccctattttttattttagcctttctgataggtgtgtggtggcatctcattgtgggtgtaattgacatttccctgatgagatgatggtcagcatctcttcgtgtggttatttgccatcagtagatcctctttgtcgaaatgtcttttcatctctcaccctttttctaattgaatgtttttaatgtttagttttgagagttctgtgtatattcctgatactagtcctttgtcagatacgtggtttgccaatatttctccaactctgcgctcattgtttcagctcttaagagggcctttccacagagcaaaagtttttaattttgatgaaggccaatttgtcaatttttctttttatggaagatgtttgatgtcaagtctaagaactttttgcctagctctagcttccaaagattttctgttgtttttttctaaaagttttatagttttgcatttttacatttatgtccatgagttgcttttgtgtagactgtgaagcttacatagaggttcctgtttttgcctgtggatgtccaatcactccaggaccatttgttgaaaaggcaaattttcctaccattaaattgtttatgcatctttgtcaaaaataacttggacatatttttatggatctatttctgggttttctattctattgtattatttgtatctgttcatcagtactacacagtcttgattattgtacctatataagacttgaaattatatatgatcactccttccactttatttttattttcccaaattgttttagctactctagttcctttgctcttccatataacttgcttttctgtatctacaaagtatttccctgggattttttataggaattatgtgaaacctctgtatcaatctggggagagttgacatcattattatgttgaatcttctgatctaccaacatggtatgtctgtcatttattttgatctttggtttctttcatcaccattgtttgtgtttcagcacataggtcctgtacgtggtttgttaaatttacacctaggtattctttgagtggttttaaatagtattttaatttcagttttcatgccttcattgttagtatatagtacaagaacttattaggtttgagaggtttttatattttttgtagagtccttggggctttctgtgtagataatcaggaaataggacataggtacagtttaatttcttcctttgtgtctgcatatcttttattttttttttatcttgccctattgcactggctggaacttccagctttatgttgaataagattggtgagagcaaacatccttgctttgttcctagtcttcagtgaaagcttttgatggttactcaccattaagtacagtgaaatgtggggttttgtagatgtttattgttagcttgataaagtgccccttgatttctatttttctgaaagttttcttcatgaatgagtgttgaattttttaaatgtcttttctgcatcgattgctgtaatcatgtgatttttttcttctttagcctattaatatggtggattacattgatttgttttgaaatagtgaaccagcctttcattcctggaataaacctcatgatgtatcattattttcatatattgctggattttatttgctaatattttgtaaaggatttttgtgtctacatttgtgagggattttggtctgtaggtttctttttactgtctttgtttgcttttggtatcgggttaatattagctacataaaataaattgggaactgtttcctcgccttctattttctggaagatatttatggaatttgttttaattcctctttaaatgtttggtataattctttggtgaaaccatctgggcctgattatttctttctgggtagatatttaattattaattcaagttccttaatagtgtagaagtattcaaattattgatttcacattggatgaattgaggtaacttgtggatttcaaggagtcgatccatttcatctatgttgtcaggtttatgtgtgtagagttgtttattccctgattatccttttgatgtttgcagagtctgtagtgacttcccctgtttctttgcttatattgataatttgtgtcttctctcttgttttttgttagtcttgatagagatttgtcaattttactgatttttttcaaggaaccagctttcattgtcatttatcttctctatttttttctcacttaaattacattgatttcttttcttatccttattatttattttcttctactttatttgggtttattgtgttctcctttattacagattcttaaagaattcagattattgatttgagactttctcttttatttttcttttgacttttgttttcggtttgagggtacatatgcatgggtgaattgtgtgttgttacagtttggtgtgataacaatcctgccacccaggtagtgaacctagtcccttatagcttttcaacccacgtcttcctcccaccctctgcctttcatagtcctcggcgtctgtcatcctcatttttgtgtctgtgtgtactccgtgtttagtttccacttataagtgagaacacgcagtatttggttttctgttcctatattaatttgattaggatgatggcctacagctgcatctatgttgctgcaaaggacatgatttcattatttttatggctgtgtagtattccatggtgtatgtgtaccgtattttctttttccagtccatcatcagtgggtatctaggttgattccatgtctttgctattgtgaataataccgtgatgaatgtacaggtgcttgtgtctttttggtaggatgatttattttcctttggctatatgcccatactgggattgctgggtcgaatggtagttctgtgttaagttctctgagaaatttccaaactgctttctacaccagctgaactactttacattcccaccagcagtgtataagcattccctgttctctgcaaccttgtcaacatctgttattttttgactttttaaaaatattcattctggctcatgtgaaatagtatctcattttggttttggtttgcatttctctgatgattactaatgatgaacatttttcctacgtttcttggccgcttctatgtcttcttttaagaagtgtctgttcatgtctcctacccattttttaatggggctgcttttttcttgttgaataatttaagttccttacagattctggatattaaatttcttttggatgctgatatggtttggctgtgtccccacccacatctcatcttgaattgtagcttccataatttccacgtcttgtgggaggggacctggtaggagataattgactcatggggcagtttcccccatattattctcatgttagtgaataagtctcatgagatctgatggatccgaaggaaaccctttccgcttggcattcattctctcttttgcctgctgccatgtaagacgtgcttttcaccttccatcatgattgtgaggcctccccagccacatggaactgtgggtccattaaacctcttgctcttttagtttacccagtctcaagtgtgtctttatcagcagtgtgaaaatggactaatgcagatgcatagtttgcaaatattttttcctaccctataggttgtctatttacctgttaatagttgcttttgttgttcagaagcgctttggtttaattaggtccctcttgtctttttttttttcttgcagttgcttttggagatgtcatcattaaatctttgctaaggcctgtgtccagagtggtgtgtcctacattttcttctagggtttttatggttttaggtcttacatttaaatctttaagccatcttaaattgatttttgtatatggtaaaaggaaggagtcaagtttcaatcttctgcatacggctaaccagctatcctagcaccatttattgaatagggagtcctttctccatttcttgtttttgttgactttgttgaagatcagatgtttgtaggtgtgtggctttatttctggtttctctaacctgttccattggtctatgtgtctgtttttgtaccagtaccatgctgttttggttactatggccttatagtatattttgaagtcaggtagtgtgattcctccagctttgttctttttgcttagggttgctttggctattcagcctttttttttttttggatccatatgaattttataattcttttttttttctaattctgtgaaaaatgatgctggtggtttgataggaatagcattgagtctgtaaattgctttgggtaatgtcaccattttaacaatattgattcttcctatccatgagcgtggaatgttgttccatttgtttgtattatctctgcagtgttttttaattcttgtagagatctttcactttcttggttagctataaccttaggtattttattctttttgtacatgttgtaaatgggattgcattcttgatttggatttcagcttggaaattattgatgtgtagaaatgatattagttttttagtttttgttttggtttgctaagggtaagtgaattgtatgctactggtttttatacattgatatttttttcctgaaactttactgaagtcatttattagttctagaagtcttttggcagagtttttaggggtttctatgtatagtatatcatctatgaagagagataatttgacttcctcttttcctatttggataccttttatttctttcccttgcctgactgctctggctaggaattccaatactatgttgaataggagtgatgagagtgggcattttgtttcattccagttctcacaggaaatgcttccaacttttgcctgttcaatatgatgttgcctttgggtttgtaattgatggatcttattattttgaggcatattccttttatctttgtcctttgatgcctaatttgttgaaggtttttaacatgaagggatgttgaattttattgaaagcccttcctgtatctattaagatgatcatatggtttctgttttcaattctgtttagtgtcatagaatgatttagggaggagttcctactttttggttttttgaagtaattttagtaggattgttactagctctgctttctatgtctggtagaattcagctgtgaatttgtctggttccgggcttttttggttggtaggttttttttttattagcaattcaattttgaaagtcattattcatctgttcaggatttgaatttcttcctggttcaatattgcaaggttgtatgtttctgggaatttatttatttcttcaaggtgttctagaagaaatggaaaaaacccagaaaacctaaaaggttttcttgtaatatcaccgttgtcatttcttattgtgcttatttaggtcttctatttttgttaatctagctagtggtctaccaatcttatttattatttcaaaaaatgaactttcttttgtttgtgtttttgtgtcccaatttcattcagttctgctctgattttgattttttcttttcttctgctagctttgggattggtttgttctttttttttctagttcttccaggtgtaatgttatgttgttaatttgagatctttctaactttatgatgtagttgtttagtgttataaactttccttttaacactgctttagttgtgtcccaaatattctggtatgttgtgtcacagttttcattagtttcaaataattttttgatttctgcattaatttcattctttacccaaaagtcatctaggagcaaaatgtttaattttgatgtaactggatagttttgagagatcttcttgttttttatttgtatttatattacatgtgggccaagagagtggttggtatgatttcaattttctttggatttttttgagacttgctttatggcatgtggctgatcttagagtatgtgtcatgtgcagataagaagaatatatattctgttgttgttgggtagtctgtagacatctagaagacccagttgatcaagggttgagtttgagtccagaatatctttgttttctgcctctatgatctgtctaatgctgtcaaatgggatattgaaatctccccctattattgtgtttatgtctctttataggtctctaagaacttgttttatgaatctgggtgccccaatgttgggtgcataaatatttagggtagttaagtcttcttgttgaattgaaccctttttcattatgtaaagcccctctttgttctttttgatcattgctggtttaaaatctgcttcatctgatataagaatagcaacctctgctctttgttgttttccacttacaagatagatctttctccatccctttactttgagccaaagtgtgtcattacatgtgagatgggttcttgaagacagcagacagttgggtcttgcctctttatccaacttgtcaatctatgccttttaagtgggtgtttagcctgtttacattcaaggttaatattgatatgtaaggatttaatcctgtcatttgtgttgttagctggttttcatgtaaacttgattgtatagttgctttatagtgcaagtgagctacgtatttgtgtttttgtggaggcaggtatctttcttgtttccatgtttagcactcccttaaggacctttgtaaagcgggtctaatgatagtgaatttctttagtgttcacttgtctaaaaatgattttatttcttctttgcttatgatgcttagttttgtgggatatgaaatccttgattggaattttttttctttaaggatgctgaaaatagggcccccagtctcttctggcttgtaagcttttttctgacatgtctgctatcagcctggtgggttctctttgtaactgacctgccctttctctatagctgcttttaagagtttttctttcacaacaaccttggagaatctgatgaccatatgccttggggatggtcatcttatatagtatctcacaggggttttctgaattccttgaatatcatgtcaacctctagtgagattgggaaaattttcatggactgtatcctcaactatgttttccaagttgcttactctctctccttctctttcagaaatgccagtgagtcatagttttggtcactttacataatcccatacttttcagaggttttattcattttttaacactcttttttctttatttttgtctgcctgtgttgatttgaaagaactgcctttaagctctaaaattcttctctcagcttggtctcttctgatgttaatgcttccaattttattatgaaattcttatattgaattttaaatttcagaagttcagtttggttattcttaaaatggctatgttgtctttcaactctcaaatcatttccttggattgagtttcaactttctcctgtatctcattgagcttccttgccatctagactctgaatcctatgtctgtcatttcagtcatttcagtttgattaagaaccattgctgggtagctagtgtgttcatttgtaggtaaaaagacactctggcttttagaactgccagagttcttgtgctgttttctcatctgtgagtgctgatgttcttttatccttttgaagttgctgtcctggggatagggctttttgtttttatgttcgttatttctcataagagttttgctgttgtgtaagttggatatagttgattggctttgtttctgaattttttcatagggccgaggttcagcttggaactcctgggctgtatgctctaaccctggtgacctgggaccaggcctgtggctttgtcctctggccccttgagctttagtaccagcttcactgggaggtcaaggtgcagctaggctgctggtgaaagcactctatcaggggccaccagctaaactgccccattggtggttgctggcaaaagtgccctggcagggtgggtgggggccactggcaaaagtgctccagtagggccctcttttttaatgtaagcatttagtgctaaaaatttcacttagcacagttttaactgtatgtgccatgaattttgatatgttgtgcttttattttaattacatgtaatgtattatcttctctttgacccatggattattttataacatgttgttatatttccccattatctttctgttattgatttctaccttgactatattgtggtcagagaacacactctgaatgattataattttgctgaagtttgttttatggcccagcattaagtctatcatggtttgtgttctatgagcaattgaaaagaacatatactctgctcttgttgggtacagtgttccataaatgttcattagatcctgttgattaatggtattgttgagttcttttctatctttgttgattttttgtttagttgctctatctatataattcatatataggattgctgtatcttcttagtgggttgacctatttataactctgtaattcccttctctgtagccattttctttactctaaatgttaacttatctgatattaatatagctattgcttccatcctttgattaatacttacatgatatatttttaaaaatatttttactttcaaccatcctatatcattttattcaaagtgagcttcatatagtgtatagttgagtctttttttaaaaaaaacccactcagccagtgttttcattgtcatatttagcccatttacatttaatgtaattattaacatgttaggatttaaaactcatttaattttgtattttctacttgttcttgtattttttgtttctttgtttcttcctcccttcctttgagttactttaatgattttggaaatccactttatctatgtttttgagtgtatgtctttgatagctttcttttatttattgttctagatataatattcatatacatattcataacattaaagtttactggtgtcataattttaccagtttgggtgaaatatagaaactttaccttcctttatgacattttacttatgcccctcatttatattataattgtttaaatatttcctctatgtgcatttaaaatgacataagacagtagtatggtgtttaattgaactgtcaagcataaaactcaaggaatgcttattgtacttactcaggttgttgcttgccatgttcttgcattcttcctgatgctccaaaattcctttttttatatttctcttctatatggagacataaatttagtaattctttcagagttggtctggtgaaaaacacaattttcctttttctggggatatctttatttccccctgattcctgaaggataacttcactgggtatctggattgatagacttgtgggattctgggttgacatatttttctttcagcacttgaaaaatgtgctgtttccttgtggcctccattgtttctgataagaaatcccctgtcatttgaattgtgttttccttgtaggtaagttgtcatttttctctggctgctgttaagatttttctttgtaagttttcagaaacttaattattatgtgtcttggaggagatttgggtttaccctgtttggggtatgcttagcttcttaaagttttaggttcatgtttcttccaaaattgagaagttttcagccattatttttctgagtaccttttcagacctgtcatcttgtcttctttcactcctctttttgaaactctgatagcatgaatattatatctttggttatagccccgcagttgctgaagctttatcatgtttttctactattttctctgtgttgttgacattgagtaattcctactgttttatcctcacttcactgattctttcctctgtctctccatccttctgttatgtgcatccactgcgttgtttattttggttattgtatctttcagtaataatatttcaatttggcttttatttacatcatctattttctgagacatcctactttttcatttgtttcaagtgtgttcataattgctcattgaagcatttttatcgtaactggtttaaaatctttctcaggcaattttaacatctcggtcatctcagtgttggtttctgtggattgtctcttttctatttattttgtgatcttctttgttctttgtataaccagttattttcttttgaaatctggacatttttgtattatgtcatgattctggatctcatttaaaccttgcattttaactgtctctttttggacactcctcttctgggggtaaggggtggtggtggtgattccttgtaactgacagggagatggaagtctagattccccaggaggcctctgttgatacctgaaggtggggtctttttactgattggttagggagaggggtgggagtttcaacttcccagatggtctctgctggcactgcaggggttgtggtaattacaacccaatggagatgaaagttctggatccctacttggccttctctgacactacctggtaggcctgaggggaggccttattacagcctcatgaaagaggaagtctagatccccatttggcctttgttggcatgggtagggagaggctgtacttttttctgtggtgttttgctggggtagagctgttaatatctaatatttttctgtcttgctgagttgattctttcctgactccttgattagagagaggctgctttagttgtgtgtgtgtgtgtgtgtgtgtgtgtgtgtgtgtacacgctggtgtttccggattgcggcctctttgactccaagtctgaggtacctgaggcaaaaagaaaacccagggaatccaccaccatgtccttctctgctctgccttcgtattgccatccttcagagtcttatgcttgttttacgtatgctcagagattttagttgtacttagtgggaagacgtatgtcatctctgggagtggattccttcttcccagggttatattttctccaagatatgccacggacagaagttcataggagatgcttaaactcccatacctctgcattgttttgtttgttttttatatctaagagcacagtttcttctgacttccgggaaggctgagatggctgggctaaggtatacagggtcctctcagactgcccagtacagatgattctgagtagttgaccaactgttgttctggaagaactgagcctttatcatagatcccaaagttgacataactcagacttatatgatttttagataaaaatttttaaattttagttatttaaattttataaatgatatttttcatgaaaagttctttttgtgccattgattttctgtttcctgataaatattaatattaagagaatcccttttaggaatggcgtggttaaaatatccttatttctaaatccacaataatagatattatactaacattgcaaatgtgctttcagttgagtatactcccaagaatggatcagaaatagctatataaacaaaagtacatttcatagtgggtgtttttaagttgctttggcaaatgggatagacttgattattattaagtacatttaatcttaaattggatagtagtgagtgtggggcctgttttctgcagcgacctatactctaagtgatatattccaactagagcagcttagagtaagttggaggccatcctaatggtgaattttcctatcattcttcacttcaggtaatgccatttaggcttttgagatttagaaatatgacaattgctttaatttgccgtctataacatttaaaaaatctagatttgcatgtgaaaaaaatatttgtgtgttcatgaagatagcttatatttactgagctcttttaattccatccagaatatgtggttctcatcatgttctggacttcctacgccacacacacacacacacacacacacacacacacacacacacacacaagcacagagccatcctgatttgaagattttggtaatgtgtttttgtacagggcataaaaatatatctctgtaattacatgatatttagtgattagataattatggataattgcatggggtagttctaagtgctaaagtgttaccataagatctaacatgtacaaattgcataataattattcttgagagttatttggtaattttgagcataattatcatgtgatccacagtgcatgtaattaatgcataatcacatggattttgccttcataactacttcacccttgttataaagctctttgtcataacatttgagtataaatataatgtaattggctcccggatacagtacattaagccccatgataattgctttcacagtaacaataccccttattccattccaattgctgtcttttaagattttgttaggaagaacaaaatacctaagatatggtggcgggcaggtagaggagtgggtgagtggcgggtactatgtgcttattgtggatgaggagtatctttgctgtgaccacaatatttccatgtagatggaagatgtttccatctttcatagtagataaaaatctgtcttctaactaaacttgtatttggtgtaaggctccttgctgtctagccatagtcagcacccattaagtctatttttttaatttttaatttttgtgggtacacaggtgtatatatttatggggtacatgggatattttgatacaggcatacaatgcataataatcacgtcagggtaaatgggatgttcatcacctgaagtatttatcctttcattgtgttacaaataatccagttatactcttagttatttgtaaatgtacaataaattattgttgactgtagttaccctgttgtgctatcaagtaccagatcttattcattctacttaactgtatttttgtactcattaaccattcccacttgccccccgccccctgccaatttccttcccagtaacaatggttacttccttctggtagctgttgttctactctctataagttcagttgttttaagttttagttcccacaaatcggtgagaacatgcaaagtttgtctttctatgtctggcttatttcacttaacataatgattttcagttccatccatgttgttgcaaatgaaagaatctcacctttttatggctgaatagtactccactgtgtagaggtaccacatttttaaaaatccattcatctgttgatggacatttaggttgcttccaaatgttcactgttgttaacagtgctgcaataaacatgggagtgtggatatcaatttgatacactgattaccttttgggtataaacctagcagtgggattgctggattatattatagctctattttcagctttttaaggaacctccaaactactctccataatagttgtactaatttacaattctaccaacagtgtgtatgagggttccctttttcctatatcctcgccagcatttgttattgcctgtcttttggacaaaagccatttgaactgggtgagatgatatctcattgtaggtttgatttgcatttctctgatgatcagtgatgttgagcaccttttcatacgcctgtttgccgtctgaatgtcttttttgagaaatgtctattcagagttatatctatttgcccatttaaagttagattattgaaatttttttctacagagttgtttgagctttttatacattctggttattaatcccttgtcagatgaatactttgcaaatattttctcctattctgtgggtatctcttcactttgttgattgtttcctttgctgtgcagaggttttttcacttgatgtgatcccatctgtccagttttgctttggttgcctgtgcttgtggagcattactcaagttgctttggctgcctgtgctcatggggtattactaaataaatctttacactatccagtgtactagggagttttcccagtgttttcttttagtcgtttcatagtttgaggtcttagatttatgtctttaatccatttttatgtgatttttgtataggaagagataggagtctagtttcattcttctgcatgtggttatccagtcttcccagcaccatttatagaagagactgtcctatccccaggacagttgacgattgttgacgatttttgcatcaatattcatcagggatattggcgtgaagttttattttttgatgtgtctttggttttggtatcagggtaatactggcttaatggaatgaatttggaagtgtttcctcctcctctatcttttggaatagtttgagcaagattcttctttaaatatttggtaaaattcagcagtgaagtgatcaagtcccaggcttttctttgcttggagactttattacagcttcaatctcattatttgttattgatctgttcaggtttttgatttcttcatggttcagtcctggtagattctatgtgtctaggaatttatccatttcttctgggttttctaatttactggcatgtagttgctcatagtagcctctaatgatcctttgaattactgcagtattagttgtaatgtctcctttttcatctctgattttatttatttgggtcttttctctttttttcttagactagaaaatggtttgtcaattttatcttttcaaaaaccaactttttgtttcattgatcttttgtattgttttcttcattccaacttgatttatttctgctctgatctttattatttcttttcttttactaattttgggtttggtttgctcttgcttttctagttctttaagatgcatcactttgggaggccgaggcgggcggatcacgaggtcaggagatcgagaccatcctggctaacacggtgaaaccccgtctctactaaaaatacaaaaaattagccaggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagatgcatcattagattgtttgagggtattctcttttttctcgatgtagttgcttatagctataaactttcctcttagtactgcttttgctgcatcccacaggtttttggtatgttgtgtttgtattattatttgtttcaagaaatctctaaattttctccttaatttcctcattgacccactggtcattcagaagcatattgtttaatttccatgtgtttgtatagtttccaaaattttccctgttattgatttctagtgttattccattgtggtcagagaagatacttgatataatttcagtttgtttttgaatttttaaagatgcatttttttgccataatgtatgggctattcttgagaattattcatgtgttgaggagaagaatgtggatttcatagccattgaatgaaatgttctgtaaatgtcaattcagtccatttggttaacagtgcagcttggtcaatatatcttcgttgaatttctgtctcaatgatctgtccagtgctgaaagtggcatgtggaagtcttcagctgttactgtattggggtctgtctcttgctttaactctaataaaatttgttttatatatctggatgctccagtgttgggtacatatatatttacaattgttatgtcctcttgctcaatttacccctttatcattatgaccttctttgtctcttttgctagttttgtcttgaaatctattttgtctgatacaagtactgctactcttgctcttttttggtttccatttgcacggattatctttttccatccctttctttttagtctatatttgtctttataggtgaagtgtgtcttttataggcaacagatgattgggtcttttttttaatccattcaaccactctgtgtgttttgattggagagtttagtccatgtgtatttgttattattgataggtaagaacttactcttgccattttgttatttgttttctgattgttttgtggtcttctctttcttatttctttccttacttttttttttaagtgaaagtgattttctttggtggtatgttttaatttctagctttttactttttgttgtatctgtttatgttttttgatttgaggttacaataaggcttgcaaataacatcttataacccattattttaaacggatgacaacttaacattgattacataagcaaactaacaaaccagcacagagaaaactaataaaaactctacactttagcttcatccccctactttttaactttttgttgtttctatttatatctttatatctgaaaagttgttggagttatttgataagttcatcttttagtcttttaactccagatatgagcagtttacacaccacaattacagtgttatgatattctgtgtttttctgtgtacttactattaccagtgagttttgtacctttagatgatttcttactgctcactaacattcttttatttcagacggaagaaatccctttagcatttcttataggacaggtctgctgttgatggaatccttcagcttttgtttgtctgggaaagtatttttccttcatatttgaaatgcatttttgttggatatacaatttcagaataaaagggtttctttcctttaacactttaaataacaatcccgtttcctggcctgtaaagtttccactgaaaagtctgctgccagatgtactgcagctccattgtatttttgtttgtttgtttattttcttttgcagattttaggattctttcttcattcctgacctttgggagtttgataattaaatgtcttgaggtagtcttatttgggttgaatctgtttagtgttcttatagccttcctatacttgaacactgacatctttctctaggttcgagaagttctcattattatcctttcaactaaactttctacctctttctctctctccctcctctttaagggtgataaatcttagatttgtctttttgaggctattttctagatcatgcaggtgtgcttcattttttaaaatccttttttctttggtctcctctgacggcatattttcaactagccagtcttcaagctcactaattctttgtcttgcttggtcaactctgctgtcaagagagtctgaggcattctgcaatgggtcagttatgtttttcaactccagagattttgcatgattgtttttaattattctaatttcattgttaagtttatcggataggattctgattgtcttttctatgttatcttgaatttcactgaatttttttaaaacaactattttgaattctttgtctgaaaggtaacatatctatccctgtctctccaggattggtccctggtgccttatttagttcgtttggtgaggtcatgttttcctggatagtcttgatgctcttggatgtttgttggtgtctgagttaggtatttattgtagtcgctaaaatctcggcttgtttgtattcatccttcttgggaaggctttccaggtatttgaaaagactttgcccactttttgatggggttgtttttttcttgtaaatttgttttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgctttgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagaccggattaagaaaatgtggcacatatacaccatggaatactatgcagccataaaaaatgatgagtgcatgtcctttgtagggacatggatgaaattggaaaccatcattctcagtaaactatcgcaagaacaaaaaaccaaacaccgcatattctcactcataggcgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgtacaatgtgcacatgtaccctaaaacttaaagtataataataaaaaataaataaattaaaaaaaaaaaagaaaagactttggttctgtgatctacgtttttaatccctgcagccatatctgcattaggggccactcaaagcccagtaatttcatggctgtttcagactcacagatgtatcaccttggcagtcttggatacaatctagaagaattttgtggattaccaggcagactttttttctcttacattctccgagacaaacgaacggacggtctctctctctccccccctccccgagcttcctggagctgggtgacgggtgacacaagcacctctgtggccaccccaccactaggactgtaccagatcagacctgaagccaggacatctctgagtcttacccaaggcccatggggtactgcctgggtaccactgttgattattcagggcccaaaggctctgtagtcaggagatgatgaatcctttcagtactgggaccttcccttcaaggcagtgggttttcctttggcccaaggtgtgtctagaaatgtcacctgggagctagggcctggaatgggggcctcatgactctgcccagtgccctatcctacttggctgagcagttatctaagttgtaagataaagtcctctttactcttccctctcctctcctcaaggagaaggaaggagtctcttttggagctgtgagctgtgctgcctagggttgagggaagggtgacactagcacccttagttgtgccagctagtaccttactaggttgtctgcaccccaagtccagtggctacaagccaagcacagcaccaggacttgcccaggaattgtagtccttccatcataggcagccttcaagtttatttaggaccccagagcactttagcccatggtggtgaggcttgtcagaactcagattctgaccactgggatgggtggtactgctctgtctagggctggtctaaatattccctccatgggctctggttgagttttgcctgttgtttttactgtgacagggcagcaccgagttccaataccaagtcccactatcactgtgctctctctcccaagtgcatgcgttctctctctggggcacacagccactgcagggggatgggtgaggggtgacatcagcaattccaaatgatcttttccaccctcttcagtgcctctttcaatgatatggagttaaaaccaggtactgtgaccactcacctgaaatttggttcgtatgaaggtgctttgctgtgcggacagttgttcaatttggtgttcctacagggaggatgattggtagaggcttctatttggccagctttctccactctcacccaagcctttttattactattaatgcagcagagcatcagttttctttttggcctagaagtttcagaaagctggaatttctgtaaggagatcttgataaactgcagtgagagggaggcttactttgctgatgggaccatcaacttaatgctgaaatgcaactaattgtgagactgaagcaagagctttggctaaatttccaaaatgatgacataatttttgcaatttttgtccacaggtttcacgtggcaggatgactatactcagtatgtgatggaccaggaacttgcagacctcccgaaaacctacctgaggcgtcctgaagcatccagcccagccaggtaagtgtggacgtggcttgttgctccttgctcccaggacacagtccatagccattacacttattatttgtttgtttgtttgttttaatgtagcaaagcacccaccatctttctggtgcagacgtttcagaaagttaggatgtctgtaaggaaaagtttggttcccatgagagaaagcgatattggggtgaccctccagtaagagacatgcccaggggttcttcgtttttccatgagactcttagaaaaatcctgcatcttcaaggccttggtcgaaagcagataagtcgagaattctcatttctcagtaagaaattatttttgctttagacaaaaaacagaattgtgaaagtctttatcatcctttcccagagcatagcaacgtatactgagctaaatatattgttccatattatcttattttgtactcaaaactatgtggtaattactaatgtcatacaaacgatgtggtaatgtcatacataccatggactaatgtcataccgattcttgaaagtgaggaaattgagtcatagggaggttaaaaaattagtctaaagacaaaccacagtaagaaagctggcactgtcggattcctgagccattgtgctatttttcatgttttttaaaaaaaaacatgaaaatgacctttcctaaaggtttagtttgaaaagttcatttttccctgacagacaattctagagtcatagtctttagaaagattccagtaacacaaaatttagatatctgctttcatgctcatggccatctgatagggaaagcagttaagtgtcctggcaggatcaagagtgagaacgtgtggagaactggtaaccgtcccccagcacgccgcacacactgagggcgcgggttgcctctttcctcagaacgcggcgcacactgagggcgggggctgcgtctttccccagcaagcggcgcacaccgagggcgggggcttcgtcttcaccacacggcgcacgctgagggcggcggctgcttctttccccagaacgccgcacacactgagggcgggggctgcgtctttccccagcaagcggcgcacaccgagggcgggggcttcgtcttcaccacacggcgctcgctgagggcaggggccgtgtctttccccagaacgcggctcacgctgagggcaggggctgcgtctttccccagaacatggcgcacactgaggttaggggctgcgacttcagcacgcggcgcacactgagggcaggggctgcctctttgtgcttctgtgcctggtgtatctacctttaatacctcctttatcaaagagaatgtgctgttatagtctgtaagacttttctgtaggaaaccaaacaaaaacccaccaaaatgttttcaacttgagctgtgttgaatttctattttggatgtgttcaaactccttatactcctctctaaattccactgggggcgttgtgcactgccccaatgaccttgaactccatcaagtatagggatgggttggacggccaagaagggcaaaaaatagagggctggaagaattgggaaaaccaagcaagggatggctcctcctcactctgggggggtgcagaacagggcaaacagaagctgccaaacgtgggaggaaaggggcgccacatagagaacaatccagggaggacctgcctctgagaaatcaaactcagcaacaaccatggagaggcgcctggattgtgccttctaaacaacgttaaatgtggtcatttggaaaaattgccagtttttattatttaaaacagtgccagttttattatgaaaaatggtatgttatctttgttttatgagttataagtgagattaaaagtttaaaatacatatgctttgagattggaattttctccttccttcctcccttccttccttcctttttctttcctctttctttcctcttcttttttttttttttttttttttttttggctcttgcttcatcacctaggccggagtgcagtggcacgatcttggctcactacagcctccacctcttgggttcaagcaattctcttgcctcagcctcctgagtagctgggactacaggtgcgcgccaccatacccagctaatttttgtatttttagtagagatggggttttgccgtgttggccaggctggtcttgaactcctgacctcatgatccgcccaccttggcctcccagagtgctaggattacaggcatgagccaccacatctggccgagattggaattttctttgtgaattttctgtatatggtctttgtctgtataaaaaggactttttgtatttttctgtttgtttcttttattataggttctttatatttcaggctagtaacttttcacatattatattttgtaaaaatatttttatcagcctggaacgtagatggcactagctatggttacaaataaaaacagctcttaccattctgtaggttggatttctaaattctttctttgtgagtgttgaacccaggcaagagcaattatccctgcccacaaaacagaggcccatttagggaggcattggctggatattctccagactcctttcctccacactcccttcccctgccctgctatgggcttcatgcctgtaagctccatcgggtcctctgggcctctggctttggtggggtttggaacaagctgcacccagcatggagggcagaggagtctgggcatgttccccagctcttccccaggcccagacatgactgcctggggacaatcactccctctcatgctgtccctcctgctgacccaaaggcctccccagtcctgccggtgccttcctcatgcccgactctgacacctactgagggaggttcccatgaggccctgcccaggagagaataagaaacagtgtggcccatcgtcttcctcaacagttgcccacagtatttcctcatggaaatgtgatcgtttttctttttttcctaacatttctggaaaacttcttttaccattgatctactttctagtatattttttaggaatgttcttcatttatagagtattttcattgtcttccacgattattggtaaaatatgcttacactgttgtgtgatttgggatatttataagctatcctttaatagcgatttccacatttgtaaatgcagtgtagtggatgctattctcttgttgatgaaaagagtcaaactctgtaaaatatttttagagatgtattctgagccaaatatgagtggccatagcccgtgatgcagccctcaggaggccctgagaacatgggcccagggtgctcagggtgcagcttggttttatagattttagggaggcgtgagacatcaatcaaatacattggtttggttcagaaggtgggacaactcaaagcaggggcttccaggctataggtgaattcaaacattttctggttgacaactcgttgagtttatctgaagacctgggatcaatagaaaatgttccagttaagataaaggattgtggagaccaagttttattgtgcagaggaagctctcagttagcagacttcagagaaagcaggttgtaagatgcttcttattggacctaaaagggtgcctggctcttggttgattatctcctggatctggaaaggaaggaaggaaaacaaaggggaaagtagatccctatagaatgtggatttttcccacaagagactttgcagggcaatttccaggtattgcaaggaaatatattttagagttaaatattttgattttttccctttgtctcataatgttctgccagagtcagactgaaaagtcagtcacgatatatagggtcaaataaaacccatctgatgagaatttatggtttgtggggtatgacttcccagacctcttagataggaatttggacaagagaaaaaatcagagcttagttctcactattatggtttttaaaattactcagcacttgtgtagttatattcctttgcattgtaaacgtacgttttctttagccaggtgtggtggcgcctggctactcaggaggctgagagagaggatcacctgagcccgggggattgaggctgcagtgagtcatgatcacacacagcactctagcctgggagagagagtgagaccctgtctcaaaaaaaaaaaaccacttttttttcacccttgtaacatgatttttaaaaagaattatctcttagattttcttctttttgctgttctcttttaaataaaacttcttcagtaaaacttatttacgctatttattcatttttaaaaaaataatgaaatcacataaataatttgcttttgagcataattttaacatcattctataactgatgaattctcacttgcttttgttctaaattatctgtaattgtcattttatatccttttgaaacaataaatgtttggtaggcttttctactttttcatatttatgtgttgtttttaaacttcaaattagtgtctaattctactgcattttagtcagaatgtgactttgttcaacttttactctttggtaattttgaggttttctttggcctaattgataccatacttaatcttcaattggcgcttcaaaaatatatttgtataactatttgcaggatacagacttttataaatagtttataattatatatatatgatgtgtaattaggtaaaaatgtgtcaattgtattacttcaacatgtccttatttatattgtgactttctgaaatttctcagacaaaaacagtaatctgtgagttttctttgggggttgatgtgtttagcttcataggctctgaggctctgctgcttagcacacgggggctgcgtcagctcgtcctcggcgtccatcattagtggattgttgtttaaatggtgcctgcatctcccttaatgcttgttgtcttggattccattttcctaaatgagtagggcctttcctgcttcctctttgtttttgttgcctgattaatccatggctatcttcagaatttgacctttgagactggttctgtttgaaactcagcttttataagatcaagtggtgtttccaaagccccttgggtcaggtcggagggcgagttatagcagcaaggggactgattcctctgtggggctttttcttctcatatgtggattgtggcttgtttgccttctcatacgtggattgtggctcgtttgcctcttctttagtattcgtaattttgtcttattttggatttaatttgtggccatcacctctagattttcaagcgattttatagtaatggatttgtttcattcctcattaaagggatcatgttctgattcctgctgcatgataaggaaccgtgttggctttcagcatcctcactccccactcccaggagctgcttctaaccaggctcccctagtgcctgcctgtgcccttcaccagatggaccctgggccagcatttgttggataaatggtggtgaaggacagaatgcgtgatctgcccaagcctttgaattcttgcatgggtagctacactaacgaagaatgtcacctggctttctccactccatgtgtattcagagcattctgagcttcacagctgaacaagaatccaccatgggccagtgacatagtagctggtgttctttacataaggcagttaatctccagagattgagtaacttgctgaaaaccaatcatccattcatgaaataaaggcgacattagaatgaagtcttcagaatccccagccctgtttttgggcttaccagagtggcaaccacaagctcatttctcctgctggttcttctcttcccacacatgaggtcccttaagcagagtaagccccatgagagaaagccagaaagagacgcagtgtggaaaatcagcaaagcagtaggtatgagtgcccagtgtgaggaacagagctcgcacctaaggggtcaccaggaacctgagaacatgctaaaggctaagagaacctgagaaccaggaacctgagaacacgctaagggctaagagaccttgagaactgagagcctaagaacatgctaaggactaaggaggacctgagaaccaggaacctgagaacatgctaaagtctaaggaggagctgagaacatgctaagggctaagagagtcaaggaaggggaacctgagaactgagaacttgagaacatgctaagggctaagataaccaagaacctgggaacatgctaagggctaaggaggatctgagaagccagaacctgagaagaacatgctaagggctaaggaggacctgagaagccagaacctgagaagaacatgctaagggctaaggaggacctgagaagccagaacctgagaagaacatgctaagggctaaggaggacctgagaagccagaacctgagaagaacatgctaagggctaaggaggacctgagaagccagaacctgagaagaacatgctaagggctaaggaggacctgagaagccagaacctgagaagaacatgctaagggctaaggaggacctgagaagccagaacctgagaagaacatgctaagggctaaggaggacctgagaaccagggatcatgctaatggctaaagagaaccagggatcatgctaaatgctcctgaggcaggaacagggacaacaaataccagctgtgtatatgagcaccgatgacttcacagagaacttcaggtggccatgaaggttggatataaaacataagatgggcctgtaatgtggaattttttcctttaacaaactgggtgacaatctagactatctcatattatcgtgagcctaaggccagtgtgtgccaatggagaagggaatagctactaagtgtaaaacatttttcatctttttaaagtacaaaattcatacgtatgaagttttgacctacttcaagctggatgacagagcaaaagtcaatgtgcaagttaattgctacaacaccacgcggcataatgataaaccctctcattgccgtaacatactgcagcatcacaaacaagtccccaggcatggacagaggcgaagcaaagatgaatacgacaatttaaagatacatttatgaggtggttccatttgcattgattagcaattagtgagaaaagtagacaaaataccagaaaagtaaattaactgcagttaaattacactctgacaacatagaacatgaaatttcattaattaaaaaatggccaaggaaattatagccatgatttgagatgcaaagaactgcaaaagccttggtaatttatatgcctgttacatctgtatcagtgtaacttgaaaagtgatattgtttggctgtgtccccacccaaatctcatcttgaattgtagttctcataatctgcacgtgtcatgggagggacccagtgggaggtaattgaatcatggaggtggctgtctccatgctgttctcatgatagtgagtgagttttcacgagatctgatggttttataagggactctttcccctttgctccttgcacttctctctcctgccaccttgtgaagaagggtgtgtttgcttccccttctgccatgattgttacgtttcctgagacctccccagccatgctgaactgagtcaattaaacctctcctttataaattacccagtctcaggtatatctttatgagcagtgtgggaacaaagtaatacaaaaaggcactagaaataaaaacatggtgggtttatcaattgagataatcaagcaaaaatgggattttttttataagccccatgcaggtatcacacacctaatgttagtgatctgttcttgaaaatcaacatcctacatggaaacagtacctggaaacctattccattactgtatgtgggaaatttgtaatgagttccacatccactcaagccccagtgtatttcctaaagtgtttctaaatcacactaaagacccatatacaagtaccagatggtcatgtttggatagaagacacttcttgctgatacccagaagtggaaattgttcttagcaaagtgtatgttctatttgaagtaatactgcctcactcagcacctgcaaagtctgagctgcacctccctcaggctgttgggtgatgccacagtgctgtgtttggagacatacccagactttttctgaatacgattttgttcagaatgtagcatcaaattctgtgaaaggagatacacatgcacacgcacacacacacacatacatgtatatacatatatacgtatacaggtgctccttgactcatatctacctcctgtgcctgcctagggagcctgggctgttcatatccctcattgtggagctctgctggggatgatgtccttcagtgtcgtatttctaagagagccataagtctacctttgtatttgaaggatattttcatgggatatagaattctgggttacttttttttctttcactactttaaaaatgttttccatcgtcttctggcctggagcacttctcaaggagaaatctatagtcgcctttccactggcatcgggggcactggattgaagtcccccaagatcctcactagccgtgggcagggccccaggggtgcccggggagctacatctcggttgggtgtctggacagcagactctgtagtcctgaagtccaaatgcagggtcttgggaagacccctcatggggaagtgaagagacgggtttggccgaggagaggttggactcagtgtggtcatgacagaggcctcaggagccctcacccctcctcaggggctggggaccagtgtgggatgcagacctccctagatggggtataaacgtgggtgaggcagacccccatggtggagggccattttgggaggggacgcagctgtgtggcgatgacacttgcccccagctgcctcagggacagtggtgctcagtggcctgccagagttgatgagacagagctgaaggtctggggaaaccaaggcagcttgagttcacaggtcagagtataaaagagaagagtgcacagagagccctggagattttcagccactgctgaggatttggtagatgactgatgaccttgtgtctatgagggaaaagaaccatccaaaaaaatgagagcaaacagtatctgacattcacacagggtgcgacatagtgcttcttcaaacctatcaagacttgcaaacctcataatttccagataattgggtagaatgcccacagagtcctgtcttagtagtggggagtaatttgtcatagataattgctgctctgatactgccaaacaagacttaaaagtaagaaccgagagggttgaactggtcccaaggaacttaactgaatgccagagcaaaggtaaataatatttatgggattgcaaatgtccatcacccaataaggtaaaattcacaatgtgaatatatagacatggattatctggcatgaaaaggagcaggaaaatgcaactcataaaattcatcagtgtagacacagaactgacacagacacaataagtaggagacaggaaaatttcatgggtggaatgaatagcagattagacactgtggtagaaaatattagtgaacttgaagacacagcaataggaactatccataaggaaacaaggaaggataattaaaaaaaaataaaaaacaccagtgagctatgggacacatctaaaggccaaatatctgtataactggagtcccaaggcgggagagacaggaacagaaaaatcatttgaagaaataatgaggaaaattgtttcaatatgataaaaatgataaactcacagagccagaaagctcaataagccccctaaaaaagaaacatgaagactaagaaatatcataataaaatttctcaaaaccagtgataaaaagccaaccttaaaagcagccagaggaaaaaaaggtgcatttcatagagagatgagatgatgaaggccactgcaggtttctccttgagaatgctccaggccagaagacgatggaaagcatttttaaagtactgaaaggaaaaacaaacaaacaaacatcaacccagaattccatatcccatggaagtatccttcagatacaaaggtaaaattattggctttctcagaaatacagacgctgaaggacatcatcacccacagagctccatgaccagggctggtaaagccgccgttctggcagaagggaaaggtgccagatggaaaccaatgagagaacacgcgaaggcaactgcatccaccgatagatggtgttttcctgtcacttaaatcacatttaaagaagttgattaaacaaaaatgatgaaagtgtattgtgaggttgataacatagctgtcaacagaattcatgtcaacaccgcatcagagctggagggagaattgcaaggatctatttaaggctcgtatttcatatgttaagtggtgtgatgtcccttggaggcaacctgtggtcagttaaacgtgacagttatacactatctgtaatttgggcttcttgccctaacgaggatctagacttagatgttgagaaggtgaaggtggagccatgccccagggctctgaggcagccagtgcctgggcgctcaggaaagtacctgcctccacctcggacctagcctctccctggcctgagagaagcagatggcagctgaccgcacctgtaaagcctgttatgagggaggcctgagtcttgtgctggcagtggggcatgacgccggggcctgtggcgtctggaccgtccactgcagcacaagtcggacctgaagtgattggtcatcgctgagcatggctctcagcgggaaggggatttgggagcattgctgagggcggcaggttcacagagggccctgcccttgtctgtgggcagcagagccggacagcaagggcccccagactggcccatctttttaatggtgatgcccgttcttttatggacataaatgacgcactcaattaattatacaaactaaaaataaccagaattaaaagctctttggtctgtgtctaaactccatgtctacgaaatctttgcattttattagaagcatggtgtgtgcgtgcaggcgcacacatacacagacaaacgcacacacgcactcacacccctcacacactcacacacacacttacacaaactcacacacgcacatgcgcgcgcgtgcacacactttttttgttgttgttgaaacagggtcttcctctgttgcctgaggctggagcacagcggcgctatcgtagcttactgcagcctcaagttcctgggctctagtgaccctcctgcctccacttcccaaagtgccaggattatagctgcgagcccccatgccggcctcacattatattccttttttttttttttttttttgagacagagccttgctggaatgtggaggtggggtgcagtcactcacgcaggtgttcttaaacctggctggtagaggcgtctcctatgggaattatcttccttatttaggagcatgctctgggcccttttggtcatgtgcaaaaaagcaaaggcctccgtgggggctgtgaagctctgggcggctgagtcctgggtgcagagaccagcggcagagtctgcgggtgagctgggcagggagggccatgcccatccctagggaggccatgcccatcgtgtcccaggctgagacgctgccccgtggctcaggcaagctctccgccacagctgagggtaaagggggacagggcgcaggctcagggggccacggacatcctctgtgcatgcccaggcctccaccagggctccccataaacatggggagtcctgactctgtctctccggggcctgttgggcgttaccgcgacttttccagtgaatctccctggttctgctcttcctttccgtgtggctgcacaagctggtgatgggggccccactggcaagtggctgctttctcagggactctgagcatcattagtgggggccacatgtggctgacacgtccagctgcctcctggatttatgccttcagcacgcagctgtcccatggggcccctggccagccgtgcctggttcttggccttgtcctcgctggccctacccctgccgccctcagcagggtgggcaccacatgtgtctgcccacgggaagcgtcccatgtgtttgtccttctagcctccggcgtccctgccctgcatggtgcacgcgatggcggtgcgtgaatcactgtttaacagcagggactgcagcggaggggctgagagcactgcatggacgtcccgaggctgtggcgaagtacatcaacctaaggcctaaaacaatgcacatttatcaggcgagaacctggttcctgccttttccagcttctgggccgccaccttccttggtctacccacaaacccagcagaagccatgccaagccttgggccccccatgcccacccggcctctggctgcctcagcctcctggagaattcctgctgagcctgcagccaacacctgcagcttcctccctttctcccctccccttgtttcccatgtattgcttttgcttcctgtcttctgctctcagcaggggtcaatcgtccatccccacaaccacgaggcaggtgctgttagccatcctcgtgcaggacacaggctcgggggcccgggagaagttcaaacccatggtcatggagcagcaaggccaggccggccaccgagagcccggctcccagccccttgcatgcacccaggcaccacaggggacagagcagctccaggcaccagcaaacatgcggttgatgtctggtttcttttgctttttcaggccctcaaaacacagcgttggcagcgagaggaggtacagtcgggagggcggtgctgccctggccaacgccctccgacgccacctgcccttcctggaggccctgtcccaggccccagcctcagacgtgctcgccaggacccatacggcgcaggacagaccccccgctgaggtgacccttccacttcctccccgggccggggttggcttttccttcagggtgcaggtacctgggcatgtttccttagtcgctggctcctcttggctttgcgcctgtttcccgggccagcgggcatcctgtgaacagggcttcggtgttcctggggccccttagagcgacacctgctcccagtccagccacccccacaaatgcttagtcctctgggtgaggctctgtaggatctttcttgggacaaggtgtcgtgactccagaaagcccaccatttaaaccacagatgcacaccagggaggtagaggagataggtggctgctcttcaccctttgagaaaggatccgggacagcagtggacactgaaacctgactgaggtagactgaggggccatgaacatggctggaattagggggcaccaggtgcaactactgcatccaaggaaagctcctgctccccggcaagcctgccccgggggcagcccagggcagcgtaagggctccatctgcctgtgggcatgagggtctgggcaccaaaacacaaggtgatgccctgggcacacagaccccagacaggctcggaggcgaaccccaggagtgtttatgcagggcgagtgggagctgcaaggacccgcatcacagagccacccaagacccttcactatgcgaagcccactcaacatcttaaggacacggaattaggaatctcagtaaattttgtaaatggaaaagcaggcatgatttttatgacgacttgttaggccagagttcacaggtcccacattgcctggaaagagggagggacaagagctgcagaaatcacctttggagcccagccctgccagcttcctgggataggattttggaccaggtgttgaggcccaggatggccctggggacattgggggtttgatggcgacgctcacacactccttttctgccaaacgttagttacatcagctctaatttgacacactttcctttctaagatggaagccatgctggtgtgagacaggaaagcctgaggaccctctgcatcctcttggactccactggggtctcaccaggagctgtggccctgggatatgtgtgggaagcaatgtgggcccagtttctattatgttcctgccatcgagccattgaaatgacttaagttaactctgggcaacccccacagacctcgaaaggtagagtcctcccagaggacgcgtggccactaagctcaatcccaggccagcttaggggcttcctggaaccttgcaccaagcgtgggaaccacagggtgagtttccacagaagttggccccacaaggtggcacgttctgtgcaggcaggtgaggaagctgaggcacttctgtgtcttagcaggtggtgcctggggaaggcccggccttggccccatggttctctggagcctttccgagggcagctcctgggcagccatctttgctgtggccttgcctcttcaggaggatgtcacaatgacgtttgaatgcagaagccagtctgtccacggccgccaaacagagccctgatgctggcccagagccatgcaggggccacggggtgccagacccacaggccacagttgagaggctgctcaggagggcccagtggcacctgggccatatttgtgtttttcctgatcatggactgtgtttcctggttggttgaaatcacccctcatggtggagggtgggggtcttcagccctcgtggaagtacagggtcacagggctctgtgggccccaggtctccctctaaggttaggctcacaatgaaaggccagtcccagccctgctctgtgccaggcccacctcccatcaggaccactggctggcctgaaaaacatgccccaaagccttccaggagcctgtgggagtctctctgtgtgggcctaaccctagagggtctggtccacttaacactattttaaacaggctaaatttaaagtttttattcattaactgagagcaactaagcacgtctggtgcgccagacatcctgctggattttgtggatgcagaaggtggatttcatgcagctctgtccttgggtcagaggctcctccacccactgctctggggccagggggagccgctcagcttctgtgcctcgagtcctcagctgtaaaccaggggtagtggccctggaggtgtcatgagagccacgtgtgaagctcctcatggagtgcccagtcagcaatagctgtaaccgtaactatcgttgataaaataatctttaaaaaatgaaatagaaattaggttgagagtctgaaccaggctcagtggaggtctccgactctgatgagaggaatcagagggcgccaggacactggcaaacatattccctccgcacacctgtgcctcggcaccacagagcaggtctcagcacagcacggtggaaactggcatttctcccaccctcttgaacgttggtaatttagcacctccagctctgaaatcattgctttgtcctcctcctctgccccgctgtgtctttatcagaagggctgtggggccctgtgctctgcctccactgctgctgggagatttcaggcttctgtaacggcgccgtgacgtcacgtccccagacgctggaagtgaatgatcagtaaagtaacccacgtgcagtccagagatggttttagtaacatacgagggaagggggaggcgtcattaaaagtttcagagactcggaagaagtttgagagaagggaaatcagttgacacttttctgtgaagcagtttcctgtctttcccccctgacttgacagtggcgtgctcacctagactgacgtccaagggccctcttcacgggctactgaatagagaaaggcaggagcgtagccttggaggctcgtccaatgtgccttggatgggccagtgagcgagtcgtcacctgcaaacagcatttggtttcattcaatgggagcctcagttgttccattttgaacccatcatcatgctcctccttcggtttcagttattttattaaatagccctggcactaaaataaaagagtcagagttagaatggaatttgcctgtgggacaaggcgcagcatggattcgcctcgagggtaaatggaatggctgcagtgcttccctgccctcagcagccagacgtgaggtcggccaagcagccgcaacatccacacattagaaacaaaccgtagcaaattgcaggaactcgttgagagtgaaggtctttggtagatattgagcaattcgtgctatgagccattgggaggtatcctagtgatgccccatgagatggctcatagcagcccctggggaaagcaagttcctgccagagacaggatgccttcctaggccgagcacagtgtactgcatgtcctgggatgctttccaggtgctcagtggttctgctggactcagcagctcagtgctcattaggccaaagggcccgtggcctcgtcacactaaccagttgtatttactgaagtctttccattcctggcttactgcactaggattccagcaccagcattctcaacacacgccccggagtgctctggaagcagccttccccatacagcgggtgagcgtggcggccttccccatacaaggcggcgagcgtggcggccttccccctacagggggcgggcgtggcggcctttccagtacagggggcgagcgtggcggccttccccatcagggggcgagcgtggcggccttccccatcagggggcgagcgtggcgggcttccccatcagggggcgagcgtggcggccttccccatacagggggcgagcgtggcggccttccccatcaggcggcgagcgtggcggccttccccatcagggggcgagcgtggcggccttccccatcaggcggcgagcgtggcggccttccccatcgggggcgagcgtggcggccttccccatcagggggcgagcgtggcggccttccccatcgcggggcgagcgtggcggccttccccatcaggcggcgagcgtggcggccttccccatcagggggcgagcgtggcggccttccccatacagggggcgagcgtggcggccttccccatacagggggcgagcgtggcggccttccccatcgcggggcaagcgtggcggccttccccatcaggcggcgagcgtggcggccttccccatcgcggggcgagcgtggcggccttcccagtacagggggcgagcgtggtggctgcctctgcactaggacatcccttccgttgggagctcgtgacggggccactgggggttcatctcttgggttgcgaccctgccgctccccagggctgctgggtgcatggaggaggagcatcttccaccactgcccccatcttgcctgctctccatttcaagaaagaggaatgggagaggggcgtgggcaccggtcatgtcaaatattccaccagcagccagggtccaccttctgataagtttggctgtgtcaccttggaatctcctacacacgatggtcggcctcacagtcctggtctctactgttactcagcataattatcaggaagtcattctttcccactcggaggtgtcccagtttgaattaatgagctccgtggtcattccagcacacagacatttagcacagctgtcaaacggttattcagaaaatgagcacttggtggcattttggcttaggtatttttcttctttgttaagatagatgcttctcagtatttaaaaaaatgcatgaaaacccagaactcattttcttttctgtccagtgtttaaatgaggagaaagctcttagtcatcttgctaatgaacaaagactgaataagcacaggaagtgcgtgaccagaggctgcagcgctgccgtgcagattttgctgccccgtaaatatagggacttagagatctgggccccggcttctcccctcccctctcagctgatgaaatattttaattggaaatttaagctttatatactgacgatctttgaaggtacaatcaacttcctgtgaattattttataaatcattgttttctatgtacccatcatcaaaaatgaaactctagcgtagatggagaaatatcctaaacatattgcctttcagggccttcatgctggtgacgtcataacagaattattttattttattccactgggaatataatcatgctctttctctttgttcattagcgagatgactcagagctttctcctcgtttaaacactaattgagcacttattgatcactaaatcaaggtgtcgttacgacttctgcattgtgagggtggtaacgcttcctgttttattgactgtggtagcaccagttcacagtccttgaactcatcatgcagaacaccataaattccctgtccactctgttactgaggaggtttagtcagaaattcattacttaccaataccattaactagctgatttatcttggaaatgtttaaaaaacatatttaacatacaagaaatggtgctagattaaggaaatgattaaggaaagttagtttctgtcctttaggattttacagttttgctgggtaggagggagaaaacaagcaagcaaaaaatataattaaaaaattaaagcaagtgctgtgatggagggaacacagaaagtaaaggtgcactcatgccagagggggcaggtggcccaggcgggcttctgacagagggggcaggtaggcccaggcgcgctcatgccagagggggcaggtggcccaggcgggcttctgacagagggggcaggtgggcccaggtgcgttcatgccagagggggcaggtggcccaggcgggcttctgacggagggggcaggtgagcccaggcgtactcatgccagagggggtaggtggcccaggtgggcttccaagaggacggccttgggggacgaccaggagacacctcctgcaggtgtacgatggacgtagggtgcagagtgtcaggagcccattctcctcccaccccgaccacatgagtgagcccccgggagaaatctgccaggagactatccccctcccaccccaacaacacgagtgagccccaggagaaatctgccagagctgaggacacaggaaaagaggatgaactgcattccagaaagggatggatgaacccattccaaggagaggagaccacagcttctttcatgcgcattggaatggaagaagcagaagccagtcacaggaagtggggagaattcggcctaaattttaagaaactcttgaggtgcatggaacagatttgagagacaggctgtgcaaagcgagtgtctgcacccccgcctctttcctgtgggctttcgctgagtatgtgagatgcggcactagggatggaggagggagagggctgggagaaatcctgccaaggagcaccaggcctctatggagtgccccatgtggccttctgaagactggggacaagggagcatggtggaaaaagatctgttgaatctttctaagggtgcagaaagccagggtgggaccgacggggaagagaagcttcagaaactcacaaactgacacttggaccataaagcagagagctcccccatggttcagaaacctggcggctgagtgcagagcataaagggatctcgagtctcactggagcccagatccaagcctgggcgaagaaggcaacttagacctaaaggatggaaaatgtgtacgatggaaactcgaaaggcaggaaagctggtgtggtcatgttaatattagacagagtggacttcaagactaaaagtgttattcatgacagagacactttatgatgactaaatggtcaattcattaagatgctatagaaaaatgttatgaaccaatttcagagcttcaaatacataaaggaaatatatgagagtactaaagagaggaacatacaggtcgatcatgatcattaatgattgaaactctcctctgtcagtaactgattaaacaaatagataaagtatcagtaaggatagagaagatttgaaccacagcattaaccagtctaagctaagtgatgtttatagaatgatacacctaaaaactgctaaacacacattctttttgagtatgttatatagaatatttcccaaactagatcaaatgctgggccataaaataagtctcaataaatgtcaacagatcaaaatcatacagagaaagattttaaaagaaaactgcagattattattcttcagaaatatagaaacaaaaattctaaacaatttttatcaaattaaattcaacaatatataaaaaagaatactgcatcataatcaaggcagatttatcccagatatgcagggtatatcgaacatttaaacatcaaccaacataactcaccatagttacatagaccatgtgatggtctcagtagatactggaaaaagcatttggcaaaacccagcatccatccatccatgacggaaacctacatctaagattacatcaactggtgaagggctgaatgctttccacttaaaatctggcattagacgaggatgtctgctcttacctcttcaattcaacactgcattgaagatcttttttttttcttttgagacggaagttcattcttcttgcccaggctggagtgcagtggcacaatcttggctcactgcaaccctctgcctcctgggttcaagtgatgctcctacctcagcctcccgagtagctgggattataggcacccaccaccatgcccggctaatttttgcattttcagtagagactaggtttcaccatgttggccaggctggtcttgaactcctgacctcaggtgatccactgcctgtcacattgaagatcttagccagtgcaataaaacaagaagaaatgagaggcattcagattacataacctttgtcaaaaatttggtggaacctacagaaaagctactaaaactagtaaatatagcaatgctgtagagtgcaaagtcagcacacaaaaattaatttatttctgtatactagcaacaattaaatatgaattttaaaaaatatagtagcatcaaaaattatgaaataattgaggttgaatctaaaatatgtgtaagacaatgtacaatgaaaactacaatacattgatgagaacaataagacaaattaatggtgatatatacatggtcatgtgtctaaagactcaatagtgttaaggtagaaattacctccaaattggtatcaatatgatacaaaaacacaatccttaaaaaaaattgataactagaactttgtcaaaatttaaaaattttcttcttcaaaagaagacacttcttcgaaagacacacaaaagattgaaaagacaagccacatacttagaaaaatacttgcaaatagcactttttaagataaaaaatttcagaatgtataaaaatctctaaaaactaaaaaagcagcacattaaaaatgggcattttttttcaagacagtggattagaagcggtgttagcatgcctctcccacttggaaagacaaaatagtgtgtaaagattcacactgtgaacttttttccaagaagcgacaccagaacttgacaggaaaactaaaagaaaccacagaacctttgaaagaagtggcaggctgcagcctacactgtgagccaagcaaagaactgtaagccccacagtgtgagggggagacactgcctccaagatatgcacccccactggagaattcagcccatgggggcgggaccttaaccctaccaagtcctggaactgatttagggagcagtggagaatataaagtaggagaagcagtagaaagagccctgtgtgcattcccagtctccagcatggattggggaagccattctgcctcacaggggaccttgcggaagtctgccaaccaactcagtcagtggccacgggttgagagaagctcccaactgaaatttgcaatctaatcttgagtggggacaaactcccttggccataacccaggggggagtgggaagcacgctgcagccacaaacacaggatctgggagcctggctttgctgctggactgggatagatgtggtctgaaagccacacttcctgtctccatgatgattgggacaatatctcacatctcaatattagtgttgaatgtaaatggcctaaatcctccatttaaaagataacagattggtagaatggataaaaagacacaaaccaaatatctgctatctcaacatagtcacctaacacataaagatgcatataaagttaaggtaaaggggtagtaaaatatattccatgcaaatggaaaccaaaagtgagcaggagcattctaatatcagataaaacagactttaaagcaacaacagtaaaaagagacaaagaaggtcattaaatgatgataaaagggccaatccaacaagaagatattacaattctaaatttatatgcaccaaatgctggagctctcagattcataaaataattactgctagatgtgagaagtgagataggcagcaacatgccaacactgggggacctcaatacttcactgacagtacaggacagatcattgagacagaaagtcaacaaggaaacaatggacttagtctacactctagaacaaatggatctaacagatatttacataacattctaatcaagaactgcagaatatacattctcctcatgagcacatggaacattctccaaaatagagtagatgaagaaaatgtggtacatatacaccatggaatactatgcagccataaaaaggaatgagatcatgtcccttggagggacatggatgaagctagaagccatcatcctcaacaaactaacacaggaacagaaaatcaaacactgcatgttctcacatataagtggtagttgaacagtgagaacacatggacacaaggaggggaacaacacacaccagggcctgctgagggttggggggagagtggagggaaattagaggacaagtcaataggtgcagcaaaccaccatggcacacatatacataggtaacaaacctgcatgttctgcacgtgtatcccgtctttttagaagaaaaagtaatgaaacaaaaaaagactgtatactaggctacaaaacaagtctcaataaattttttaaaattaaaattatatcaagtatcttctcagaccacagtggaataaaactagaaatccactccaaaaggaattttttaaactacacaaatacatggaaataaaaaaatatgctcctcaatgatttttgggttaacagtaaaatcaagatggaagtttacaaattctttgaaatgaatgataatagtgacacaagttatcaaaacctctgggatatggcaaaagcaatgctaagaggaaagttcactgtgctaaatgcctatatcagaaagtctgaaagagcccaaagtgacaacctaatgtcacacatcaagtaactagagaaatatgaacaaactaaacccaaagctggaagaagaaaataacaaagatcagaacagagctaaatcaatttgaaggaaagaaacaaatacaaaagatgaaacaaaaaattggttttttgaaaatataaacaaaattgatggaccattagctagattaatcaagaaatgaagagtgaagattaaaataagctcaactataccacagaaatacaaaagattattcacgactattatgaacacttctatgcatacaaactagaaaatctagaagaaatgaatacacgaatatattcctgcaagcatacaaccctcctagattaaattaggaaggaataaaaaccctgaacagactaataacaagcagtgagattgaatcagtaacttaaaaattgcccataacaaaaaaagcccaggaccagatggattcacagctgaattataccagacactcaaagaattggtaccaattctactgaaactattccaaaggatcagggcagagagaatcctccctaactaattctatgaagccagtatcactctgacactaaaatcagggataaaataatgaacaaaagcaaactatagaccaatatccctgatgaacatagaggcaaaaaccctctacgaaatactagctgactgaacccaacagcacatcaaaaagataataaaccatgatcaagtgggtttcatcccagggatgcagggatggtttaacacatgcaagtcagtaaatgtgatacgtcacataaacagttaaaaacaaacaccatacgattatctcaatagatgcaggaaaagcattcaataaaacccagcatcacttcatgataaaaactctcaacaaactcggcacagaagggacttacctcaaaataataaaagccatatatgataaacccacaaccaacattatatggaatggggaaaagttgaaagcatcccccctgcgaactgaaagaagacaaggatgcccactctcaccacttctattcaacatagtactggaagtcctagccagagcagtcagaaaacagaaggaaataaagggcatccaaaatggaaaagaggaagtcaaactattgctgtttgccaatgatatgatatacctacaaaaccctaaagactcctccaaaagactcctagatttcataaacgaattcaggaaagtctcaggttacaaaatcaatgtacacaaatcagtagcagtgctatataccaacaatgaccaagctgagaatcaaatcaagaactcaatcccctgtacgagggcttcagaaaataaataaaatacctatcaatatacttaaccaaggaggtgaaagatctctatacagagaactacaagacactgctgaaatacactgtagatgacacaaacaaatggaaacacatcccatgcttatggattggaagaatttcatgaaaatgcccacactgcccaaagcaatctacagatttaatgaaattcctatcaaaataccaacattattttcatatagcaccaaaaaatagcccaaatagcaaaagcaatcctaaacaaaaagaacagatctggaggcatcacattacctgactccaaactatactacaaggctagagttaccaaaacagcatggtactggtagaagagtaggcacatagaccaatggaacagaataaagaacccagaaataaacccaaacacttacaaccaactgatctttgaaaaagcatagaaaaccataaactggggaaaggacacctgtttgataaatggttttggtaaaactggatagccacatgtagaagaatgaaactggatctctattgatgcagggtaaggagccccaaagtggggcttagcccaccagggttcttggctttgcccaggaaagaattcaagggcaagctggagataaaagaaagcaaccttattgaaaaggcagtgttacaactctggcagtgttttagctctgtgactgctcctgcagagccaggctaccccataggcagagagtagcagctcagggaagctttgcagtcatatttatagctacttttaattacatgagggttaagagtggtttatgcagaaatatctagggaaggggtagtaacttttgggtcatcaggtcattgccatggaaaggggcagttactccttggtgttgtcatggcaagtgtaaactgacatggcatattggtgggtgagacttatggaaacctgcttccaccttggccctgttttaactagtcctcaatttggttcagtaacccagcccggcctctgaagttgagtcctgcctcctacctcattatctcttaccttatacaaaaatcaactcaagatggatcaacaacttaaatctaagacctgaaaccataaaacttctagaagattaagtaggaaaaaatcttctggacattggccttggcaaagagttcatgggtaagaccccaaaagcaaatgcaactaaaacaaaaataaattggacctaattaaactgaaaagcttcatatagcaaaagaaattatcagaaaacccacagaatgggagaaaatatttgcaaactatgcatctgacaaaggaccaacatccagaatctacaaggaactcaaacaatttagcaagaaaaaaaaatcccattaaaaagtggacaaatgacgtgaacagacatttcttaaaagaagatattcaaatgggcaacaacatatgaaaaaaatgctcaacatcactaatcatcaaggaaatgcaaattaaaaccacaatgagataccaccatactcctgcaagaatgactattattaaaaagtcacaaaacaatagatgttggtatgactgtggtgaaaagggaacacttatccactgcaggtgggaatgtaaattagtacaacatctatggaaaacagaatggagatttcataaagaactaaaagttgatctacccttttgatccagcaatctcactactgagtatccaaaggaaaagaaatcaatatatcaaaaaggcacctgtagatatatgtttattgcagcacaattcacaattgcaaagatatggaaccagtctaagtgcccattgactgatgagtggctaaaggtgcagtggctcacgcctataatcatagcactttgggcggccgaggcaggtggatcatgacctcaagagattgagaccatcctggccaacatgatgaaacctcgtctctactaaaaatacaaaaaattagccaggcgtggtggcgggtgcctgtagtcccagctacttgggaggctgaaggaggagaatcacttgaacttgggagttggaggttgcagtgagctgagattgtgccactgcactccagcctggcaacagagcaagactccatcttaaaaaaaaaaaaaaaaaaaaaaaaaaagaaagaaaatgtagtatatatatacaccatggaatactactcagccacgaaaaagaatgtaataatgtctcttgcagccacttagatggagctggaagccattattctaagtgaagtaactcaggaaaggaaaatcgattaccttatgttctgacttataagtgggagccaagctatgggtatgcaaaggcagacagagtgatctaatggactttggagactcagaagcgggagggtgagaggggagagggataaaaaaacctacatattgggtacaatgtgcattacttggatgatgggtgcattaatatctgagacttcaccactattaaattcatacatgtgacccaaaccatgcgtaccccaaaagcttttgaaatttaaaaaatgggcaaaagatttgaataaacacttcaccaaagaggataaatgagtgacaatttaatgtgaaatattcagtatcattcctcattatggaaatgaaaattgaaatcacagtgaaataccactacaaacctataagaatggctaaaatttaaaaaaacaaaatacaaactgaccatcctatgtattggcaaggaggtggaggagctggacctctcatatgccaccagtggaaatgtaaaacattaacaacgatttggaaaacgtcttgacagtttcttcaaaagtgaaatgtttacttgcctgtgatccctccatcccacttctactcaagacaaacgaaagcatgtgtgcattcaaagatttacacacgtatcttcatggtagctttcatagtaaatgcccacaactgaaaaaacccaaatgtctatcagaaatggacaaagaaattttgtttgatccacaaaatggaatgctactcagtaataaactggagtgagctgttgatgcatgaaacagcacagtgagtctcatttctgttgaccaaaagacaaaagaggagctattgttataattccagtttggaaagctgtagaaaatgcaaactgggttataagggacagaaagctggtcgggattgcctggagctgtggacagggatgggagagggcagtgtctccaggggcaccggaatgtattcagggtgacggacgtgttcattgtcatgcctcctgtactgtttattgtatgtcaattatatctcagtagtgctccaaagggaaaagaggcaagcaatcccatgcaaaaatgtataaaaactttgaacggatacttcataaaaagatatacaaatggccaatgaaggcatcaaaggtgcttagcatccttattcacaaaaccataaagaacaaccacttcatgtcactagattggctaaaattaaaaaaaaatccataaaaccaactcttgatgaggacatagaaattctcaaattagggggaatgcaatgcaagctgttataacctgtatttggaagctgcttaaaggctaaagatacgtctgtccttggactcagcagttcccctctggatgtctatccaagaggagggacgcctgcattcacaggaaagctggcccatgactgcccacagtggctctatccagaacagccccaaactgtcaccacccagatgtggtcaacaagcccaccttcccctatccctgtttctggaggagggccacctagagagattgtgcagagatagcacagcttccctcacagccctctgcttagccatgccacctggaggagcaggtgtggaggcacacagcgatgaggaccgtggcctccacatgttggatgccacattcacgatgtccatttgagttttttaaaagtttgccccctcatgtgattgttcttatgacctttggtgggaagcggagctctggtggaaaattggccccagggcatggtgttctgctcccagcatacacagtagcatctgaggcagagcaggttgatgcatgctggccaccgtcatcctgactgtctcccctggtttcctcccagacagtcctgtccctgccctccactgaacactcacagtgacagctaccacccaccctgcactagcagtccctccacacccagacctgtgctccatggaagccgacctgcttacggttcctctgttcactcggcgtgtttggtgtctgtcactcgacagacatacacagcctagggagaagggctgcatcttagctctgccctttcctcactgcaggatcttctttcctcatttgcaaaatgtgggtaatcatgtctgtaccatcgagtcattgaaagggttagagaaaattaaggcatgtaaagccgaaaacagcctggtgtagcactcagtgaataagagccccgtggcgatgactgtccctccatcttctgggtggttatgagccaactgacctctaaccccaggccaaggtggacgggacatggattggaactcgctgctttaatcatgccctgtgcttttcacttgccaggtaggaggcttttgggtgcagcttctggaaaggccaaaacgcaaacaggagccagaagagtgacagaaggaagagtggcgggcaaagtagggtgggctgagagcagtgctggcctcacggcattgcgagtctcggagcagggcgggctgagagcagcactggcctcacgatgtcgtgagtctcagcagggcggggtgagatcagcactggcctcacggtgtcgcgagtcttgagcagggcagactgagagcagcactggcctcatggtgtcacgagtcttcagataattccagactctcagaatgcatcatcattagcagatatccaggagttcacattggcaccccgtgatactgtcaactcgctacaaatttgttgatcccaagtagtttaggacttaacctcttcaacctcatagattttgtgaactctgaaaactgtttggggtcttatttttcagtctgagagctctataccttggctgcagagatagcaccgtatacgctcgtgtgagacccccctgcttccctgaatgcaaaaaagttattttgtcttggcgacagcactgttggtaagaatgacaccacaattatttcccctccacacgagtgggccacttagagcctgagcactgttaaacactgacactttctactgtgttaagacagagacagaggcagagatacacagagagacagagacacagagagagacagagaaaataaatgagctgccagaatcacctctctaaggcccgagacagaaaggcacagtgaagtcatcccaaccccacattcacgagccggagccggagctgcagcgttcccacctcagctcccaaacctggccgcatccggtgccggctcattaggaagcctgtgaatagcactgaggctgtgtgctttgtcaggctggcagcaagcacgccgtgatcaaggtgcctgtcagtgctgccggcgggcagtgagacagggagaaaacgtgtgttatgtggtcaaaagatgtcccaacttgggcttcctaatttgttttggatcctcggtgcaggagaatagctgatgagcatgggcagagaccagtgcacacacaggagtctcctccacccagagtctcccggcatgtgggactccccggacctccaggccttcctgtcagcctgaactcataattgtgcctttgggactgggctgggtggatctccaggagaggcatgtttgtcaaaggaagaggcctgatttttagctctggtactcccggccccagtaaagttgggagcgaggagagtcacttcctcagcagtgtcactgtttgacaggtgaggggtatggtgcagggcgtggctctgtgaactgcatcagctggctccaggaagcagctctgatttcctccagctgaagagaatcacattcttccaaaaccaggattgcttttctgaccctttctaatagcattctttcaattacggttgttaatgtctatgactcaactcctagttcagtctgcaagatgtttgaggacagggccacatctgagttattcttccttcatagaagtccagggcttggcacacagcagcagtaggggtttgatgatgctgatggcgggggtgacactgatggtgtggatgctgctgtggatggtgtggatgatgatggtgctgctgctgctgatgatgatgatggtgggaagctgatggttgaggtgatgatggcagggatcatgttgatggtggaagtgataatggtggggatgctgctgtggatggtgaagatgatgatggtggggatgctgctgtggatggtgggatgatgatggtgaagatgatggtggtggggatgctgctgttgatggtggagatagtggagatgatattgttgatggtggaagttgttgcgggaagtcagggaccccaaatggagggaccggctgaagctgcggcaaaacataaattgtgaagacttcatggacatttatcagttcccaaaattagtactttcataatttcttatgcctgtttttactgcagtctctgaacataaattgtgaagatttcatggacatttatcatttccccactcaatactcttataatttcctatgcctgtctttaatctcttaatcccatcatcttcataagctgaggatgtatgtcacctcgggatcctgtgatgattgcattaatggtacaaactgtaaaacatgtgtttgaacaatatgaaatcagggcaccctgaaaaggaacagaacaacagcgatcttcagggaacaagggaagataacattaaggtctgactgcctgcggggtcgggcagaatagagccttatttttcttcttgcagaaagcaagtaggagaaatattgctgaattcttttcccagcaaggaataatcctggggaaggaatgcattcccaggggtaggtctatgaatggccgttctgggagtgtctgtcttatgcagttgaagataagagatgaaattctccctggtctcctgcagtgccctcaggcttaccaggattgggaaattccagcctggtgaattctagtcagaccagttgtctgctctcgaaccctgtttcctgttaagatgtttatcaagacaatgcatgcccagtgggacactcatcagtaattctaatttcaccccctgccttgtgatcttttattgccctctgaagcatgtgatccctgtgacctactccctatttgtacacccctccccttttgaaatccctaataaaaacttgctggttttgtggctcaggtgggcatcacagaacctgccaatatgtgatgttacccctgaaggcccagctgtaaaatttacctctttgtactctttctctttatttctcagactggccaacacttagggaaaatagaaaagaacctgtgttgaaatattgggggctggttcccccaataggaagtgatgatggtggggatgctgctattgatggtgggatgatgctgatggtgagggtgatgatggtgtggatgctgctgttgatgatggggtgatgatgatggtggggacgctggtggtgttggtggtgatgggatgctattattgatggtggagatagtggagatgctgttgttgatgattggggtgatgatggtggggatcctgctatggatggtgaagatgatattggtgggatgctgctgtcgatgatggggtgatgatgatggtggggatgctgctgttgatggtggaagtgatgatggtggggatgctgctattgatggtgggatgatgctgatggtgaaggtgatgatggtatggatggtgctgtggatggtgaagttgatgatggtggggatgctgctgtggatggtgggatgatgctgatggtgaagatgatgatggtgggatgctgctgtgaatggtgaagatgatggtggggatcctgctgtggatggtgaagatgatggtggggatcctgctgtggatggtgaagatgatgatggtgaagatgatgatggtgggatgctgctgtggatggtgggatggtgatggtggggatgctgttggagatagtggagatgctgttgttgatggtggagatagtggagatgctgttgtggatggtggagatagtggagatgctgttgttgatggtggaagtgatgatggtggggatgctgctattgatggtgggatgatgctgatggtgagggtgatgatggtagggatggtgctgtggatggtgaagatgatggtggggatgctgttgtggatggtggcagtgacactaatggtgataatgatactgctgatgactgccatttatcaagttcctcctctgagttgtgtgctgagcaaggcacttttacctatactctccctaatcctcacagtggcttttaaagaaaacagaattatttttctagttttgcaggtggtgaaaatgagacttcaagaggttagataactggtccaaacttacacaagttacacagaactgacaggattgggccagtctttcagtgagccttctttcctgctggctttttcagtgtgtgggcgagtgggttctgcttctcgtcatatggaaatgcagtgggttgaagaatattcccagtagaatatcatgtcagcttaaacatcatcagactttggcagaagctctcgaatgcttcatatccacagctgggctaccccagagatgctcagccggatttctcttacacatagtttgaagacttcatgcacaggaatgtccatcgcctgtactggaaattagtctgtgtctatgccgttaggctgctaatttccaggtttgggcagctacggtcttaaaaattattccacattgtcttaggaaacctcccttcattggtatgttgaactgagactgaaaacatcttcacaacagggggtttgaaaatgagtcacagaattttaaactcagagctgagagtagaagaaaaagtctaattggatagtttctcctcagttgagatgtggatttcctgactgctttaaagaatatgaaggtataggctgggcatggtggctcacgcttgtaatcccagcactttgggaggccaaggcgggcagatcacttgaggtcaggagtttgagaccagcctgaccaacatggtgaaaccccatctctactaaaaatgcagaaaagttagctgggcctggtggcgcgtgcctgtaatcccagctgctcaggaggctgaggcaggagaatcacttgaacccaggaggtggaggttgcagtgagccaagatcacgccattgcactccagcatgggttacagagcgagactatgtcttaaaaaaatgtgtgtgtgtatatatatatatatatatatatatatatatatatatatatgtgtgtatatatatgtgtgtatatatatgtgtgtatatatgtgtgtatatatatgtgtgtatatatgtgtatatatatgtgtgtatatatgtgtgtatatatagtgtatatatatgtatgtgtgtatatatgtgtatatatgtgtgtatatatatgtgtatatatatgtgtgtatatatgtgtatatatgtgtgtatatatatgtgtatatatatatgtgtgtatatatatgtgtatataatgtgtatatatgtgtatatatatgtatgtgtatatatatgtgtatatatatgtatgtgtatatatatatgtatgtgtatatatatatgtatgtatatatatgaaggataaggtaaagtaaataattgtaataatagtagtagtcatagccattaacacttccgtgccagatactattattattatccttgttttacagattacttaaatagtgtgctgaagcaaaggtcattaagctcgtagcattggtggtagtttaaacccaggcagctccagagccagttccttttccttggggacctcaaaccgtgaaagagccagtcagcgtgagaatacttttctttactgcccatgttcccaactctcaggccctcttggttatgggatggtcacctcaccttggtgagaaacaccccagtgtctgcaatcatctattgagtagccggagtggcttgcaaaaaccgatgtttgctattatttctacaggctctgttgtttgtgctaactactgaaatattctttttcctcttcaccttaatttgattcagaacataaaccaaaaatagattgtttatccaagtctactgcacagatcacactctgctgtgattgtgtaatgcactgaacctagtcagtcctgcacctggagcttccaactcaactttaattaaaggccctttgcgtggaagctccaggttactgcattcatagcaatgaggggaaagccacttgcaggcacataacgagggatttggacgcagatccccaccccccagcacggtggctgaccaggtgttcagagacagcctttgcaagagggagtgcaggctgagctggagattgacacttacacccaatttgtgggaaattgctagaggggctgtttgttgtggtggcattcactgtctctcgctcgctcgctctcgctctttctcacgctcttgctctctcacatattctctttcttaagggaagaatagttgatttcagctagtccttggacaaatttaagcaatttggatgatagctatagtcacatcactttagaaataataattaaaatatcttagagataatggctgggcacagtggctcatgactgtaatcccagcactttgggaggctaaggcaggcccatcacttgaggtcaggagttcgagaccagcctggccaacatggcgaaaccccatctctactaaaaacacaaaaattagcagggcgtggtgaagggcacctgtaatcccagttactcaggaggctgaagcaggagagtcgcttgaaccccagaggtggaggttgcagtgagccgagatgtgccactgcactccagcctgggcgacagtgagagactccgtctcaaaagaaaaaaaaaaatcttagagataatgtccgatttccttttttgacagaagaaaattgagtctttaggggtcaagtaatttacccaagttcatatatgagaactgaaatcagaacctaattcaacctggccaggcgcggtggctcacgcctgtaatcccagcactttgggaggctgaggcaggcggatcacttgaggccaggagtttgagaccagcctggccaacatagtaaaaccccatttctactaaaacacacacacacacacacacacacacacacacacacacactcacaaaagcagccaggtatggtggtgtgttcctgtggtcccagctacttgggaggcagagacataagaactgcatgaaccaaggaggcagaggttgtagtgagctgagattgtgccacttcactccagcctggatgaaagagggagactctgtctcaaaaaaacccagaaaaaccaaacaaccccaacctctatcaacccacttcccaactcccaggttgctactcaaaaatctaactcagaggatgaacccaaatattttcggaaatagccagactcaggagctggacccccttaccttactgtcagtgatggctgcacacccttagctagtgccgaggtgtccacctccactgacatgacattgatcatgtgccccaaggaggtgcaagtagaaaatatgaacggatgggatttaaactggggtgtccacacacccatgcacgcctccagggagctcagcttgtgtgtccaggattcgaaagtctctaagctggaaattattcatactcagcctgtccatgacattttgatgaagcccaagtcagaggtacaatgtggggacttttcacatttttacagctgccctagaggtgaggacagctgggccttggtttatctagtgacacaaagtgtgatgaggacatgtcctcttaacggaattttactaaatgagtgaggagaaaatatagacagaaatcccatgaaagactgttagccagggcattgactagtaaatgatgtgataggtaattatcgaacaagagaccctggcatcttccctgctgcagcacactgcagttaaaagagcaggcagcaaacatgtttcaggtcttcagtaaagaagttggagtgaagacctccagacaaggcacttgaggcctctgctgagggttgctgaaagagagattcagctattggggagcagcttttcagggttaaaataaaaaccagtgcaggcaaaaaatacaaacagacatttcttcagagaagatgtaggagtggtcaataagggcacacaaagatgcagcatcattagccaccagggaggcaccgccgagcctcatgaatgtgtctgggagcagctcctctcattgctgtgaatgcagtaactccgagctgccgtgcaaaggacctttagttaaagctgagttggaggctccaggtgcaggacatactaggctcagtgcattatgcaagtgacacagcacggtattgctttccaactgctaggacaaccatagtaaaaacagaaggaaagtagcaagtgttggcaaagatgcagaggaactggcatctgcatccattactggtgagattgtttgtggtgctgctgtgctggaaaacagcttgggagttcctcagtcagttaaatgtcgagttaccatgtaatatcctcgaataaacccaagagaattgaaaacacattgatacacagactcataaatgaatactcatagcagcattattcaaaatagccaaaaggtagaaaaaagcaaatgtccatcaactgataggtgaatttttaaaatgtgggatatacatgcagtgggatagtacttggctgaaagaggaaggatgtcctggcccatgccccagcatcagcatgggtgcacctgaggacattatgcttagggaaatgagccaggcacagatgccacacatggtgtgattccatttacaccaaacgtccagaagagactcctccatagagactgaaagcgaatgagcagtgtcagggtgggagggaggaatgggaacactgcaaagtctctttttgggtgatgcggatgttctggacttagtagtgatgtctcacaactctgaatacactaaaaactgctgatgtgggtgaattatctccataaagctgatattaaaaataatgcaggaacaaatatgaaatagggacctgggttggtcagtgtgaaaatgagagtcctgttttggctttacatttcagagatgtccagggctgtttaggaccttgaacctgagaccgaagggcatctttgtacccccagggctgtttaggaccttgaaaactgagactgaagggcatcttggtgcccccagctgacgatggaaatgtgactcttgctctgttttgctctcctttccttcagggtgatgaccgcttctccgagagcatcctgacctatgtggcccacacgtctgcgctgacctaccctcccgggtcccggacccagctccgcgaggacctcctgccgcggaccctcggccagctccagccagatgagctcagccctaaggtggacagtggtgtggacagacaccatctgatggcggccctcagtgcctatgctgcccagaggcccccagctccccccggggagggcagcctggagccacagtaccttctgcgtgcaccctcaagaatgcccaggcctttgctggcaccagccgccccccagaagtggccttcacctctgggagattccgaagacccctccagcacaggcgatggtgagccagccccgcttggtgtttcttgtttgctgactgtcctctgtccagcccctcccagtgacagacgcaccatgctcttcccacacgtggggtctgcacaccgcactcccccgaggacgcgtggcaggaatggggcaccatgtagggaagggtcccttcggccctcataccctctctgtgctgggaaggagtatgtggtcatttcacgtcctgggaacgcagtggccagtgagaggcgggaggtgatcctgacagtgggatggagaaggcgctgctgagggtgtgaggacagtgaacacagcggccagtgggaggggaggtgatcctgagggtgtgaggacagggaacgcggcggccagggggaggaggagatgatcctgagggtgtgaggacagggaacgcggcggccggggggaggaggagatgatcctgagggtgtgaggacagtgaacacagtggccagtgggaggggaggtgatcctgagggtgtgaggacagggaacgcggcacccggggggaggaggagatgatcctgagggtgtgaggacagggaacgcggcggccagtgggaggaggagatgatcctgagggtgtgaggacagggaacgcggcggccgggggggaggaggagatgatcctgagggtgtgaggacagggaacgcggcagccagggggaggaggagatgatcctgagggtgtgaggacagtgtgtgttcccttctcacttcttgttcatcccttccccagattttatgatttcacaattctactgctgaagctgatggatggggcgggcaacatggcttgcaggacgggtctggcccacagcttgtgtcatccatatctgttttggaaaattgactctgaacacgttaagtccagtgtcctttgtcgctgaactcacctctccctgtggcccagcatgtgaccgtagcccatatttatggcggtttgccacatcctccgaagccccctgtctggatttcatgctgctcaccatgcactagctgaacagtgtcggcctcgaggtgactgctctgccaagaccgtggcttccggtgtcgctacctgagttaagccacgtcagggcgggcccaggggagaaaggcgtttgcgggttcctgcgactctttgtgatatggagaaggttccgacccatttatttcccaacagccttttcccaagaccatcctgcagtgggttctgataaaacatgacttcccttttggagataacaaatactaaaatttcacaaacattgcctgagcatcgcgttatgtgagcactctctgctccttaagtgaaggctgaatgggagccgctgagagcgagcatcagcttctctgctgtctgcagccgggagctctcctgccctcgctctttctttgttcatgcagccgttatggcagtttttaaatagaaggaatgtgaaattgcaattagagggaaggacgtgtgaccattaccgatgctttctccttgttcctctcttggaggagaaggacggcggaggaggccgatgctgcacttgagtgagtgctgctggagcattgatggtgctgtttgctacgggagctgcccgcctggagtggccactttccctccagcacctctccctctgggacgacgtctcctctgttctaagccatgctctactccgagaaacccctttccttgatggtcctgcctcctgcacttgcgtgggtactagacaccatcagggtcttcactgcctcctgcactttcgtgggtactagacaccatcgggggtcttcactgcctcctgcactctttgtgtactagacaccatcaggggtcttcactgcctcctgcgctttcgtgggtactgaatgctatcaggggtcttcactgcctcttgtgggtactagacaccatcgggggtcttcactgcctcctgcactctcgtaggtcctggacgctatcagggggtcttcacttgcgaccttgggtccgtgtagctgccgagcttcctgttctcctccagctcagtgtggcctcagcccttggccacaggcggtgaatacatggctgaggtgaccttcagcttctcatctcagccttccttgcccctccccggcaccggctgcccctctacctgcattctcccacctctatactccttctagtggggtcactttgggtcgtcctcttccttctctaacctcccttttctctctcctatcccatctcccacagcttaaaaagccccattcacctctgtcctcattattgggaacagaaagcaataaacatcgtcgcccccatcagagggagggaaacccagctggagagccgggtgagggtgagctcacagagagaataggacgcattcctgctctgcgtgccttccctacgtgcgcgccttccctacgtgcgcgctcccgctctgagccctccctacgcgcgcgctcccgctctgcgagcccttcctacgcgcgcgctcctgctctgcgtgtccttcctacgcaccctcctgctctgcgagcccttcctacgcgcgcgctcctgctctgcgtgtccttcctacgcaccctcctgctctgcgtgcccttcttacgcgccactcctgctctgcgtgcccttcttacgcacgcgctcctgctctgcgtgcccttcctacgcacgcgctcttgctctgcgtgctcttcctacgcgtgcgctcctgctctgcgagcccttcctgcgcgctcctgttctgtgtgcctttcttatgcaccggggagcttcacctccctgccttggcgccttctcgttcctcccacaccccagggtgtggatcttcggaacaagcgtcctgaccgtgctctctccactctcccgtgatccctacgagttacacaatgtgcttggcattcttcctgagctaccctgcgatgctggtgatattctgataaaaactgacttccaaactgcactgtgcgctttagaaaagcctcatgtaaaacggcaaataggaaatacgcagagagaattgagaaccccatgcaggtatcacctatgaaatacacagagaatactgatcacctatgaaatatgcagagagaattgagaaccccgtacaggcgtcacctacgaaatatacagagaatattgagaaccccgtacaggcgtcacctatgaaatagaattgagaaccccgtacaggcgtcacctatgaaatagaattgagaacccggtacaggcatcacctatgaaatacacagagaatattgatcacctatgaaataagcagagagaattgagaacttcatacgggcgtcacctaagaaatatacagagaatattgagaaccccgtacaggcgccacctatgaaatatacagagaatattgagaaccccgtacaggcgtcacctatgaaatacacagagaatattgatcacctatgaaataagaagagagaattgagaaccccgtacaggtatcacctacaaaacacgcagagaatattgagaacccggtacaggcgtcacctatgaaacacgcagagaatattgagaaccccgtgcaggcatcacctatgaaacacgcagagaatattgagaaccccgtacaggcgtcacctatgaaatagagagaattgagaaccccgtgcaggtatcacctatgaaacacacagagaatattgagaaccccgtacaggcgtcacctaagaaatagagagaattgagaacctggtataggcatcacctatgaaatatacagagaatattgagaaccccgtacaggcatcacctgtctcccacaagtggtgactctcaggctttcctgatgctcctctgcgcccactacagccccctgctctgccctgggatgattctaaagcaaatccagacatcgaatgatttctgaagatgtgaggccctagctagacagacattctcaacacacaaagagcaactgcacccgagcaggaagggaggaccctgtgataatgccagggaacagaaaacttctttacaggtcagagaacagggccaccctcctgtcgcacggtcgggtccaacatgagacccttgctgtttagtcttcagagagtgggagagaagacccacgcgtacctgctcccaaagaagcagtcagtcaacgaggctgcgggctgaacgcatatgacaaaagtttacctggtaaaagctttaaaaagagactctcttccttcacttattcataattcacatctggtctcctttcaaagagctttaaagcaggttcagtggaaggcctatctaaggtggggtgacggggaggacaacaggtgacgtgcagtggccggtgaaggaatttggggctcatctagttcagcgtctccagtttccccactcgagacctggcaaccatggaccttgttgctgtctccatagtttgccttttcctgaatgtcctggagttggaaccttacaatatgtggccttttcagatgggtcacatgccttgaagattcccccatcttttcatggctcgatggctcatttctctttagtgctgaatagtattgtattattacattataatccataacactccattgtatagatgggccacagtttattcgcctactgaggaacatcttggttgcttccatgtattggcaattattcataaagctgccataagcaccctcatgcaggtttttgtgtggatataagtctttaacttctactggttaagtaccaaggagtgtaatcactggatcacatagtaagagaatgtttggttttggaagcagccaccaaactgtcttccccagtggctgtggcattctgcattctgcgtgccaccagtggtgaatgagctgctgttgctccacatcctcgcctgcattgggtgttgtcaatgttctgggttccggcccttctgagaggtgtgtggtggtgtctcgttgtcattttcattcacatttccctgatgatggaggaagcagagcatcttcacatgcttgttttcatctgtgtatcttctgtggtgaggtgtctgtggtggtctctgggccatgttttaattaggctgtttgttttcttattgttgagtttgtaaagttcttgaatattttagatattggtcctttatcagatatcagatatgtcttttgtaaacattttctccagtctgtggcttgtattttcattctcttgacagcgtcttttgcagagcattagtttttattttaatgaagtccagcttaccaattattttattcatggattttgcctttggtgttggattttaaaaagtcatcaccaaacccaaggtcatccagagtttctcctctcttacctttaaggagttttatggtttttcattttataatgaggtctgtgacccattctgagttagttgtgaaaggtgtaaggtctgcatctggaattgtttctgtacatgtggacatccagttgtccagcaccatttgttaagaggcgatcctttctccatagcatcacctttgctccttttcaaagctcggctgacctcatgtatgtggacccatgtctgggctctctgttctgtttcattgatctgtttgtctgtgtcatcaaccccaccctgcctggattcctgtggagttggagtgagtcgtaacaatgggtgtagtgcatcctaatgatgggtgctgttgtcctccgcctttgttcttcttcagtattgtgttggctgttatgggtcactcgcctctacatataaactttagaataaacttgcttgtatccaaaaaatgacttgctgggattttgactgggatttcattaaatccatagatcaagttggagaactgacatgctgacaatattgagtctttgggagccagtcataatcctgaaagacacaatcctgaatgccatagttctgaatgttaagatcctgaaatatcaaaatccctaaggtccctaaaatcctgaaaatcacagtctcaaaatatcaaaatcccaaaaatgtaattctggaaaaaattatttaaaagacatttatttacatttttaaaagggaatttatttgcaaaatatataaaatcgtgacaaaacacttcataggccattttacacaataaaataagcaataataacattcgtatttttgcagacataagccctcagatatcttgacgacagttgcatgggcatcacacttatgagcagatgaactgtgtttatgaagacataggtcaggaagggagatgtataaaagcatgtccctctgcttggtaattgtgtgcacccagctgtataactgcaggcatctgaaataccctgatgaacaacctaaggcttttgacaagatgagtcaaaaaccctgatgggtcactgctgcataaacagtcgaagagctgagatctcaagaaattgtatctttcgcaaatgcagatgtacaaaaaggacattcttcatttattgaggaagttgcagtgtttttgcattgagaaccagggaagctgatgatgtaactctcagtctgaagacccagggacggctggtgtgagtcctggagtccaaaggccgccaaacctggagctctgatgtccagggcagcagaaggaaagtctgccccagcactcagagggagcctaattcaccctctgtgtttgttctctctgggccccagctgtttggacagtgcccgcccaccaacactgaggcagaccttcccccagccctctcagactccaccccaatctccctggagacacctcccagaaacacccaaaatgaagctttactggatttctaggtattccttaacccagtcaagttgacacttaaaacgaagtctacagtttcaccccttgtcaacttggcactcacacacaactccttaagttatgcttaatttccaaataaagacaataacaagctaatagctccacccagcaggatgcaactctcctgtggttatgatttaggggattttaaacattagcaacactagacttttgggatttagactctatttagagattttgatattcagatatttggggatttcactatttgggattatggcaattgggactgtatcttttgagattatgatccaaacccatgtcctgctagccatgagcatgtaatatttatacgctgcttctccatttctttacttttgctttctttcatcagtgctgtagttttttttcatatagatacggtacttgtgtaatgccatactttcagctcaagactctgatgacagcgaaagcgttttggaaatcactttaggagatgcatcagacaccgttttctaaatgaaccaatgacaaataatgtgtggggtgtccactgttgtaatccttgctcattgatcaaacaccagccacactgaacgggaaacaaaaccggtaaccaacctgttagaaccctttctttcatcatcttggttctgcgccctccagagcctggatgggaattacaagtccctaattcacatcatgacgactgacttttggttctgaatttcacattgcaacctcatcccaacatacctgatatttcttctattcaggtgtcttattatactatcgcttgtatggccaaggtaatcacgggtctccacccagccagcctctgtcctaagatggggcccgtggtgttcatgtgggaagtgcactcggaaactcatgtggaagctggaagaacttgtttctgctgccggccgtgcaactctccagccatgcaacgcttcgcgtggttattcccaagttcactcattcattcagaaagcacttgcaaagtcccggccaatcacacgggctcctgattctcccaagttcactcattcattcagaaagcacttgcaaagtcctggccaatcacacgggctcctgattctcccgcgttcactcattcattcaggaagcccttgcgaagtcccggccaatcacacgggctcctgattctcccgagttcactcattcattcaggaagcccttgcgaagtcccggccaatcacacgggctcctgattctcccgagttcactcattcattcaggaagcccttgcgaagtcccggccaatcacacgggctcctgattctcccgagttcactcattcattcagaaagcccttgcgaagtcccggccaatcacacgggctcctgattctcccgcgttcactcattcattcaggaagcacttgcgaagtcccggccaatcacacgggctcctgattcttccgagttcactcattcattcagaaagcccttgcgaagtcccggccaatcacacgggctcctgattctcccgagttcactcattcattcagaaagcacttgcgaagtcccggccaatcacacgggctcctgattctcccgagttcactcattcattcagaaagcacttgcgaagtcccggccaatcacacgggctcctgattctcctgagttcactcattcactcagaaagcacttgcgaagtcctggccaatcacatgggctccgctcccagttctctcccctcatccaaaataagcgtgttctggtcctcttctccttcgagccttccgtgaccctgaggtcctgcgttggctggtggggtgcccacttccttgtcgtgttggtggtgggaatcccagcctgaaaaccctcacagagaagggcgtgttccccgcagcccagtctcaggagggcactgaaccaaagctttgacttttcacggtgacagcagtagattataacacagaaataactgataccaatgcttctgtcactttggagaaaatatgcccacacttttggggtcattttcacttgaaaggaagcacctgctgccttttcgtttttgaagaaattcattcatatttgaatgcatcccagtgctgctcagtgctctaaacccaagcacgcctcttggcttaaaaaaaaaaaattagaagagaattggccacctaatcactggcacacagaggccgcctctcacaggctgctccaggaggaagccactgataaattgttaatctcggatccatgcccctggctggagttcacgagcaccctctaaagcaggaggagaaggcacctatgttatcaaagtgcctttcatcctagcgaaacagtcccgggctcagtgtgcactgcctgaggcctttcttcctgtgtgtcagcacaccgtggagtcagcagcagcgcactctctcccaggggagcaggcgcaggagagggcacccggggtgctgggggggtcactctgtggcttatatagcgggaacagggttcgtctcactgcaccttgaggacacacccacctgctcagcaaccctgacgtggatgcgcccagtgcggggtggcagcggccgtgtgtggctggcagcctcggacctgcgtgtggctggcagtcccggacctgcactgctcggctccacccagctcatgtcttctcccagggggaggaggctccccgacttctgcactagtgcagagtcactgctttcagatttgggagaagtaagagtcataaactgcccccatgtgagaaatctcttccccggtgtttggctgatgtccttacagactctgcttaaacacctctgaggtcactgctttcctgccaggtccatgctgctgtaagccagctgcatttgctggaaagatttttactttgagaattgggttgaaatttgcctctgtctgactaggaattggcagggcacctaaaggcacctcactgtcactgcccaacccctgaggttttcctcccaccaccttctgccatggctccaagggggaggccttccagagccacatggaacaggggtgctctctgctgtgttagcacaatggggaggccttccagagccacatggaacaggcgtgctgtccgctgtgtaagcacaatggggaggccttccagagctacatggaacgggggtgctgtccgctgtgtaagcacaatgggtaggcctttcagagccacatggaacaggggtgctctccactgtgttagcacaatggggaggccttccagagccacatggtacaggggtgctgtccgctgtgttagcacaatggggaggccttccagagccacatggaacaggggtgctctccgctgtataagcatcctctgcatatgatgtcatccttcctgtcacttttccaaatctccccagttccaacctgaacgctggtggttaatggagaccgctgattacatggtgatgcttccgctctgagggcacagggcaggtgtagggaaggcactgggggagcctttccccttcccacgggtgagtgcgtcacaggctggaactgggggctcgaagccccagggcgttctatgcagcagttggtttgctttgggtctgatcatgccgagcgtctgactgcagctgtgtgttcacctgccctctccaccggcatttctagaacttttcgaggtaactgttcccattacgagggcgtttctgcagatgtcggcttagctcatttagcgaatgtgggcagctccgaagtcccaaccctctgacatctgtaaaacattttctcttctggtcttacctgccacccagtccacggtgagctgcgttacctgtcgtccgtcagttcacgttctgagtgtgcaaactcacactaacatgaacctaaaggaagcagtctttagaaagccatttgactgccaatccccacaccccactgaagtcatgtcattaatgccagagctaattggatatatttttttcttctttgcctcagtattgcattcaatagagaaagtgtcagactgggtgaatgctgagccctgtgagtgcaaaatattgcggcatgacagtgcaggagaagcttcatcccaggctgcagcatgggcacttttcattagtcagggagagatgcacactactcagctgtgattccttaccccctcatattggaagcagaatatattttactacacttgtgttgtttccagtgaaaatagacaacatgctggcatatgattatgtcagtttctccctgtggaagcccaaatgaggagagaatgcgataatgagctcctactgaatttacctgaatcctctgcaaatacccaagttttggaccccagcaattaaatgggctgtatgtcctctaaaccaaaggagcacagtccattccccatgatggtgggtgatggtgatgatggtggtgatgatgatggtgttgatgatggtaatgatagtgttgatggtgatgatgatggtgatggtgatgatggtgatgatggtgatggtgatgatggtgttgacggtgatgatagtgctgatggtgatggtgatgatggcactggtgatggtgatgatggcaatgatgacggtggtgatgatggtgatgatagtgttgatggtgatggtgatgatgatggtgatgatggtgatggtgatgatggcaatgatgatgatggtgttgatggtgatgatagtgctgatggtgatggtgatgatggcattggtgatgatggtgatggtgatgatgatggtgatggtgatgatgatggtgatgatggtgttggtgatggtggtgctactgatggtgatgatgggtgttcagatgtggctaactgtgtaccttcatatatacatggttgtaaaggcacttaggagcaaaagctgttgtgcatgattcccattgtctttgtgaaaacaatgttgtggcgaggttatctgcaggctgttgctgattgtttaaagcttgtaccattttgtttggaaggccctacaatgacatataatttcaataggcctggctgtggcagttgagaatgcagagtcatgtgagctgatctcttactccaggctttacacatttaatatcctgacattttgtgtaattgccttatgagagcccagttggagcactgaaagctacttaaaatgtcattatgaactggccagattgcagaattacgtggtgcagttgatggaacacaacgttttactttgatattcttgttatctgtgctctgtgctgccgcccttcttcaacccaccagggctcactggatgctgcaaaacatacttcctcatttctcttcatcttcaaatggcaggtagtggatgcttctgagataactcagcatgttcataaaatgctgtgtgtgtggtttgtagaggttacatgggaggggatccctagtatgcattaactgttctcccataagctgcccagcaacttagaattttctcttatatacttatgattttttttaaagttatttttcattaatgataacctaaaaagtttctttttcagatgaggggaagtagtttttggaattgtactttattattccattttgaaggtggatgtttcctattatagtgattctaagaggcccactgaaaatgcctcctgttctctgatctttaccataaagaacatgaagttttatttcagggcagttgtatttctgctctcccatccatttaacaagactcgaaccaaagggagtcaaaggaaaagggatgcgtagcagccataagagagagtttttctgagttgttaaatgttacagcggtgttagaagaggggacacaacttcctgtcaacaaatactgagcattagcaggtagtagacaacacacttactatatttcattttctcagcaacccattcgagtgggagttattgattcagtttcacacagagggctcatgaggctggaagaggctggatgggtttccccgagtcccaactgtggtgaatggtggggtggagtttgagcccggtttggctgactccggagaacacctgtctctgcgttacgctgccttttctggaaggcagtgaatcttttagggtttctgccctgacattccctgcctgtgaccagcaggactctcatcccacctgcactggcacaagaccaaacatggcagtgtgggtgcctgccgggctcctgagggcctcccagcccagcccggaccccacaccttgaacgaaccctcccatggttcctacagcatggctgtggggccactatccatttaggtccttttctttctgtccccccatgtccagtctgttggcagaccctgctgtacctgccttccgagcgagcacacccagggtgccccctcctccccaccagccggctgctctctgtccccccgaccaccacccctaaccagatctgaccagacctggcctcctgcctctgaccttgtctcaggcctgcagagtggttcttgtaaatttgtcaatcagatgatatcccactgctcagagcacaccacgggcttctcatcacactcagtaaaaatcaaagctgtttgcctggtctgcaagaccctgcatatctgtggcacccccacccaccactcctctccctccgtgtcctgttgaaacgggaaaagttcccttattcccctcacagggcgtgcgatgggggagtggctcgcttcttcagtgccccgctgctcaaacctctaggggagctgacagacgggtgggctgtgggctcagaccccatggcagtgtctaggggtgaatgtttacagctcctaaagccccagtgggcatgtgttacagggtgctcttttggtttcgctcctttaattttgccgtctataggtggcttgtgttagtcagctcaatcagaccccttccttatcacaaggacagagggctttctgaatgctgggttcttgccttagtgtactggaagaatcagatcatatgtgggcttggagagtaagtgcaaggttgttttgagtagaagtagctctcagcagatgggggagccagaagggagatgattttcccctggagtccgaatgcttgatggcctgggctctcctcagactgccccggccacactcggcatcgttccgctggtcgatggtatgctggtgtctgtcggtctgctcttgtccccccagtcggtggcctgctggcgtgctggtgtctgtcggtctgctcttgtccccccagtcggtggcctgctggcatgctggtgtctgtcggtctgctcttgtcccactggttggtggcctgctggcgtgctggtgtctgtcagtctgctcttatcccatcagtcggtggcctgctggcgtgctggtgtctgttggtctgctcttgtcccactggttggtggcctgctggcgtgctggtgtctgtcggtctgctcttgtcccaccagtcggtggcctgctggcatgctggtgtctgttggtctgctcttttgccaacgtgctcctcttgacatccagccacttgtgtgtgtgcctgccagggtcttgggggtttttataggcacaggatgggagtgtggtaggggccagggtggtcttgggaaatgcagcatttggtggtgaaggcaggagtgcctgtcctcacctaggtctgtggagatggagccccagccagggacctgccttcctcaacccagcacttcccttcacacttctatatcatttaaagggaccagctctccccttcccagcactcccatatcactgtgaactctccacgtggggctgcattctggacactttggcctcctgtctgttcttccaacccaacacgccaggcagcttctgcccacggccttagtgctcactgctactcctgcctgaagacagcttcccaggccccactaggcccatgctcacctccctcaggcctctgctgaaacttcaccttctcaatgaggctttctctggcagtgcggtatgaaagagcagtgctccagcccccgatccttcatactctgggttatttcttcgcagcatcaatcaccaccacatattctgtgcattcatggttttttttttttttttttgagacagagtctcactctttcacccaggctggagtgcagtggcgtgatctcggctcactgcaagctccgcctcccgggttcacaccattctcctgcctcagcctcctgagtagctgggactacaggcgtctgccaccacgcccggctaatttttttgtatttttagtagagacggggtttcaccatgttagccaggatggtcttgatctcctgaccttgtgatccacccgcctcggcctcccaaagtgctgggattacaggcgtgagccaccgcgcccggccgcattcatggtttttatttgtttcctgttccttctaacatagatggaagtcacacaaaagcaaggactttgctcatggatttatctctgcgccttcaaaggtagctggtgcaaaggagatgtgcagtaaatatttgtggcaggaaggaaggaaagaatgcagctagcaagggagggagggaggaagattggggagaaggaagaaagaagggaaaggaaacaagagggaagaaggagggggcgggggagtatttcacctcctgaagctctcatctgtccctgaaggggagggcgtggctcataccacccaccaccaccaccccaccacaggcagagtaagaggctgcctgcagatcgcctggagtaggacgtgcggtgaggagcagaaaggcgggcggtgtgggcagggagaggcaggaatagaaaggcgggtggtgtgggcagggagaggcaggaatagaaaggcgggcggtgtgggcagggagaggcaggaatagaaaggcgggcggtgtgggcagggagaggcaggagcagaaaggcgggcggtgtgggcagggagaggcaggaatagaaggtgggcggtgtgggcagggagaggcaggagcagaaaggcgggcggtgtgggcagggagaggcaggaatagaaaggtgagcagtgtgggcagggagaggcaggaatagaaggtgggtggtgtgggcagggagaggcaggagcagaaaggcgggcggtgtgggcagggagaggcaggaatagaaaggcgggcggtgtgggcaggggtaggagcagaaaggcgggcggtttgggcaggcaggggcaagagtggaaaggcgggcagtgtgggcaggcaggggcaggacagtgacagggcctggcttcccgcataggaggcagcatgaggtgctgagaggaacagacattgctgtaagcagggtgggatgcacagaataatatttcccagcttctcggtgttgtgtggggcccatttgctgcaaaccagtaggataattccaccagcacgttgggttggaagaacagaaaggaggccagagtggctggggtgcaaccatcatgggagagttcacaggacacggagggagaggagtgctgggtcgcggtgctgcagatacgcagcgtctcacagaccaggaaagaagagagctttgcagatcaccatgatcacccacattcttccctctgcatgacagatctcacctcagtgacccccctgggttatgttcacaagggtggaattagaggggcaggagatgacaccgagatcttaaggagaaaaggtctttccatatagatgctccttgaccttctagaaatgcccacttgtttctgggctccaggagctggtgaatactgggactcacctgggttagctttgcagtgaaggtcagtgcaggggacacaggaacatccgcctgctgcgtcagtgccaggtcagggcggcagagctgccacttttcgagctgctgagggtggacatctcagccctgcatgtggagggcggagactggggtacacccttggtgagcccaggtactcagaaatggaacatgcttgtcagctgaatgttctggttacgttagcctttagcagaaacagcctggattcaacttgtttaaaaatctctcatgaatacatccatctatttttctgccttggccagtgttcctgaagcatgaaggtgggtctcacacacactgccccgcttgaggcaacaggagcctgcagggaacagcattgttgccggccaagcttcagagctcagcagaacacccacggcagccttctgccccacggcctcttccctcagatgactctgttttcttatcattcatgcccttgatgccacactacgccacctaaatctgatgtgtctgtaatgaggcttaacaaacagcaaagaattgtgttgcttactttctatttttatttttcatatgttttatttattttatattaaatttaaaatatattcttgccactttttgttcagcataacttagatcccaaaaattccacagtaatttttttgttttttcaagagacatcacttgggtttatcttttttttttttttgagatggactcttgctctgtcactcaggctggagtgcaatggcacaatctcagctcaccgcaacctccgtctcccatgttcaagcaattctcctgccttagcctcctgagtagctgggactacaggcatgcgccaccacgcctgggtcatttttgtatttttagtagagatggggtttccaccatgttggccaggctggtctcgaactcctgacctcaggtgatccacccacctcggaccccaaagtgctgggattacaggcatgagccactgcgcccagccgggcttatctttttaaaaatcagtgagttaattggattgcctttgttagagattaaaaataaggatttttttttttttttacctcttgagaaaaggtaacatcttatacattttatgttttaagagtttatactgaaaagacactggttagatttaagtttatgtcaatgtagttgttaatttccaggggttaaatataggcagtgatttacacattgatgacattgctttataaaagtttggaggtcttttggttggaaattgggttccctgtactataattggtgccagcttggagagcaggtcagcccagacactcgtgcacttgaggaggaaagacgtgtggcgtgagatggggtgtcactgagggggaaagacacgtggcgtgagatggggtgtcattgagggggaaagacgtgtggcgtgagatggggtgtcagtgagggggaatgacacgtggcatgagatggggtgtcagtgagagggaaagacacgtggcgtgagatgggatgtcattgagggggaaagatgtgtggcgtgagatggggtgtcattgaaggggaaagacacgtggcgtgagatggggtgtcattgagggggaaagacacgtggcgtgagatggggtgtcattgagggggaaagacacgtggcgtgagatggggtgtccttgagggggaaagacacgtggcgtgagatggggtgtcattgagggggaaagacacgtggcgtgagatggggtgtcattgagggggaaagacacgtggcgtgagatggggtgtcattgaaggggaaagacacgtggcgtgagatggggtgtcattgagggggaaaggcatgtggcgtgagatggggtgtcattgagggggaaagacacgtggcgtgagatggggtgtcagtgagggggaaagacacgtggcgtgagatggggtgtcagtgagggggaaagacatgtggcgtgagatggggtgtcagtgagggggaaagacctgtggcgtgagatggggtgtcagtgagggggaaagacacgtggcgtgagatggggtgtcattgagggggaaagacgtgtggcatgagatggggtgtcattgaaggggaaagacacgtggcgtgagatggggtgtcattgagggggaaagacacgtggcgtgagatggggtgtcagtgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgacatggggtgtcattgagggggaaagacacgtggcgtgagatggggtgtcattgagggggaaagacacgtggcgtgagatggggtgtcattgagggggaaagacacgtggcgtgagatggtgtgtcattgagggggaaagacacctggcgtgagatggggtgtcattgagggggaaagacacgtggcgtgagatggggtgtcagtgagggggaaagacacgtggcgtgagatggggtgtcattgaaggggaaagacacgtggcgtgagatggggtgtcattgagggggaaagacgtgtggcgtgaaatggggtgtcagtgagggggaataacacgtggcgtgaggtggggtgtcattgagggggaaagacacgtggcgtgagatggggtgtcagtgagggggaaagacgtgtggcgtgagatggggtgtcagtgagggggaaagacacgtggcatgagatggggtgtcattgagggggaaagacacgtggcgtgagatggggtgtcattgagggggaaagacacgtggcgtgagatggggtgtcagtgagggggaatgacacgtggcgtgagatggggtgtcagtgagggggaaagacctgtggcgtgagatggggtgtcagtgagggggaaagacacgtggtgtgagatggggtgtcattgagggggaaagacgtgtggcatgagatggggtgtcattgaaggggaaagacacgtggcgtgagatggggtgtcattgagggggaaagatacgtggcgtgagatggggtgtcggtgagggggaaagacacgtggcatgagatggggtgtcattgaaggggaaagacacgtggcgtgagatggggtgtcattgaaggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattgagggggaaagacacgtggcgtgagatggggtgtcattcagtctcttcacaggatcttaatggtgtattttccctgtaaactgtttgcttgttctatccattggtcaagtctctctggcctccaaaacattttagtgtgtctgtgctggtgtgagaacaatgttgtagccctcaagaaaatgaagcttttaattttctattgtttcttttttctttctttttttttttttttgaggcagagtctcgctctgtcgcccaggctggagtgcagtggcgcgatctcagctcactactagctccgcctcctgggttcacaccattcttctgcctcaggctcctgagtagctgggactacaggcgcccgccaccacgcctggctaattttttgtatttttagtagagatggggtttcaccatgttagtcaggatggtcttgatctcctgacctcgtgatccgcatgcctcagcgtcccaaagtgctgggattacaggtgtgagccaccaagcccagcctattatttcttagaataatgtttgttcccaggctttgatcacaatagatgcccaatacaggttggtgcaatcaatgggtaggttagtgggtggagggatggacggagactgggctttgactttaatgagaggttcatatttttttaaatataggttaacattttggttaatattttggcagaaaatagtttcaaaatgcataatcttgaattagatcttgagcaagttggaaggtgcctgtcagcttgtgtgactgagcatctaaggggctctctgactgtgttcctcacttctcacctgaggatcacaatgagctgtggcgagagcttctcatggagaaccaagtatttgttttcagaatggatgggaaagggggaaaagagtggaaaactaaaatgatttctcatcctctccttgtttcatgataatagttataatttattaagcacttacagtatgctgggcccatgcctcacttgtcaccattttacagatatggaaactgaggcatgaagaaatgagcgagcttgccccaaaccacagaccatgagcgctggggccaagactccgggagcatggtcagcctttcttcatgggagtccagcctggcatcccccagggcagggcagcacaaggatggatgatcggattgatgggaactttaaatgtgtctaaggtcctagctgcaatgatggaaaaagaaatgtgagctaacaccctacagattctagaataatcaggcctgagaaagtgtgcaggcagctgcagccacggcaggggagcccctgttggttcagtactggcagctccacgccaagcctggccgcgtctggccagggtgctctggctttcccgccgtgcctgatggcctttctgctcacgttgccatttcttcctcccttcctggtccaccatggagcctcagtttctcaagggtggatgcctgccagttccccaaactctacattcccagctgctctctgtcgatacaagtaggctgttcatatggttgagtgtggcgctcactgtaccacgctgtaccgggcactgccgccccttctcacgatgatgtgagggaagtcttgccaagccgtggtattctggaaccttctcaccgtgatgtgagggaaaccttgccaagctgtggtattctggaaccttctcgcgatgatgtgagggaagtcttgccaagccgtggtattctggaaccttctcaccgtgatgtgagggaaaccttgccgagctgtggtattctggaaccttctcacgatgatgtgagggaagtcttgccgagccgtggtattctggaaccttctcgcgatgatgtgagggaaaccttgccgagccgtggtattctggaaccttctcgcgatgatgtgagggaaaccttgccgagccgtggtattctggaaccttctcgcgatgatgtgagggaagtcttgccgagccgtggtattctggaaccttcttgcgatgatgtgagggaagtcttgccgagccgtggcattctggagacgtggcttgctgttcagttcctccttcagagcaggcacttggcctctgtgtgggtttgagaggggaataagcatcattttgcaaagttcagggtgggtcgacacacctgtctttgtgttaagcaggactcatcagtgttgacagtgacggtgtttgctgttagaaacacagaccgcagcctcttccctcggggtggtgggagaagcgccagcctgccctggagggagagggtgagcgctccaccccgggatgcctgctgatgtcccccttctccttccccttccccttccccttctctcgctctatcgcccaggctggagtgcagtggcacaatcttagctcactgcaacctccacccccaaggttcaagcaattctcctggtttagtctcctgcatagctgggattacaggcgcctgacaccatgcccagctaatttttggtatttttagtagagatggagtttcactatattgctcaggctggtctccaactcctaggctcaagaaatccgcccaccttggcctcccaaagtgctgggattacgggtgtgagccaccgcgtccggctgatgtctgctttctctttcttttggcattttcctgctggcaacactgtagccactctgaattgaataccctggcctgtgcacatcatttttataaaccttggggggctcagaaaagtttatttgtggatcagtatggcaaaacatgattcattttcactggaaatgccgaattcgagaacatttaaccttctttattgagaagtcacatgatttttattctctcaccatttgtcaaaatatcacaaccagcttttcagcccccttaggaaacacagggccttgcagaagaacggttaatggaactctgtcccaaacttgtccccgcacggaccacgtcaccttctctggagctgcagtggggtcgtctgggcaggtggtggcccggggctgcagtcctggggagctccggctgcgggggggacggtggccactctgctgcctgggagctcaggaaggcggtgtctacagatgcaggtggaggctcccaggccttgtggtgcctgctgtgccaagctagtgtgtggagagtccttttgtccttttgggagggcagaagggatctttggacttggaagtgaattgttctaccacacttggaggccctgccacttcctgcgaatcgtgacatcagaaataatggactttgccccagacgaggcctctggtcaggtcgttactctggggccctcctgccccactcacctgatgaggaggccgctgggcagccgagcctgtgttcattggttcgtgtccacaggaaggacctttccttagcaaccaccactcattcctcacctccctgtttctttccctccgatgaaattccatcacggggactggtgtccaccgtgagctatggccgggccgactctgacacacatcttggctagtgcaggcatgtgtggagacatccctcgcctcctaagcacggaggacgccgactgctggggacagccatgcccaatgccgagggcccttcaggtctccctgcagctgtgccggttcctgccgcaggctccggtgcctcctgccagttctctggggctgttagttttctgggctccgcctggtggagcccgggacccttcagaactcaggctcttgcctgtggccgcctacttttccagacacagctcttcctcccgatccctgcacttccttatttccattttctttgggatgagtgagccctttgttgccagcattggacctgtggacgtggacgagcgagataagactgtcgcgatgataatcgctgggaaagaaaaagatctgtggtgggaggagactgcagtgaatgagaatgaaaaggttgctctgggctcgtggctcggtggctcggttgcgaggctgagatggctcttctgattctgaaagctgcaatgagcagcacattttcaaaacagcaccgagggctgtggtatacacgcacctttaattccggagcacatcttttatcttctctgtgaaacaacgtgagcctgtcagcgtggaaggagctggggcatgggtgccgttgacctgggactgtccagcccttcagccctttgtcacctgcagacaggagtagcggtgaaggcaggctttgctgcggttttaggcatgtttttgtttgtgagaaagtgagatgtattttcctgagtttgttgctggaagctttctttgaaggtagcattccatcagtgaatgcatggtgagggctgatgtgtgggggttggtgggccctgggggtgtggcgaagggaggctggccctcccctccaaggctcaaggctaatgaaaaaacagaagagtacgcggcctccatgccaatccctgcgtttcccttcttctgttttaaacggcaggtttcattatgatttaggacggcaagcccgagagatctgggtacagctgctgttgaaacaacagtttgttacttacagattttgagaggagggggcaggccacgccatgggtcgatacagggatgcgccagcgtcagtccggaggctgggcgagggcaaggcagggtcgtcagggacaggactgcccagcttgaatagttccagccgctccggggccaggggctgcccgtgtctggtccttgccccagggtgactagggcagcggcctggagtctgagcccacagaggcggaggcgggcgtgggctccggatcgcagggtttgcatgtggaaagcctgcgtggagtgggtgactgttcactatctgggaattggctgttcgtgggaggggcagcccccagggtcagcagggccccagatgtcagagcatcagaaatgtggggttaatacggacacttcaacccgaaggtaaagaagccgccactgtctgccgaacaattcagaggcctcaacgtcggccagagcggggcactcggccaccccagcaggggacatcggtggcagtgaacgcccagcacgctccgatcagaacgcccgtgtccgtcacacatttcgtgtacagattgactttaaaggactctgtccgcttcatcccatgctaaactacacataatgctgtctcagaaatgcctgtcatggacgttcaggcctttacatcagagggtcttagtcatcaacagcaagtctggagtggcgctgacaggactcaggttttcaaaggggaaaatcagagggtcatggctgtgaccctttccatgcgagaccctggtgggggatggggtgcagcagagagtgttcagaaatgaagcaaaacacttcaaaaaatgtgtccttacagccgtgtagcaagacgccccctgaagaaccagcttcaattaatgggcaagagagactgcacttaaaaaattttcactcaaagaacccaccacaggccatcggcacttgtgtttggaaagtcatgcgagtctaggcggccccagacactgactcctgtcctgcgtatgcagtgaacggggcacgtggggaccgggtgccggccccgctgcctcggcatggactagacacagcctgcgctgtggagagaggacgggacgtgcggctgagtgaacgggggtgccacaggcagtgccactgtcgagccctgtgcagacactgcaggctgcagcccaggcctggtgatgcatttgacgcagacaaaaaacctaaaatgcctacatttcttaatttgtaaaaagcagaaataattcctccgcttctattgtagaggattgtgccgagatccctctagggcagagggtcgcagtgggatccctctagggcagaaggttgcggcgggacctgtctagggtggagggtcgtggtgagacccctctagcgtggagggtggcagcgggacccccctacagtggagggtcgtggtgagaccccactgaggtcaggacattctgtgtcccctctgcgtcactctgccggtgtcgttcgggaaggtagagacgtggccatgagctattttacataaacctttatgaggacagagatttcaacactgaatacaaaagaaagtcaggttttccttcaaagctcggaaatgggcccatgaaccttctttagggcagagtctttattgctgctgttgagggggagtatacacacggcgagatgcgcagaccgcaggtggacacgatgacgcgttggacgcatgtgggcctggaaccagcggccacgctgcacggcacaccctcacacccgacgcttcctcctgccccagccccacctgcaggtgatgcggctctggttgccctgggcagacctcgcccatccttgaacttcatcttctgttaacaggattctgtggattctctggtgaccggcttctctcactcagcctgactggttctaggtctgtcccccttctcgtctctgtggttccttctggctcagtgctggtgtggatgtggcctccttatccgctctcctgctgccgggcacatggactttagactctgtctgtggaactatgaggagtcaggctgctacccacagtctcatttaactctcatggttacgggtttcacttctctcgggtaaatacttacgagtccaatttctgggtaatacggaagatgtccttttggaaaagactttcctttctctgttgaaacgccctggcgcctttgaaacagtctcctcggagttgtcactgtgccacttcctggacgcggtgaggaggcttcagctccctctagcctcttgtgccatccagttcatgcctgcagctgttttatgaaccctaccttaaagtggtaataatttttccttgctaacaatcagttgttttttagataaagtaagaggagaaaagaagacggtctttcttgtttatgtaaccacatatttaccctttcaggagctttttggctcctcccgcagctctgggcttctgtgtggtggtgtttctcttcagcctgtgtgcaggcccacagggacccactggctcagctttgttcacatacgtgatatgaaaatgtctctcctttaccctctcgtttgaaggatattgtcattggatataaactcctggattgaatgatttttctttcaacccttcaaatgtggcattcattatctgtaacgtcaaatgcctgactctgcacattgtatgaaatacgttgttcttacaggacatgcagggtgtctggcggcctctgcgctcctgggaccctttccattctcatgtgtggagcgtgtcttccccccgccccgcccccgctgctttccaggaatcttctccatctctgacttgcagtagctcagctgaagtcatggcgtggttctccttgcattttattatcgtggaacttagtgactgtcttgagtccctgagtgacaatccttcccagatttgagagacttgtgggctttctttcaggtgtttctggttcctttcccacccccccgtgccctcctgactccgacggcttggatgccccaggggtgactgaggttctgcagaacgtctcccattctgttcttccaacgatgatcgcttctatgatctgtcttcagattcacaaaccgtttcttccgttatgtccacccgtaatggacataaattttaaatttcagacgccgtgctcttcacttacagaatgtgtgttggattctgttttaatttccccactctgctgagcagcgggtgcacacatctctccgcggttatggcagctccacaaatggccttgtctcctcgctctaatcatcgactgccctattctcaatttcgggttctgtttttctgcctcctcctgcatctgttgctgcttgtgtgaagtgggggcctagaccctgccaccttcctttaaggggcttttccggcagcagttactttcttggacgaggctttgaccctgtgtggctgtgtttagatgtaattagagttggtccatgctgggcagggtgtgctgggcagggtgtgctgggcagggtgtgctgggcagggtgtcctgggcagggcgctgtccttgccaggcattgtttctccttctgccaagtgagggggacacagctcatcccattcttttatcctctggaggacatggtgaagttgcctagcccatctctcttcctggcttggtcattccagtgttttctggaagctgtgctttccatcctcctgagcgcgtggatgagtctgtccttccattctgtgggttttccacctctggggaactgaactagtgatggttacagggtcaggtggatttgagattcaagtccaatatcccaatcttctctgagcactggcctgcgcctggccctaggtggccactgccttgggacgccgcagacgcccaccacacccctatggtctggaggccctcacctttgcattcgtccacccacaacgtccttgtgtttgtgtgtgtgcccctaggagcacggattcataccctcctgaaggacctgcagaggcagccggctgaggtgaggggcctgagtggcctggagctggacggcatggctgagctgatggctggcctgatgcaaggcgtggaccatggagtagctcgaggcagccctgggagagcggccctgggagagtctggagaacaggcggatggccccaaggccaccctccgtggagacagctttccaggtgactgcagcgccatgggtgcccacacccaggggtgctgcggggaggggaggcctcagggctgtgcagagactgctggctcaccaagtgcaatgtgggctttctgctggggagatggggatctgtattaatgatttttatctgtttgaacttttgcctctaaaagctttcttaacagactaagcctaccagagcaattatgttgaatggcaaattgctctctgcgaggaggtttcactcctccatgctgaggctgagtcaggaaaacaggcgtgatgggaagtgttgtgtttggactgtgtaccggtgaatattgtcaaatatttgaatagcagagtgagaggggatcattcaaatgtctgcttggggcgtgcattggtcctctgaggctgctggggaagcagaaggcagcccctcagcaccactaccccggcaggcatccggagccctgtggaggccccatgggtcagccaggacttctgcagcctgatggcttctcacagcgtggagctgcaagaaagcacctagctcagctccccacacatggcagccccacaagtacgtgctgaaaaccaaatgacagacgtgcccctctctctgcacgggtgcagagggggccttgctggaagctggaagcctgacttggctgacaggcagggtgcaggggagtagtggaactgcaccccgggagggcctgtgttaggtggtcgcccagtggttgaaggaatcgggacccgcaccatggctaggagggatgcaggaggccctggtgtgcgtgctgtctccaggggcactgttcaggtgccatgagtcacgcacctttgggcactgaaagtaggatattaattaatttatttattattttattttattttttgagatggagtctctctctgtcacccaggctggagtgcggtgacgtgatctcggctcactgcaaactttgcctgccgggttcaagtgattctcatgcctcagcctcccaagtagctgggattacaggtgtgcactaccacgcccagctaattttttgtatttttagtagagacggggtttcgcctgttggccaggctgatctccaactcctgacctcatgatccgcccaccttggcctcccaaagtgctgggattacaggcgtgagccaccgcgcccagccggggtacctatttagagagaaacgctgaccacagtgaaataacctaagtcagtggattctgaagccatcttaattgtgaggtggttttggcgaaggcttcactttgctttttcatgacgtgaactgctcggtacgatggggtttttttttgccgtgagttaactttgtcgatcacgtgagacccccagagctgggtgaggtcattgtggctgccttcacgtctaccatttagctcctcagtcccctccgctctcgcgaagtttacagaatgccattttgtgctataaacagaaaaggtttactctatggcaggacttaggccagcgtcatcacacctcacctttcgtatggaggggtctgcagggtcaccctttttatgtctgtggcaccctgtgatgacattcttgatgagggtcttggtaacactggtgtcttttacagatgacggagtgcaggacgacgatgatagactttaccaagaggtaagatgacgtctctggtgtttgtttcatgttaaatgtggaagttggtgatctttttgttcatggtgtgggaacatttatgaaatacaaaagtttttttcccagaaaattatggagaaacccctcataatctccaaattgaaaaacagtataaagagaacatacaaaagtgtgtatatttggatacgaaatatctcttttcaaattataacctaatttatccatggtagaaatatgaaagtcgtggtaaatgcaaagaagaaaattaatttttcctggaatttcccagccaggattatcacacggcagcctgtgcccactttgcacatttgatgcctcctgcatgtgcggattcctgaggggttcagctcactcacacctggctgtcccgtgtggcacctctggccacatgtggccatctaaacctatatttaaattgaataaaattaaataaatgaaagatgcagtgccttggccgcactgggttcaggtcggcggcacgttagtcgcatgtggctcagggccaaggcgctggatgccacaggaagaggacggtccaccatcccagagcccccgtgggcactgctgctccggaggcagtcagaagaagggcccagtcgcaggcgatgtccacgagctagacactggccttccctgttaagtcttttagcctcttagtttctctccctttaagaacctttggtcgtgaatacaaggccgaaggatgaagaaccgttctaagcaacagcagtgacattgcatggttctgggaaacccagttttgggggtggagaaagaagagtctttggttagtcattctctcctcagattctcttactggttagtggttccatgcctgttggcaagtgcaggaagaaaacatcagcagttctggttttgaatatccatcagaaatgatgggacctgctgtctgagctgtggagggagaagtggggctgagaaacacatttcctaatttagggagtcggggagacccagccctcccacctgaggggcagggagcgctctggggggctgccgttagcctaagactccctgacttttagaccacaggcttttcatcctccatgcgtggaattctgactcagttctctgttgtttggggtgtattttcaagcaattctgtttctcaaaaagggtatgtgagtgttgtattttctgacttcttatttatttaaaaacatctttctttttcttctcacatgaaacacaatttaagtgacaatattatgctttttcctagctctgtttagtaacgtcaacggctacatcctattgtcattgaggatccaaatttgagcagtgtttttatcacactactattttgtttaaattttaaaaaatacaaaaggaaaagttgtaatttgtagccaaaatgggaataattgcctctatagtccttccttaattttcttaaaagtgtgttttggcaaagtgagttgtaaagtgaatcagattttcctgtttacatctaatataatattgaagatataatttcatggttggaaaaaaaccctgccaagtagacataagacttttggcatcacatgcaccaggaggtgtccgtgggttgcctggtatgtgccagtggcaggagcagacccggtctttcctaggaagcagtgtagggtgcctgggagggcagtgcggcccaggggtggagatcatgtctttgatggcccttagacctgagttccaattctggatctgataatcacgacttttgtgatctggtaccaataatttgatatttaacctctgtaaactccagagtctacaaattaaaggtgaaactcaccctttatttatggggttggagtagtaattacatgagaacccacacaaagcaaatctgtacccggtgcatagtcagcagaggtgccagggggttccgagggatggcttgtccaggaaaaggggatccggctgggagactgtagcccgtgtgaggaccacagatccctcaggtatcgttagaatcaattacacatccctgtgatgtgcccacttgtgggttaatcgctttgtgcctccgtctccccttctgtgaactggggttactgagggtgccccacccacaggcttacgtgaggactcagtgtgttcatgcagataacgcatttagtacagtgcctttgtgtgctggaagagctcagtcgttgcaaatttgttattattattattattatttagtgttcattgcttctagagggctggggtgggatcttgatatcacacagtttatttttaaaaatatcaatgccaaagacctacacaaactctacaaaatctgattcttcagagaggtgtgtgtgtgagcatgtgtgtgagagggagcgggagggaggagaaaacagcacgtaagtgattcggatactcagcgccctcacacctcatgctcggctagacatcattctaaatatagactgcacacacttcgccttcctcccacactctccttccaggctgcccatgtcatccccacagtgactctgtcccgggcagcccttgattgcatgtgtcacatcagcattcctttcgcagacgtccctcacggaatgtcctctctgtcaggtccatcgtctgagtgccacactcgggggcctcctgcaggaccacgggtctcgactcttacctggagccctcccctttgcaaggcccctcgacatggagaggaagaagtccgagcaccctgagtcttccctgtcttcagaagaggagactgccggagtggagaacgtcaagagccagacgtattccaaagatctgctggggcagcagccgcattcggagcccggggccgctgcgtttggggagctccaaaaccagatgcctgggccctcgaaggaggagcagagccttccagcgggtgctcaggaggccctcagcgacggcctgcaattggaggtccagccttccgaggaagaggcgcggggctacatcgtgacagacagagagtgagtagcagccctggctaagctcctgtgtgccgagggagggcttgtcccagcaggctggaggtggggcgcctccttgctgtggcggatgcatacgcttttaagtgtcttcaactgaataatggggtgcaggcatccctggagtctcaggcgcggagggcagccaggtgcctggacagtggctcctcctgatgcttctgagctgggctccagagctggagagccgttctctgaagggcatcaaacaaaaccaaaccaagcaaatcccttcctgggtttttggtcctgactggtcacctgcaggccgcgcctctctgcgggtcagaatcaccttcagcggcggccaggcagggtggggtctcggggcaggtaagtgtacagcaaagcctgagcacggcccgcgcgggaatgcgggatgggacgcggccctggaaactgctgcaccccggactcctcctgcctgttaggaaggactccaggtgctttatctgttttgcaccaaagtggcccaaatatcctggcgtgggcgcccttcagaaggaagaaggggcttcacagcagcgagcctctttccccgccctcatgtcgatctgaacttaacgagtctcagaattcagacatcacgggcccagcaaggcacaagtggctggcccgttctcaggtcaccccgttaatgaatctgacatttgatgctttgctttgtacaagtgttgtgttttcttcaagtgatagaattggtgtttcaaagagaaggacgtgtctgcctggatgtacacacacccacacgtttgtatgtgtgtgtatatgagtgtatgttgggtaggtgtgtgtgtgtatgagtgtgtatgttgggtagatgtgtgtgtatctgcatacgcatgtgtgtgtatatgagtgtgtgttgggtagatgtgtatgtgcgtgtgtgtatagtgtatgttgggtaaatgtgtatctgtgcgtatgtatatgaatgtgtgttgggtagatgtgtgtgtatctgtgtgtatatgagtgtgtagggtagatgtgtatctgcatctgtgtatatgagtgtgtatgttgggtagacatgtatctgtgcatatgcatgtgtctatatgagtgttggatagatgtctgtgtatgcatgtgtgtgtatatgagtgtacgttgggtaaatgtgtgtgcatctgtatgtgcatgtgcgtgcgtgtgtgtatacgagtgtgtgttgtgtcgatatgtttgtgcatatgtatgtgtgtatgagtgtgtgtcgggtagatgtgtattggtttgtgcttatttgcatgtgtgtgtatgagtgtatgtcgggtagatgtgtattggtttgtgcttatttgcatgtgtgtgtatgagtgtgtatgtcgggtagatgtgtatcagtttgtgcgtgtgtgtgtgtatgagtgtgtatgtcgggtagatgtgttatccgtatgatgtgcatctgttcgggtatttcgttgtgtgtatctgtgcgtgtgtgtgtatatgtgtgtgtgtttggtagatgtgtatctgtgtatgtacgtgtgtgtgtatgtgtgttggataggtgtgtgtatctgtgcatatgtgcgtgtgtgtgtgtgtcaggtagatgtgtatcggtttgtgcatatttgtgtgtgtatgagtgtatatgtcatagatgtgtatctatgcatatttacatgtgtgtgagtgtgtgtgttgggtagatgtgtatctgtgcgtatttgcatgtgtgtgtatgtgtgtcgggtagatgtgtattggtttgtgtatatgcccatgtgtgtgtatgtcaggtagatgtgtatcagtttgtaggtatttgtgtgtgtgtgtgttgggtagatgtgtgtatttgcgtatttgtgtgtgtgtgtatgagtgtgtatgtcgggtagatgtgtatcggtttgtgcgtatgtgcatgtgtgtgtatgagtgtgttgggtagatgtgtgtgtatctgtgcatatttgcatgtgtgtatgagtgtgtgtcgggtagatgtgtatcggtttgtgtgtatgtgcatgtgtgtatgagtgtgtatgtcgggtagatgtgtattggtttgtatgttcgtgtgtgtgtatgagtgtgtatgtcgggtagctgtgtatcagtttgtatgtacccgtgtgtgtgtatgagtgtgtgtgtcgggtagatgtgtattggtttgtgtgtataagtgtgtgtgtatgagtgcgtgtgtcaggtagatgtgtttcagtttgtatgttcgtgtgtgtgttgggtagatgtgtattggtttgtatatacgtgtgtgtatgagtgtgtgtgtcgggtagatgtgtattggtttgtgcaaatgtgcatgtgtatgagtgtgtatgtggggtagatgtgtatttttatgatgtgcatctgttcaggtatttgtgtctatgcatatttgcgtgtgtatgtatgtgtgtttgttgggtgtgtgtgtatgtacgtgtgtgtatatgagtgtgtatgtcaggtagatgtgtattggtatgatgtgcatcttcgggtatttgtgtgtgtatgtgtgtatgtgcgtatgagtgtgtgtttggtagatgtgtatctgtgtatgtgcgtgtgtgtataagtgtgtgtgttgggcaggtgtctgtatgtacgtgtgtgtataagtgtgtgtatatgagtatgtcaggtagtgtgtcgatttctgcatatgtgtgtttgtgtatatgtgtgtgttgggtagatgtgtcagtttgtgcatatgcatgtgtgtgtatgagtgtgtgtgtcggtagatgtgtatcggtttgtgcgtatatgcatgcgtgtatatgagtgtgtgtgttgggtagatgtgtgtgtatgtacgtgtgtgtatgtgtgtgtgttgggtagatgagtattggtttgtgcatatgtgcatgtatgtatatgagtatgtcaggtagatgtgtattggtttgtgcgtatgtgcatgtgtgtatatgagtgtgtgttgggtagatgtgtgtgtctgtatgtacgtgtgtgtgtatgagtcaggtagatgtgtattggtttgtgcatatgtgcatatgagtgtgtatgtagggtagatgtgtattggtttgtgcatatgtgcatgtgtgtatatgagtgtatgtggggtagatgtgtgtatctgtatgtacgtgtgtgtgtatgagtgtgtgtgttgggtagaagtttgtgcatatgtgcatgtgtgtatatgagtgtgttgggtagatgtgtatctgtatgtacgtgtgtgtgtgagtgtgtatgagtgtgtgtgttgggtagaagtgtgtgcatatgtgcatgtgtgtatatgagtgtgtgtgtcgggtagatgtgtatcagtatgatgtgcgtctgttcgggtatttcttccttggtgaagaagtacctcttattttgaggatcattcgcactggaggtgggagctgcatgacagctagaacccatctgtcctgcgggctctgcgagcctcgcagtgctcgggctggtgctgtcgctgtgctgcagatgctacatttcatcagggagaattagctgcatatcataattgggcagaaatattttatcttgagctcaaaccgcagagtgtgtatcaaagccaaattaaaatttaagatgattttcagctgtaggtgattatcttagttgtatctttaggtaagttgtaagcagcagaaacttgaagcttacactaaaatatggactccattttctcaagactgctttacataagtcaggatgagctttcccgtttccaggctctttgcttggaggaggcgtcccacgtgtctgtctgtgcccttgctctcctgtttgtagagtcaggaacttctcatggctgttcatttctttgctctcaagcccagtggagaatcacaggcaggccctaagtgatgtgttctgaggctgcgtgtctgcaccagcagagccaaggggaggcgcctgcctcagcactgggtgacgcagaccattatcatgaccgattcctatgggtggtcaaacgccctgtgctgtggacgtctccctccctaggaaacactgctttgtgtgtggtgtgggtgttatgtgatgtgtgtgtggtaatgtagtgatgtgtggtgtgtgttgcatgtggtatgtgttgcatgtgtgttgtgtgtagtgtgtgttgtatgtgtggtgtgtagtatgttgcatggtgtgtgtgtgtgctgtgtgttgtggtgcacagtgtgttgtatatgtggtgtgtggtatgtagtatgctgcatggtgtggtatgtgttgcatgtctgttgtgtgtagtgtgtggtgtgtgttgtttgtgtgtggtgtgctgtgtggtgtgtgttatgtgtagtgcgtggtgtacagtatgtgtgtagtgtgtggtgtcctgtgtggtttatgtgttgtgtgtggtgtgtagtgtgtggtgtgtagtgtggggtgtctgttgtgtgtcgtgtgtggtgtgctgtgtggcttatctgtttgtggtgtgtagtgtgtggcgtggtatgtgttgtatgtgtgtggtgtgtagtgtatgtgtgtagtgtgtggtgtgctgtgtggtttatgtgttgtgtgtggtgtgtagtgtgtggcatggtgtgtattgtatttgtggtgtgtgtgcatggtgcacagtgtgttgtatatgtggtgtgtgtggcacatagtgtgttgcatggtgtggtgtgtgttgtaggtgtggtgtggggtatgttgtgtgtgtgtgtgtgtgtttggttgcctgtgtctcctcactctgtgctggagccctcttttctcctgaaggcccccatgttgtgttcgtggacactgtgtgtttccctgcaggtgtcctggggacttgagccacccttgcagggggacggccgcccatccctgccccggggtaggagagtgccccagagaaccagtgatctggtcattttaagggctttccaaatggatgccgaggtgttcacccggagagcaggaggccggtgtggtttgctagggaaccttcagagccgacaatcctgtgccattgctgctaatgggctcaccctggagggaaggacaggagggcccctgtctgcagcagcctcgcactttctggggaaggagacctatcacattgggtcatttcctgtctgtgcttgtgactttccagtagaaaaaagctagggcttttctttgcattcgagtttattttcttgtagtgggtttgccggccatgccttttggactggaatatttacctcctatgagcagtgggttaaagaaaaaaaaaatcatcatgttatcttggctgacttcttttcttttcctttgcgacttcaactggttggaagctatctggtgaagacagcacagctttttgtcagcaatttgtactgcttgagcaaggtgtgatgcactaggtgaggtctcctctcttcttgcaaggagattgaggtttttgccctattatcagactaataatttgtgattctcttgggcaagttttcaccagatttcagcttaaaccttaacagatcagctattaatttccaagacacagatggcattctttaaaaaagggggacttttgtacatttggttgtcccacagaaaggagaggaatgtggtttagaactcggtgtcacctcagcatccacatgctcttggtgctgaggttcagatgggaggatggtagggctcggcttttccaggcatgattttctctctcacattttctgatggacacagtaatcctttgccatttacatttttatcctttttacaaactagagggattcttgaagactggacgaagggcaggacagccgccccagtcctccaaggacaactttaaaatgatttcatgttaggtttccagaaggaatcacaggacggacaccaggtatagggaggagggagccccttacctctcagcaaagaggaacctgccttctaaatccagaggcaagagcttcagagaccacggctcacacacacatgcctctctctgcctaccccagaccccactggattgggatgtattctgcggaacgaccacgctgagccagtgaggtggattttggggaagtgaaacctgtagtcaggaaaacatgggagctgaggcagaggcttgagtctggggtggcggccacagtgctgttggagaaggtggcctgggcccttgacccacggaagtccggcatccagggtcagggtcccacggcagccccgagacctagaatgtggcaaacgcccctgtgcttgggtttcctggtctctggagtggcagccgcagtgtgtggctcctggactgtggagagatgaacggggctcaggtggagcagagcccgggccacgtgcagaggatgcagggcgcaagcagaggaggacgcagggtgcacgcagaggaggacgcagggcacaggtgcacggatgagcagcctctgtcagcagtgggaagaacacagtgttgcttgaaagaggaggagccaatggatttccacgaggggaagctggagaggttggagccctgagtcttgcggggaggccggctgagggaagaatgtgcaaaaagtggcatggggcggcgttgacctctccgatgcctctcaatgctaacaagggagacagctgcagctgaaatgtttcttccttcaagtgtttcttatgacaaaactttcttgcacctcggagaaggcaagcagcaaaatggcagatggtaccgggccaccgttaggggctgctgcgtgctcacctctgtgggggttcagttggaatgtggaattcagagaggccagtgaaggcagggatccgccggccagggagaggaactttggaaccagaagtctggaaggaggtgggggcttcggtctctccatctgccaccctcagtgagtgccctggccctgcaggttcccccagccccttcctcggctcactgtgagatgtgaaatgtgaaacccaccgagtgctcaggaaccactgcccgctctccgggggctggtgtggcggagaggaagttccgccgcccgctgtcctgggggctggtgtggtggagaggaagttccgccgcccgctctccgggggctggtgtggcggagaggaagttccgccgcccgctgtcctgggggctggtgtggcggagaggaagttccgccgcccgctctccgggggctggtgtggcggagaggaagttccgccgcccgctgtcctgggggctggtgtggcggagaggaagttccgccgcccgctgtcctgggggctggtgtggcggagaggaagttccgccgcccgctgtcctgggggctggtgtggcggagaggaagttccgccgcccgctctccggggatggtgtggcggagaggaagttccgccgcccgctgtcctgggggctggtgtggcggagaggaagttccgccgcccgctgtcctgggggctggtgtggcggagaggaagttccgccgcccgctctccggggatggtgtggcggagaggaagttccgccgccgctgtcctgggggctggtgtggcggagaggaagttccgccgcccgctgtcctgggggctggtgtggcggagaggaagttccgccgcccgctgtcctgggggctggtgtggcggagaggaagttccgccgcccgctgtcctgggggctggtgtggcggagaggaagttccgccgcccgctctccggggctggtgtggtggagaggaagttccaatcctagtggctgcccaggaggcctcaccgctcaggagcccctcaggggttcagcgagaagagcgcatcacgagaaccagcagggtgccaggacggggtgcagccgaggtccggactgatgcttcctgctcgtccttccttgttagagtaaaggaaaccctgaggatgctgaagatggattctgtgtttctggcgccagggcagatttcaggggttctgttttgttcttcagcctccacgctgtgttgtgacttcctgttcagaaagcgcagtcctcacctctgtagaggcccctcctgagggcggacatgccctgccttgtcacttgctcctctttgctttgtggtcttaaaagaatatctgtagcatgatggatttattatcatttaagaagatttcaggtggtgtggggttatagccccgatgggtaaacatgttcacggttgcttgtacattagaagagaagaaggcgagaaggagtggcatgggggtggggcaggaaaaagaggaagaagaagtaaacaaaaactctcccaaacctcagcatccccgacagtccagcccatcctgctgggagcggccgtgggaagtacgcgaggcaggggggtggccgtgggagggacgcgaggcagggggcggctgtgggagggacttgaggcagggaggtggccctgggagggacttgaggcagggggtcggccgtgggagggacttgaggcagggaggtggccctgggagggactcgagacaggggggcagccctgggagggacttcaggcagggaggtggccctgggagggactcgagacagggaggcggccgtgggaggcacttgaggcaggggggtggccatggttgggcctgagccatgtctcgccagcccggcagctcagtgggctctgtgccccacccggctccctccatggccagctgtctcccctcctatggctccatccatgctgtctccccttctcccctcttcccttctcccaccctggtccaggccatctgagcctcttgcctccgcactgcggggccttctctcttgcgcaccagcatcacggctctttctttctcacccgccgtgcacgttgaacccaaagaggactcgacaaaaccaaatctggccccgtcaccctctcctgttggaatctggctgtgactccactggtcctgagatacagaccccagccccagcgtggcccaggctgaccagcagctctgcaggtgcatcttggggacactccaccaggccctccctccgccccggcagctgggctcctgcagaaggtcccagctctgcacctgtcccgtctgggaggcagcttcctgttcacgtcttctccccattcagagaggtctgtccacacccctctttcccaagtctctttgtcaccaattttccattatgtttcttcaagactctgagcatctggccaaaccattggccatggcctattaatttgtaataatcacacatttggctatttctctttccaagcaaagtaaaccagatgtacagcctatagttctgcccattggagaatttcccttcaccgctgtccttttaaggatgttccagaaaggggcagtagtgctgcagttgtccactaacgtgggggcctgcatatcatgcagaaccatctgtaaaccaggcccaggtcttcctccgtcagctgattttagggaactctccaggagactgtaggtgcaggctgggagagagaaggcagcatagcgggagtggggaccgttggcattggcggcacttctttatgtaacttgtgcctttagggcctacttaggcccagacacataccacttccatttgatgatggaatgctgctgtgtacacccaactttctggcttggtgggtcggaaaacattcagttcatgatgggcaactcaggtcccatggtaacttggtggtccatgtcggcacgggatctgaggtcgaatcagattagagaaccagctccgcctgggtcggcacgggatctgaggctgaatcagattagagaaccagctccgcctgggtcggcacgggatctgaggtcaaatcaggttagagagcctgttccgcctgggtcggcacgggatctgagatccaatcagattagagaaccagctctgcctgggtcagcacgggttcacggctcctgctggaggcacttcccgatcctatttggcacactttttaaaggtgacgctatatagaccttccgtacctagatctttagttagctgctggcatttaaaaagtgtttatagtgagcagtacagtctcatccttatgccaaaaaataagttgtcagaatacagtggttttcctctattgattttctgcctggaagagtcgatggtgtggacagccccactagcagtggtccagggtcgttggcctgggtgcggcacacgagctccggggctgcatggcggtccgcaggaggaaggttcagtttgggtgcacaaagcatcaaaacctccttctcccagaccctgacattagactcctgcaggaagagagtgggcgtgcaggggatccagggtggagacagacatggtgtcggtcactgcggcgtcggtcaccatggcgtcggtcaccgtggtgtctgtaggatactgtggcgcctgtcagtcaccacgcgttggtcagggcacctccccagcccactgtttgccaccctcgaagcgttgcttctctgcatgggggaggttcccgtgggctggaaacattttaactactttataagatgatttaaatagaataaatttcatggtttgttttaatgatgaacagggataactagaataattggttgatcccaagaaacctcgtttatctattggttttgagtattgtcttatcaaaagagtttatatcaaagttgactcattttcccttcacatttggctccctagctcctggtgggttttgcagtaaatagtaaaatgtcccagatcgggctggtgaagctgcagaagcacagagcatggtcagcaggagggtcggtcatggcgggtcctgttcttggcttgatttcatctggcccacaaggaagaggcagtaacaaggctgccaaaatgagacgtggagaagttttatgcaggcttccttcggttttgttaagaacaagtgtaggtcgcaacaggtccccgggctcaccccacctttctgggcacctacgttggaacatagcctgaatgataaagtgttccgtttgagcttttctcctgggagtttcctagtagtgtaattttgggcaatgactttagtttctctagcctcggtttctcttttaaatgaggccaataatagtgtgttcctcaggggtctgctgaatgccagatcccaccgctgtgtggggcctcagtgtggcgtccagcacaggagcttcccagagtttttactactctttatatttccgacccctacgtacttttcactagtctgatttttaggggtgacactcccgtagtcattttctgctcatgcgtccacccgtgcactcatttcggggtgatgtggatgccacacggaagacccagcactgtgccggggctgagaggacaccgtggaagagggacactgtcacttcttactctgagcctccctccagtgagtgcttgccgaggccttagggcctcccatgtggctgattcagtagatccataggaacaggcttgtccaacgtggttgagcttagagacgtcacaaacttgccactgtccttcagaactgaaagactctagagagaggagacgccatcttcagctttgaaagtcctttccactgccctcacaggcactcctagctctgaccctgaccccataaaagttctcatgcctgtttctcttctacggcaatattagtgtccaggtattgagggtggaagccgccacatgcagacacagcacgtcgcacctgctggatcctcccactcattttcaggatgacgtccaactgctttctaaggaagttcaggcctcggaatgacagatgatggctgtggctttagagatgaaataggaatggctgcgtgatcattgtgagcacagtcagccctgtcttgtttgtctgctttacagaatggagccagcactcttctgctttacagaggagccgtgatgcccctgcccacctggccggcactgtcacccttgccaggctgaggaaggaagggagtggactgcacgtcccgtacactttgtataactggggacaccttggcttgtggaggcagcgggttcacaaacacattctgggcttgtggacttccttgttgtgttcagggtgttgtaggagtcttgtggatgcttctgttggtttccatattggagcatggagggcagagggctgggcccaggattcgtggtggagcccctcccatgtcctcataccatccccttggtttgaaacatgctagaaaaggagactcatggaatttggtagcaaacattgattgggaagttggcttatgctccgcagggggcagtaggcttggaagaaacaaactcagatgacacgtggctcctgccctcaatgagtttgcagtttgtagggggaggcaggattaaaatatgaaagtactggagaccttttaaaataagtcatgagctgagtggtgctgatcaaagcacacagggagttttagggaaagcctgaagagcagcagtttctgtctttgctgattggagtggtgtggtcggtcctagccttctccacctgcccttctgcacctgccctcttcctaatggctccaaggatggggaggcccagggaggctggggtgcagggggctgaggcaaggcaggtcagcgatgggagcaggtaggctggccctttggagcagtcaccaccaggcccaggcagagagaaaagcccaggctgctggggagcacaggagccgggaggaaggaacctgcagccacacgaaaaaaaggaagggctcatctggaagcatcgcacttgcctgccaggagggtttggcttggagcagggaggctggttggatgcaagtctggagttcccagcagcctgggctggtctcagccggggtggagctgagccggctgtggtgggtcattgctctgtccagctgcagcctgagtttgtctttgtagccccgcctggctcccttccctgttgcctcccttctggcccaacatctggccattctgacactttttctggcaccagtgcccttcacaagctgttcagatggccctggaggatgttttgggacaggagctgacctgggttagagcagacatccaaaatgtacaggaaaagagaggacatctgggacccctccccttccagcagccactctttaaaggaaaatggcttgtttctcaattgtaaaattacacagaatgcagccttgaaaaatccactttaaagaacacgccacaggctttccttggagacagggagcagaaaggagctttgccagggatccagcaggaacttggctcagctttctccgtgagccacaaggagtgttctgctgaaatagagattggacgaaggctggtacactgccttggatgtggggagcagccacacgtcatggtgcttttatactaatcaccttgtttcatcttcccaatttcttgtattttattaacatatagataacataaagtttactgtcttacccatgtttaagcatagaattcagtagcgttaacatttgtgctattgtgcaaccatcaccgctgtccatccccagagctcttttcatcctgtaaaactgaagtttcatccccattaaacactaccctaccccagcccctggcagccttcactctactctgtgtctctctgaatttgaggattctaggaacctcacatgggtagacacacagaatttgtccttttatgcccaggttatttcagttaccatcatgtttcagggttcatccctgttgtcgcatgtgtctgaatttcttcctgttcagggctaaataatattctacttttggtgcaggccacgctttgctcctccatttgtccatcactaggcccttcagttgcccccatgctttagtgattgagaataatgcggctgtgaatgtgaggcactaacatctctttgagaccctgttttcaattcttttgggcaaagtagtctcccccttatctaagggggagacattccaggaaccccagtggatgcttgaaacttcagatagtgcagaaccctatataaactatggcttttcctatacatacatacctatgataaagtttaatttataaattagagtatgagattaacaacagtagtgataaaatagaacaattataacaatttactgtaatagaagttgtgtaaatatggtgtctctctctctctctctctccctctttcaaatatcttcttgtactgtacctcaggtacctaaaacacagaaaacaaactgcagctaatgggggactactgtagataccaaggagtggagttactcgatcaaagtgcaattctatttttcatttttttgaggagtctccatactcttccacacttgatataccgtgttacattctcaccaacaaggcacaggagttccaatttagccacatctttgccaacgtttactattttctgggtttttttcttcttacagtggccatcctgataggtatgaggtggtatcacattgtagttttgatttgtgttttcctaatgattagtgatgttgagcatcttttcatgtgcttttggccatttgtatattttctttggaggaaaatgtctattcaagtcctttgcccatttttaaatggtattgtttgtatttttgttgttgagttttaagagtactctatacacgctaggtacattatgaggtttcttaaatagtgatgtaaatattttactttcctttaatagtcaaaatgagaaattttacgttaaactaaaaatgtagcaataatacactcacagtgctatctcttatattaaaagaagatattggccaggtgtggtggctgatgcctataatttcagtactttgggagaccaaagtggtggatttcttgagcccaggagcttgagaccagcctgggcaacatggcaaaaccccatctctacaaaaaatagaaaagttagcaaggcatgctggcatgaacttgtaatgtcagcaaatgggaaggctgaggtgggaggatcacctgagcctggaaaggttgaggctgcagtgagcaacgatcatgccactgcactccagcctgggcgacaaaaaaagaagacattattgacatgcttgaaaacaaagactgtcatgtttatgcttatagttaatgcaaatagatatcccttgttgtgtactatagaaatagtccttaaaagatctgtggaatatcatattttgctaatctctgtcttttgattggagagtttaatctatttacatttaaagtaattaatgatgaggagggacttctgtcattttaatatttgttttctatgtgcattatggattttttgccactcattttctgcattactatcttcttttgtgtttagtagatttttaaaaattaaatgcctaaattcctttcttctttttgtacgtattatgtagctattttctttgtatttatcatagaggattagatttaacatctgaaaattacaacactaacttaaatttatactagcttgacttcaataacatacaaaaattatgctcctttatgctatttacccaccctttttggctattgatatcacaaaattgcatccttatacattgtatgtcccaggatataaactaataattgtttaaaatttattcgtttcttaaattatgtagaaaacaaaatgtggagttacaaaccaaagttataatactagttttaactagtaattgtttttaagatatgtactagtctcttaaatcatatagagaactaaaaggagttacaaaccactgttacaataatactatattttataattcaccatatatttgcctttattgagattttaattttttatatggctttgagttattgtccagtgtcctttcatttcatcctgcagggctccttggaatatttcttgcaaggcaggtctagtgataacaaactctctcagctttggtttatctaagaatgtcttaatttcttcttcacttttgaagtgcaattttgttggatataggattcttggttgacaggttttttttttcttttcctgtagcacttggaatatattggttcactgctttctgttctgcaaagtttctgctgataatattatttggaaagcctggtgtgtgatgaactgcttctttcttgctgctttcaaatgtaagaggagaattctctgtttgtccttgtcttttaacaatttagttaaaatgtgtctctgagttaattttacttggagttcactgagcttcttggatgcttatatccatgtctttcatcaaacttgggaagttttcaggtattgttcttcaagtattttctctgcccctttatctcttttttttcttttgggcacaatttcctctcacaattcatatactggttctcttagtggtatcccacatgtcccttagggttttgtcacttttcttcaatctttttttctatttcttagactgaataatttccattgtcctatcttcaagttcactgattctttatttttcttgctcaaatctgcctttgaatctctctagtgaactttttaatttcagctattgtattttgagcttcagaatttcttttatattttaggttttctctttgacattttcatttttcatacataatttttctgactttctttacatctttcttttgttcttcaagcatttttatgacaattgttttaaagtctttgcctagtacatctgccatcaggtctttttttagagacaattattgttgacttacctttttcctttgaatgggctgtagtttcttgtttctttgtttcttgtttcttgcaattttttgttgaaaactagaaattttaatctaactctggaaatcagattgtctctccataggtttgctattttttgtttatctttcttttaaattttttgtaggctgtctttgtgccaaggatcagcctgaggtgtaaacttgtggtattatctgagcctttccctgagcatgtgtggtgactttctaattttccctgtatattcagttacttttgaatattctggtctttaatttctggctcccaaaagcggaaaaagagaaaaatgaaggtgggaaaaatgggtgttagcattttaaatcccctgtaagtcattttggccagagggggaggagcaacaacaatgaggaggtggccaaacaatggtgccctcctcctttcctgcacctctgtgatgagaagcagcaatcagcagtgagattgcagattcccaatatttggaggacaacatctgtattgcctgttctggctcctgccagtgtgtgcaggctgctccaggaacatgtgcacagctgcttgccacagggctgaaggtgagtagcggtagctcctactgtgatgaaagctgacattgactgcaaggtgtatccagaccttccactagaagtcggaggccttcattaggcttcagagttcaaggatcagttacatcagacagatcctactagcacagtgttgtcaggtgggagacagattcctggtgtttcctactcaccatcttcccaaaactaattcatgctttactttagttttacagaaactttataaattgagtggggttcatttaatagtttacattttaatgatttttaaaatgttggattttttgctgtttttgacattctcgtgttcattcattcatgcagttaatgccaatgtagaatctacttgtggaatgagtacttgtgtccatgtgcagggagaggtgcatggtgcagtagccaaagcctaccccacgtgggtgaggtccttacttcaccgctccatgcagggtgtgcagagcgggcctgtcttataaaactcaagttcccagttactcacctgagcgaaccaggctccttccctgttccatctgagggtggcacagggtggagtgtgagggatgggctcagtgcagacagttgagggcccacccagtcttgtcatatcttcacctgatgccttgaaggcaacacagactccgtgtgtttgatgctgacctcaggatctttcctctgtcctggggctgtcctgagtccactcgcagtgctataacaaagcaccatggatggggcagcttagaagcaataggaatttcttcctcacaattccaggggttggaatccagatgccagtagatttttgggttcttggtggaggcacacttctgggttgcagatggcattttctcacatgaaggaaaaagatctacagagcctcttgtagagggcactgatctcattaggagactccaccctcatgacctgaccacctcccataggcccctcctcctcacaccttcaccttggggctaaagattggaacatacagattttaggggtcacaattagttcatagcagcctgcttcagaaaacagcatctgctctgctgtcccttcaaccctgcagagcccacctttctcactcacagttctgaacaccttacccgctgacacatcgcagtctatgaccatgtccacttcagtcaccattaccacggtccatgctgcttgagctcatgtctcattgagacaatctggaggccaccagctgtttcccttctgtctcctctggtctccaacctgttctttatccaggggagggaacttttgttgttgttgttgttgttattttggatatggggtcttgctctttcacccaggctgggatgcagtggttattcacaggtgcaatcatagctcattgcagccttgagctcctggactccagtgatcttggctcctcagccttctgagaagctgggaccaggagagtgggacagtgcccttgcctaggccctgttgatagctcgccattgtatttgggataaactccaatcccttaatgggtgaggagcacccatgtagttggctcccttccttctagccatccgtgcctcccctgccccttctctcaagttctctgagtgactgtgctacccgagggcatttgcttgctgtttccatccctgcgtctgcctctcgcgctctgtgccttagactagtaacacgatccattctctcagccctgtggtagttcttggggacccttctggggctcccttaccccagcctggaccaggctcccatgtaggccccagggccgtggccggtggcttctcttttccctggggtttgccatgggttttttaatgcatattctttaccgttgttcctgccagattagaggctgccgggggccgctggctcctcctcctctctcatctctgcttccatagctcctggctcagcctggtaccacaagtgctcaggaagtatttcttagatgaagagtagagcattcccgcggcacgtcttccacatccctcccaactgatgtgtagattgcctgaagctgagcgacctacgttagtctagggttggaagtcatgtggctttgttgctgattttatggtgtgggagtttggccaaggggttcccaaagcagatgcctgaacaagtgtcagcaccagtgggaacccacgagaaacacagattcccaggcctgacctgtggcctcctgactccgaaacgctggagggtggctggggcatctgcattcctggtgagtccttggcccatcctggtgagtccttggcccactcaggtcccagagccctggactgggcagggaaggcctgtggtacgtggatgcagcctcacctttccattgctgtaaccactcccaaactggaccagctgtcaccttcacctacaaagggtttttttgtttggtttggtttttttattttaaatacactgtcctgggctccagttgcagccacactggctgggcaggacaggcatgggcctggacaccctccccaggtggctctgaggggtacccagatgtaggggccaccggtctccctggaggtaccgggcttttgggacaggctcagcccctgagctcagatgtggctcctccctgagtggaaggcggcctgtgccccagctggtcccggattgctacgtgcctcgaagtcctggccaaggatggtaggctgtgtccctggtggccacaacaacagcttgtagcgtcgacgccatcagatggctttcttgttgcaggtgcgaggcccatgagaatccacctcaatgcgtctctctgtccccaggaaggattcataacccccaagaactaccctctctctccagctagtgcagctgcgctctgaggctagactagtcacggcatgcgcctgctcatgagtctgaatctgcaggccctgctgaggtcctctccccaaggggtccctgagtgtaagtcatggatagagaatgcctggggtctccagccctggtgccagttctgttaccattgtcctactcctgcctaaggcctctgcctgctctgggcacacacagccatgccctacatccagcaccttgtctcatcactcctatccctatgctagcatcctagacgtcttccagcttaacagaaactgcccctcttgcccccagaaccctgggcagctcttacagtgttggccccatctctcctttcctactctccatccctccaatgctgaacaggctgcaggtccctacagccttgcagaagagctcctgtgaggtcagcccacagccatcatgacccgctaagctcggcctcagctccccatcctcatctctctggaccaatctgaggcccggcccttctccttcttggaattcttgccagctcgctgcttgcctctgtcacagtccttttcattctcttttgccagttcccctcattgccctaaatgttggggggccctcaatgctggggggccctaaatgccggggggccctcaatgctgggggatcctaaatgctggggggcaaggctccgtcttaggtgctccagcttcagtcaccctcctgaggccagtgaacacctctggtcgtacagctccccggtctcggcattcatgatgcactgcccccagcacccagcctggacgccctgctgtggcctctgacctctgcactcacaggcacatcgcccctcagtacccagcctgggcaccctgctggggcctctgacctctgcacacatggatgcactgccctcagcacccagcctggatgccccgctggggcctttgacctctgcactgacagacacgtcgcccctcagcacctagcctggacgccctgctggggtccccatgtccacgtgtgcaggatgtaaactcctgactctgtcagcaccactcccagctgggccttcctggggcttctgcccatcttgtgttttcccagtgccagcggactccaccggcatggcctcagatgtccctccagatccccaggctccccaccggacagccgtggtggccagctcaggcccctgccccagctgacggcctcctgcactcgtctccaggccatgtccacccagctgctctgtgacttcacctcctcaccatgtggcaccgcggcccccttgccttctctgctcactgtctgataccctgtttccagctccttcacctctgttcaaacggggccccactggagaggcctcctatagcccactttacaagacagtctctcctctctgcccttccctccacagccctgcatgccacttctctacccagctgtctcctccagagaacttgtcagccgacaggagctagtctgcctgggctgctggcgcacacttccaaagtgggaaatccatcttctccctgtcctggaggctggaagtccaagacccaggtgtgggcagggctggttcccctgaggctgaggagggtctgctcccagcctcgcccctgctgctactggcctgagatgacttcagcttgtgggtggtttctccccatgtctttgcgacaccctgtgcgtttgtctctgagtccaaaccctccttttatacggacaccagtgatattggcttagggttcaccctattgacctcagcttaactaaatctatgatagccctatttccaaatcagttcacattatttgggttttaggatttcaacatatgaatttttaggtgacataattcaacccatcatagcatgattgatttctattcaccagcatctctagaatgtgaacccctcgagggcagggctggtcttgctgttcattgctgtatttggaagcagctcctggtgccctgcaggcatcctgcacgctcactggatgaggaatgcaggcgttttggtctgctggggtgaaagcctttgcggtacaacatgcttttacataatattgtaacttaatactccattaaagtggtactaacaggatttcacaggcaacttgtgactttcaacctgaatgctggccttcaggatgagtcatcaagctgcaaaccaccctggtgacggctcttgcctcttgacggacaggtccccagccaggtggccttgtggggagtctgcggccacagtgccttccgggagtgcccccgccccctgccctgagttgctgccagtgggctggctgcctggtttccatgctcacacttccattgggtagttaaattgcccctcactggggcctggttcacatcagaaatgagcccattaaaaacagatgctttctccatggatccgccccatcctcagtcagagtcccagcatccgccgcacctgcctgtcccttctcccttctcccctttattgtattttcactgaaggctgagaggagccagtctccacacggtgggccacttgcgattcccacagccccgtccgcactgcactgtttgtcttgttgctggaaactcaggtgactccttgtgcctgagggggcagctgaccccaggccaggagagcagggtgtgtgtggggaccagggagcggggctgtggggccacagggctttagttctccaggactgctggctctgtggtgactgctccccatccctgctgtcatccgcagccccctgcgccccgaggaaggaaggcggctggtggaggacgtcgcccgcctcctgcaggtgcccagcagtgcgttcgctgacgtggagtaagtacggggccctggggtttctgtttggctcctgttgcttggtcgcagagactgggtgggagggaaggagctgcgagcccatggctcttgttaattacatgagggaacctgtttagagaagtgaaaggtgatttcagcagctttggtaagttatttagaggcagtggaaaccagtgtttaaggggaaggatgaaaatctcctgaaggacagtgtcgctgcagccaagtgtcaaacctttggtgctgtaaccaccgaaggctctagaacattctgcacatgtcctatgccaatgtgtgggagcctctggagggcccaccccagagaacactgtgcagcgttcatgagcacctgctgtggacacggccctgtccctggctgtcaggaaaatgcgctgcccttcggagacctggctttggatcccgagtctctgcagcttccatggcaggcatggccatggtctcagcgtgacctggtttagagagttgtgggcatgaggcatgcagggctggtgggtgagtacacacaggggcagcctcttacctgtctcacgacaagtgcttgaggaaccatgcgtgcatatgtgaagcttggagcagagatggctgagtgcagaagctgcaggagctcccacagcgcacagctgggtgtggagaggtcagagagaagagggagggtagagtgacatccacagaggacgtgagacaagaggccggcccgggctgtgtgcccacctgcctgtggaccgaggggtgcctgcctacacgtgttgttcactcactggccccttcacacgggtgacatcattcactcactggtcccttcacacagggtgacttcattcactcagtgactcttcacacaggtgacgtcattcactcactggctcccacagagtgacgtcattcactcactgactcttcacacaggggtgacatcattcactcactgtccccttcacataggggtgacgtcattcactcactgactctttacacgggtgacatcattcactcactggctccctcacaccggggtaacgtcattcactcactgacgcttcacacaggggtgatatcattcactcagtgactcatcacacaggggtgacgtcattcactcactgtctccctcacacaggggtgacatcactcactgagcctttcacacaggggtgacatcattcagacactcttcacatgggtgacgtcattcactcactggctcctacacgcagggtgatgtcattcattcactgagtcttcacataggggtgatgtcattcactcactggctccttcacacagggttgacgtcattcactcactggccccttcacacaggggtgatgtcattcactcactgtctctttcacatatggggtgacatcattcactcacagagtcttcacacaggggtgatgtcattcactcactgtctccttcacacaggggtgatgtcattcactcactgtctccttcacacaggggtgatgtcattcactcactgtctccttcacacaggggtgatgtcattcactcactgtctccttcactcaggagttatgtcattcactcactggctccttcacacaggggtgacatcattcactcactgagtcttcacacaggggtgatgtcattcactcactgtctctttcacacatggggtgatgtcattcactcactgtctccttcactcaggagtgatgtcattcactcactggctccttcacacaggggtgatgtcattcactcacggtctccttcacacaggggtgatgtcattcattcactgtctccttcacacagtggtgatgtcattcactcactgactcttcacacagggctgatgtcattcactcactggctccttcacacagggttgatgtcattcactcactggccccttcacacaggttgacctcgttcactcagtggctcctcacagcagatgctcactgggcacctgtggcaacctggcctcgcaccaggagctgggcatcccctttgagatacatgggccctgcctcaattctgccatttattaggaaaagacagaagagtgtatgggtcattagcatggagggcactaggggacatgcatgagaagcaccccagccagcctgggatcagaagtttctagaagtagaaatctgaaggacacatggaggcgtcccagagagagatgtgacatgcaactccacactgctcactgtggcccacaccgttcctagggtacagacatatgcaatgagcaggttcaaggaaatgtccatggacaggaaagatgtggagggacagggggctccatacatgccagggctgctggggtttccctgaaatggggtggtccggtgggcaggccaggtaggactgctcagcagggacagagaggccatttagggacccagtatgtagagtgagaggaccctacagggtgaacacagtgagatggtctgactagagctgagagagagcagccctgaggccacctggggaaggtaaaggagggagcaggtgcaaggcgggtgtggtggcaatgggagcacagagatccaggtgagggggggctatttgtggggctatagtgggtgagtgggctgtagagatccaggtgagaggtggcaggtgcatggggctttaattggcaggctcatgcagacatccaggtgagcaaagggtcacgtactcagggctgcagtgggcaggtggtttgcagagatccaggtaagagtgggaccaggcacagggtgaatgcagtaggaaggggctatgctgagatgcagatgttttttggggggcaggtgtgtgggcctgcagtaggcagcagaggtgcagagatccaggtgagggagggggcaggtgcatcaagttgcagtgggcaggggactttcccagatccatgtgagagagggggcaggtacatgggcctgctgtgggcagacggtgtgcagggatccatgtgtgagagggggcaggtgcagggcagatgcagatatccacatgaaagagggggcatgttcatgggctgctgtgggcaggggacacgagaagatgcaggtgagggaagagagcaggtacagcgtgactgcagtgggtggccactgggtgacttctgcctgggaagcaggatttgaagaattgtagaaaggcagcttcaaggatgagggtagatctgagtgcaaagtgtgtgttgatctacacagtgtgatgcctgcccatggaaacaggcaagtagggcctcaggcagaagtcctggtggcccctgggcagtcaagtgttttccctgtggctcacaatggggagggcctgttgttcccagagtggcctgggatgtttgggcatctggggttctggaggtggcgggtgggcaggggctgcagctgtttcccacctggtaggaaatacttcagtgttttaacttctgatgtgactgagggtactggaaatgtatggagtggctttcagcacaccagggacttaggaggggggagggtttgagggagcttcctaacaggtttgattgataggtttgtttcaggtacctggatgacttctaaggggtgctgtccaggtgacttaggggacagatctgggtaggtgtatatgacataaccttaatgtacagtggacagcaagatcccagtttctgatgggatcaggagatggaggtaagggaagagaaggggggcagcagcgatgtggggcacgtggacccttaggtgtatgtgagaacagagacaagtgtgcatgttggcaccaccttggtttcttgtgaggtagctcccagtcagtgttttgggttcctagggaagaaatattaactctagggaaaccacacaggacagatttcacagaggttgaaaatagaagaagctcccaagacctgaaagagctgagatgcttccaggatcttaaaatcttcctctttatgctgaaggagaattagataatctggttttatgggatcctggggaagtgacttttcctctctgggccatagttttatattttgaaaattagaggggtttgcctacttcatctttagtgattactcaaggattaatcttctgtgaacctgtgacctgggacactagtgaaaatcatgtaacaggcactctatcaccttcggggagcagggcacagatagtgtgacagggttatatccccaagggcagactccacaggtaggcgtttgtgtggagaggctcatttcatcagcccctggagacatcctctttatcagtgttttggatattcccaaagtggcacacttctgagcagtgataaacagtgagtcagaaaaggtggaaatagcttcttccagatgatacacggaggtgtgtgtgtggaggcagggagggagctaagaaagaagctggagccaaggatggaggtgatggtggagctttggaggaaactgcgctggagctgggagggagcagaggtggaggttgggatggaactcaagagagagggagatgagctgagatgaagctcagaaaggagctggagatgccacttgtaaggaataaggataaaaatgagatagagcagaaatggagctggggggaagctagagggagctgcggggaagctaggtggatggggctgggatggactgggatagagctaagatagatcagggaaggaactggaaatggagatgggatgaagctcagaaaaaaagctgagatgaatctgaggacagagcaggatggagctagaatggagcagtgatgatctaggatagagctgaatggagttggaatggagatggaaggagctgggaataaaacagaagagagatggggatggaattcagtggagctggatgaaggaggggatggaactggatggagctgggatggagcagtgatagagctgggtatacagtagtatggagatgagatggagtagtgatggagccgggtatagagtagtatggagatgggatgaagctgggtggagctgcaatggagctggatggggctgcatggcgtaagatggagctaggatggaaattgatggagataaggataaagcagggcatgcatctggatggaactggatggagatacaatggagatggatagagctgggatggatttgtggatggagatgaggtggagctgggatggaggtggatggagctccatggtctgggatagagttgatgaatctggatggaagtctatggagcttggttcagcttgggatggagtagggatggataggaatggagctggatggaagttcatggagctggggattattgaagccttggatgtacctggggtagagctgggatggaatctgctgtagctgagtggagatgggatggagctgggatgagggtgaagctagggtggagtttgatggagctcagtggagttgggatggagctgggatggagtttgacggagctgagcacagttgggatggagctaggatgaggatggagctcggatgcagttcagtgaaactgagtggaattgggatagagttgggatggagctgagggtggagttgggatggagtttgatggagctgagtggagttgggatggagctgagggtggagttgggatggagtttgatggagctgagtggagttgggatggagctgagggtgaagctagggtggaatttgatggagctgactggagttgagataaagctgaggatggagctgggatggagtatgatgacacttagtagggttgggaaggagctgaggatggagctgggatggagtttgatagagctgagtggagttgggaaggagctgagagtggagctgggatggagtttgatggagctgggatggagtttgatggagctgagtggagttctgatggagtttggataagggtggagctgggatggagtttgatggagctgtgtggacttgggatggagctgagggtggagctgggatggagtttgatggagctgagtagagttgggaaggagctgagggtggagctgggatggagtttgatggagctgtgtggagttgggatggagctgagggtggagctgggatggagtttgatggagctgagtggagttgggaaggagctgaggatggagctgggatggagtttgatggagctgagtggagttgggatagtgctgaggatggagctgcggttggtgctggttggagctgggatggattttgggatggagctgggatggttgtgatcatgggtggttgttggctcttcctcaagctctcctccactactgacaaggcctccatcagtcctgttctctctcttttctcccttctgttctcctctctgtccctgcctaggtgagccctatagtcttcatctcctttttcatcttgtgaggggccctgctgctgatcttggtgtcttactatttcctcatctatgacttttttatccatccacaaatccctgattttcacagcggtatctttgctcttaagttgtcttgattcttatgtgtcttccagggcctttctcaggagtctttgagcctgagattcacctgacctccattgtcttcatcctggccttcctcaggccttctgatgcctcagactgctctggggagggcatagtgaggaagcacagaaaagaaatctcaggcaggatgccctgatgctccattgccttaaatctgtctctaggccaggcacggtggctcatgcctgtaatcccagaactttgggaggctgaggcgggtggatcatgagctcaggagttcaggaccagcctggccaaaatggtgaaaccccatctctacttaaaaatacaaaaattagtcgggcatggtggcaggtgcctgtaatcccagctacttgggaggctgaggcagagaattgcttgaacccgggaggcagttgttgcagtgagctgagatcgcgccactgcactccagcctgggcaacagagcaagactccatctcaaaaaaaaaaaataataataatctgtctctaagaaccagaaggaaatgtgtccaggctgctaaccatcatgggctgagtgggatgatctgacttcatgggcattacaaagagcagtgtgctgtggcccccgacaccattggtgtccatcacatcaagtgggggcctgcactgacctggcacagagcaggacatgtaagaaggggaacactcatccctgcccctgagctgtttgaaacctggctcatgagacaaacaaatcggacagtgctagagaaggttctggaactgccagtgacctcagacattctgagtacaactcatgctagggaagtgaggctggagaggaagggaatctcctggggcccagagagtgggccctgcctcggacatcgctgctccatgggcacagccacgttagtccagaaagtgcagttttcctgatggtctttgagtctcacctgtgtgcagggctcttcgcgttctttttcctactgctgttattttaaggctttttacctcttactttgaactggaaggagccacctgccatcaagtgtcctgaatggttcaaactgcattcctttccacgaaggattccatcccaggcctgtatctttggcactatccctccctatggcccccaggaaggcgcctagttttaggactcaggaactcatcgtgggcccaggccatgcgcacagggaggatgaggccacaggtggtaagtgggagcctcacactgactgcagccaatgaccgcaggccctttgttctaggtgctcacgcctgcttctgctgtcagacagggacgggtgcatgtctggacacccaggccttactgggtcctgctgatggcttatttcagaaggaggggttccccatggactgatgccccagctcctgtcccgtcaggctccctgtctaggactcagctctgatgccgctgaggagcatgaggtactgtcctgggggtgtgtcctcccgggtctgcagtgccttccctgcaccgtggcccccagaacattagccgtgtgctgtctttctccccagaccatcagctcctcagtgcctatctatgtcctgaacccggctcagtgactgcagagaagtgtgcaagtgcacacttgcatcttaagtgcaagtgtgattcaagcgtgatgcaatgagtccttgaacaacaaaggcctcatccctccaacacccgcaaagctgcaggcccatcccacacccccttctgcctctctccatatatcaaatacatggggcatgctctgtgattctgcagccctgggaaactcacctgttgctgccaaggcccacaattactgatgaacgtgtggaggtgtggatgcctccttagttaaaagtgagattgtcctcagggacatttgagggccatggaaaagaagcagcctgggtaccatgagaggtgcctccatgagcagcagggcggcctggagccatgggagggaggaagctgttgcacccagacacataactgagataattgggcagagggcaggcagtcacaagaggtggctttggaataaagcatcctcgggccagctcgggatgcgtgcattgagtttaccatattttcctctggcaaagcccttctgtggtggctgtccagcacgtggaaggccgtggctcaggcgcacaggggctcagtgttttctgaaggttccctcctggccgccctgctgctgatggctgccatgcactgttagcatcatggctccagggtgaaggcgtgggctgagggctgcctggcacctgggctcagtgcctgccacatgggtccagtttgcgatctggggcttgggagaggaaccacttcatcctcaggacaggagaggggccccagggtcagctgcaagctccatggctgctcactgtgagcagatcctgggacctcagggcccaccgtggcgtagtgacgggcagagatgggcctgccgctgctcactgctttggccatctctgccctcccccagtaacatcccctgggagagggtgggccagaatgaagaagggaggagtggttggccacatggccaacagctggacggtcagggtggccaggggctttgctgtccacactgattggagcagacctgaggctgacgggtgcactactgtgctgggtgagattttcttaaataccaggtgggatttcttttaaagtctccatggctttcatggtgagctgggttttaaactcttttggtgcaatggaaggtgtgaggtctttctttgtatacagtgggattgtttgggctagatgactggaagaaggaatgagtttattctgctgattgtttcttttgctgtgcagaaactttttagtttaagtcccagctatttatcattgtttttgttgcatttgctattgggttctttgtcatgaagtctttgcctaagccaatgtctggaagagtttttccaatgctatttcctagaaattttatggtttcaggtcttagatttaagtccttgatccatcttgagttgatttttggataaggggagagatgaggatccagttttattcttctacatgtggcttgccaattatcccagcaccatttttgactagagtgtcctttccccactttgtttttgtttgctttatcgaagatcagttggctgttaagtagttgagtttatttctgggttctctattctgttccattggtctgtgtgcctatttttataccagtaccatgctgttttggtgactatagccttatagaatagtttgaagtcaggtaatgtgatgcctccaggttgttctttttgcttagtcttgctttggctatgcaggctcttttttggttccatatgaattttaggattgtcttttctggttctgtgaagaatgatggtggtattttgatggggattggattgaatttgtagattgcttttggcagtacggtcattttcacaatattgattctacccatccatgagcatgggatgtgtttccatttgtttgcgtcatctgtgatttctttcagcagtatacagacaacccaaagagtgagaaaaaatcttcatgatctatatatccgacaaaagactaatatccagactctacaaagaactcacattagcaagaaacaaacagtcccatcaaacaatgggctaaagacatgaatagacaattcttgaaagaagatatacaaatggccaacaaacatatgaaaaaatgcccaacatcactaatgatcagggaaatgcaaatcgaaaccacaatgttataccaccttactcctgcaagattggatataatcaaaaaatcaaaaaacagtagatgctggtgtggatgtggtgaacagggaacacttctacactgctggtgggagtgcaaactagcacagccactatggaaaacagtgtggagattccttaaagaactaaaagaactaccatttgattcagcaatcccactgctgggtatctacctggaggacaagaagtcattatacgagaaagatatttgcacacacgtttatagcagcacaatttgcaattgcaaaaatatggaaccaacccaaatgcccatcaatcaatgagtagataaagaaatcgtggcacacacacacacacacacacacacacacacacaccccatggaatactattcagccataaaaaggaatgaaataatggcattcacagcaagctggatggaactggagactattattctaaatgaagtaactcaggaatggaaaaccaaacatcatatgttctcactcataagtgggagctgagctatgaggatgtgaaggcttaagaatgacataaggactttggagactcagggaaaagggtggcaggagggtgcaccaaaatctcacacatcaccattagagaacttactcatgtaactcaacactgcctgttcccaaaacctatggaaaataaaaataaataaagaaggaataagtttatttcatgaacacaatgatccttatgagggaggagtggggagaggaagtgaagcatgaccactgatgggatggggggaggaagaggaggcagccgggatgtgttggggggaggaaggggaggcagccgggatgtgttggggggaggaaggggaggcagccgggatgtggtgggaggaaggggaggcagccggtgatgtggggggaggaaggggaggcagccgggatgtgttggggggaggaaggggaggcagccggggatggggggaggaaggggaggcagccgggatgttgggggaggaaggggaggcagccgggatgtgttggggggaggaaggggaggcagccgggatgtgttggggggaggaaggggaggcagccgggatgttgggggaggaaggggaggcagccgggatgtggggggaggaaggggaggcagccgggatgtgttggggggaggaaggggaggcagccgggatgttgggggaggaaggggaggcagccgggatgtggggggaggaaggggaggcagccgggatgtgttggggggaggaaggggaggcagccgggatgttgggggaggaaggggaggcagccgggatgtggggggaggaaggggaggcagccgggatgtggggggaggaaggggaggcagccgggatgtggtgggaggaaggggaggcagccgggatgtggggggaggaaggggaggcatccgggatgtggggggaggaaggggaggcacccgggatgtgttggggggaggaaggggaggcagccgggttgtggggggaggaaggagaggcctccgggatgtggggggaggaaggggaggcagccgggatgttgggggaggaaggggaggcagccgggatgtgttggggggaggaaggggaggcagccgggatgtgttgggggaggaaggggaggcagccgggatgcggaacccaggaatgaggccagagaagaagtgggtcttcaaggctgagaagcccggctcccctcaaggacccaggaacgctgcaccccgcactgtcaccttctaccatcttctccggccctccccgcggccccgttccccgtcccccactgcttccttgctttctcgctttctccccagctcctcggtggtcacgctttgcttcatgtctcccactcctctcccataaggagcgtcccgcgttcacgagataaacgtccttcttcttccagtccccgagcccaagcaaccccattcaccttcacagagtctcagcaaaatggtgggactggcagatgccaggccggggcgggcgagggaggcgtgtgcctcggggagcctctggtttcacagagcagctgggcctcgcccgtgcctgctccctgcccctggccctcctggccaccgccttcgctgtcggaagacggattctgagcacggacggcttctccgcattccgggagcagggctgggctttgccaggctcagtcctgggtaagcgtcaccctcgggcatctcccgccttaggacactggcggccccctctttcctacagagtcaaacctgagtcccgccgcccgtccctcggagccttcgggaatctggacctctccacctcctccccagggagcccccccggtggcctcacccgcaggatcctttgcgggtcccctgcccacattgcggagctgaagcctgattcttgctgcgtccagcgcttctccgaggtccccagtcctggccaggcagaggctgccccacgctgggtcttgagttctggtgcctgcgtgcgtgtgtgctcatgtgcaggggaccacgcaagccttacttccacgtcctgtgcctcacccgggcccagcagccacgggcacacacttggcaaatgcaccggctcgagggacggacgggggtgtgggctgtgcctcgttggtgtctcgaggggagcagctctgacaggcgggagacacggccacgcggtgctgcctgtcagagcatgttctgggagctgctcattgttccgggaaaggaaaagaggcggacaggatgcgcaagctgtcactctcagactctcctgcggttttgtggaagtgctagttatgctgaatatgttttgttagtggttatgtagctgtcacataaatcccattatttcttatgacatcattagagaccattaaaactgcattagcatgtgatgtaattatgccagcagaccggcagtgaccgcagccgggtttttacgacgtgattgtggctgtctgcggcggcggtgatcgatgccaggccgccttccgcggaatctcggggaggtgggcagtgctcctgggaaaaaggatgccaaagacacattcccacgagcccctgagtccacagtgagacgggctctgtgacagttctcttccagatggcttcggtggagctcccacatcagccacgaggaccgccggggcattcggggcacgcagcctaattctgtgatcaatcttcatgtgctctcctggtgggagaagcgtttactttctcatctgtgtgatttactggattgatgaatacggtgttattaccgaagaggcagcagtgggaattctcaaccctgatgcttcttgttggggtcttctctgtgcacggggcgcgggaggtgcctgtgcctgctcgatcctgtgacaaccccagtgctgcccgggcccctccacctccttccccagtgcctgcccctctcccaccctgccagtgggagaagtccctggggtttgccgggaaacttctggaaagtatgtttcagtttccgggggcagagttgtgattgttttgcccctagtcttgtccccatgcataggggatttacaaagatgttgtaggcagcaggaatcctgtgaggggtgagaatggtccttcattccctgggttggctctctggttttccctgtggcctcgatgactataaagccctggataattttgtctacacatcagggcagtgcagattaaccactgcagcgacagtgctgtgcgttagtaatatcactcaaagccaagagcccccgcagtgagaaactcccaggagccccaggggagggtctgggtaaatggcatttgcatctggatgtggtgtatccaccacctgcagactccggccctcacgggcaatgttgctacctgtttcacctgtgttctggatttgccaagtgaggaaggtggggaatggggcctcatgttatgtaactctccttcccaaacggagcccaggcttcgtcttcagtgccctgtctgaatattacaagcagttgcaaaggtgcaagctagtgtctcgagacagtgacatgaggttttcctggaaataaggaatgtcaaggaaatgtcacagtacgtcaaaactccccgtcccgtctttaagatgagacaacaagggaaggccactgtggatttgcaaataataattctgtttgagtgaaaggtggcatttctcaggttaagtgaatcccatgatttgattaaagatatttgtgtttaaaatattggtggagccttgtttcctagtatgaaatgatatgaccatttaggaggagagcagtttccttattttcctgagcctcagtttccccacaaggatggaggtggcctgggcatgtggctgagacccggctcttagaggccccacacatggttcatgctttgctggtaccatcttgagactcttacaattcttcaacaaagggccccacaaattatgtatacggctgtgaggccatgacagggttggagagactctaggaaaaactagaataacgtctgctgtggaggtttgcaatacatgttagctggacaattgcgctatttcattgctgttaggaaaaaaaacactctaatttctactgttaatggattcagattggcaagaagaacccattcttttctctagacttttcaatgcacttcaagtgtgaagcattgggtaaatgctggatttgggtactggacaccaggtagtgaagagtttcccaggcagttctgagttttcttgtaaaggcactttcatccataggacttgaatcttttatctcctggcctggtgcggcggctcacgcctgtaatcccagtactttgggggctgaactgggaggatcactggagaccaggagttttgagaccagccagggcaacatagcaagacctcgtctctgcaaaaccagaaccagaaagtatacactcctacgctccttgaaggcagggcctcagtctgtattgctcaatcatgcgtcatcagtgactagagtgtttctggcccataacaggggcttatttgttgaatgagtgaatgaatgattccacgaaagaatgggcagactgaattcaaaggcacatgggtttgactctgtttttctcaacttgctgtgaggccctgggcagattactgaagccacctggcctcagtgtgctcctccatggagtagagacgataatgtctacatcagagttgtagaattaaatgccctgcgtatgcagatacttaacaccaaataaagggtagctttccagatacattattaaagtaataaaatgtctaagccaagaaatatgtaaacacatgaacaagttagatttatatagaaatgacaccaaacactgtggtaaaatatgcattttacttatgacctacaccgtcaatactagataccctgcttggcgttattcttatttttctcaccaggaccaaataaaaatcacttcactcttccgaatgtgtctctccagtcagagacgttgcgcatgagctgattgcaggaggctttggggcagatgggcggggcaggttattcaggactcacctcctgcaggaaaggctgagacctgcaacccagggcagggaggaatataaacctgccccagttacaggacccagcggctcctcccaccacggatgctggcccatgagtgtgcgttacacttcatttgggattgcaaactggagttgtttgaaggctggcagttgccttcgggagttagcagcctgcgtgtccagagaaacaaaagtaaaacaagaaacaaaaccagagtgagccacagtgcccaggagaccctgagggatggtggggactgcgcagtggagccctcaggaacactcagggggaggagttctcacctttcctgcctgtcctacagcaccgaaggctgtggccaagctgctgaggcttcgggaaaaagcctgggtcctaattcttgggtgaatgcttctacttctaaatgttagtcactaataattcagtcatgtgtttgtgtagctcattaatccttaagcatcatgagagcgaagctgcaatagaaagcacagatgggggccgggagcagtggctcatgcctgtaatcccagcagtttgggaggccgaggtgggcggatcacaaggtctggagttcgagaccagcctggccaacatagtgaaacgccatctctattttaaaaaaaaaattagctgagcatggtggcaggtgcctgtaatcccagctactggggaggctgaggcaggagaatcacttgaacccgggagtcagaggttgcagtgagccgagatcacgccattgcactgcagcctgggtgacagtgcgagactccgtctgaaaacaaaaacaaaaacaaaacagaaaaaacacagatggggtggccctggtccttcgggaatggcgagcgttctgctgctcctggtgagatccggcccacccctgtgctgggggaacaagggtcttctcttgggactggtcatgccacccagcaggtgtaacaggaaagcagcctgcagtagaacttcaaaggaggcaaatgcttctaaagttcaaaggcaaagcatacatactgaacaatctgttttcttccaaatactccatgagaaaagtaagcggcaagacattccctggcacagaaaggatttcccaaatcccatgtaatggcaaagtaattgcaaagaagatacaatctgcacagtgatgcagttgctcaatgctttaagaaaataaagcatcattaataattatgttttcattaaggcttgcatgatgttaaattatcttgcaataactgtgtgtgtctttgtttcctcatacattcaaataagaattggttctctcttcttcctcctttgtaagctcttaggctagatattttgggaagttattgcctcatgtacgagaggcaggaatacacaattgtgcaggaaatgtggtaaaattaaaagtgtgtgtaaggaaagtaggtatgcattatgctatccacgtggaattccggagttttatgttcccgatgtctcctctgtaagaagacatagctggaatgaggcatgcaaagagaattctgtagcagccagacgtgagctcatttttttattggttttctgtcggtagcttggattagcccagcaccaagctgtgggcttgcctagagtgagggacgccagtgaacaaggaacaagactggaggaggcaagttatcatcaggaacaattcagggagtaaaagcacaaacagtgtgggggtcggtccagcgacagagtcaggaaaggacagtggtgcaggcctacctgtgggtccacagtgtgggggtcggtccagcggcagagtcaggaaaggacggtgcaggcctgcgtgtgggtctacagtgtgggggtcggtccagcggcagagtcaggaaaggacggtgcaggcctgcgtgtgggtctacagtgtggggggtcggtccagcggcagagtcaggaaaggacagaggtgcaggcctgcgtgtgggtctatggtgtgggggtcggtccagcggcagagtcaggaaaggacagaggtgcaggcctgcgtgtgggtctcacacttatactcgtgcctcgcagaaggctctcagccaagaacgccgaagttgtgattctagtggtggcattgatattagaattggactatttggagctagcacctaaaactacaagggtttcaacttattcatctataaaatagcgattgccaaatgagttgccttaggtcaaattttgtggttgttaccgagcaccacagcagcgtgctctcttggtttgcgcccacctactcaaggccagacacagggctggtttcttggaagttcccctgtgcctctacctcgaggctgaggggctggctttagggagcccctaaaacatgtactgtgtgtagtgagctcttccaggttttacctggcctcaaattatgttcagccagatatagtaagtctcttaaatcattatgattttgtttgataattttgagacctttattagcactgtgtttctctgaacataatactgactaagaaacagaatgagcaattcactaaatgtatagcccacaagatgggaaaggtttaatgcaaaatgattcttaagctataaacagtattttgagaaagtgtctaattatgtttgaattaatataagcaataaatatatacatatctctatccaccaaaccacccacctatcaatttttcatccatccatccgtctacctccccatccatccagccagccatccacccatatatctatccacttatccacctctctacccatccatccatccttctacccacccacccacccatctatccatccatccacccatcctccctcccacccactcacctacatatatatacacacacacatatatgtatatatatgcacatgtatatatgtatgcatatatatacatatatgtgtgtatatatatatatgcacacatatacatgtatatgtgtatatatatctctgccctcccattcacccatctactcatccatgtacccactcacccaaccatctctctacccatctatcacctatccctcacccatccacccacccaaccatctctctacctatccatcacctatccctcacccacccatctctctacccaaccatctatcacctatccctcacccacccacccacccaaccaaccatctctctacccatccatctatcaccgatccctcacccatccacccacccacccaaccatctctctacccatccatctatcacctatccctcactcacccacccacccatctctctacccatccatcacctatccctcacccatccactcacccaaccatctctctacccatccatctatcacctatccttcacccacccaaccatctctctacccatccatcacctatctttcacccacccacccaaccatctctctgctcatctatctatcacctgtccctcacccatccacccacccaaccaaccatctctctacccatccatcacctatctctcacccacccacccactcacccaaccatctctctacccatccatctatcacctatccctcacgcacccatctattcatgttatgggcttcactccaaatccaggtgtcaaatagataaagcacaggtcagtctgtcaagccagcagagagcatgctagtaaaataaacaaacaaaaaacagtctacagaagttttgtttttttcatttctaaataactttcaagaaaattcaccagttgaaaagagaagcatttacttttatgttggttgtaaagcatcaacattaaatgattaactttaaaactatatttgttgccatatatgccttggctatcttctttttatccacaaaaagtcaagggaatctagtacctgaggcctgtctttatttaaacggactacaaacttgttaactactgcttaggcagtgtctattcagaaaactgtagtcaaatgtgttacatttattgtagcccttaaaggttgacttgatacaaataagcctgtgttatgtatcgactgtatagtcgttactatacagaaataacaacccccagactaacccaaccaaatagaagcctcggttcttatttaaaaccatttccgaaacatggaagcttttgtcagagatttgttcatcttcttcattctcaaccggacggttggtctaagaacagatggagctcagtgttttctttcctgtggttaaagtgtcatgccctgaaaactaatattcagaaaatcactttgagatatatgattgctaagacaacaaatattagtacatcagtatattgatgttctaaaggcagataattatatgtatttttaaattatttcactcataaaagtaggggaaaaagagatttccaaatagtcctcagttaagaaaaggccttttacgcagaactcttacactcaacagtctggttgatggagggctggtatgtttgtctcataagtcttgagtgataggagtatcctagaacacaagcaataaaatcagtgttaaaatgctagatgtcacttctcttctttgttggcatgttttatgaccatcaaaagaaatgagcaattatcaatatatagtaaactatcaagtggaaccactgagtgataaagaactcaggaataaatggaatgatatttaaaatagaggtaactatagctaaaattacagtgatgaaatgatctcttatctatgtacaacatatatggtttccttattttggttaaaggtagttttaagtcagtgaattctgtagaatctcagtgatatattttttcatgttatttccagcccaattgggagatgactcctagcggcaataaatagcttttgtttctcctaatatattcttcataggacccatgtgaacacattgttcgagtatcacacctctgagggctctaggcagcaggtgtgtgtgaagactccctctttcatcaggggaggaagggtttgtgtgaagactccctctttcatcagtggaagaaggatgtgtgtgaagactccctcttttgtcaggggaagaaggatgtgtgtgaagaccccctctttcatcaggggaggaagggtttgtgtgaagactccctctttcgtcaggggaggaagggtttgtgtgaagactccctctttcgtcaggggaggaagggtttgtgtgaagactccctctttcgtcaggggaggaagggtttgtgtgaagactccctctttcgtcaggggaagacaggtttgtgtgaagactccctctttcgtcaggggaggaagggtttgtgtgaagactccctctttcatcaggggaggaaggatgtgtgtgaagactccctctttcgtcaggggaagaaggatttgtgtgaacattccccttttcatcaggggaagaaggtttgtgtgaagaccccctcttttgtcaggggaggaaggatgtgtgtgaagaccccctctttcatcaggggaagaaggtttgtgtgaagactccccctttcatcaggggaagaaggtttgtgtgaagactccctctttcatcaggggaagaaggtttgtgtgaagactccctctttcatcaggggaagaaggtttgtgtgaagactccctctttcatcaggggaagaaggtttgtgtgaagactccccctttcctcaggggaagaaggtttgtgtgaagactccctccttcatcaggggaagaaggtttgtgtgaagactccctctttcctcaggggaggaaggtttgtgtgaagactccccctttcctcaggggaagaaggtttgtgtgaagactccctctttcatcaggggaagaaggtttgtgtgaagactccttccttcatcaggggaagaaggtttgtgtgaagactccctctttcctcaggggaggaaggtttgtgtgaagactccctctttcctcaggggaagaaggtttgtgtgaagactccccctttcctcaggggaagaaggatgtgtgtgaagactccctctttcgtcaggggaagaaggatgtgtgtgaagactccccctttcatcaggggaagaaggtttgtgtgaagactccctctttcatcaggggaagaaggtttgtgtgaagactccctctttcatcaggggaggaaggtttgtgtgaagactccctctttcatcaggggaagaaggtttgtgtgaagactccctctttcatcaggggaagaaggtttatgtgaagactccctctttcctcaggggaagaaggatgtgtgtgaagactccctctttcgtcaggggaagaaggatgtgtgtgaagactccccctttcatcaggggaagaaggtttgtgtgaagactccctctttcatcaggggaagaaggtttgtgtgaagactccctccttcatcaggggaagaaggtttgtgtgaagactccctctttcatcaggggaggaaggtttgtgtgaagactccctctttcatcaggggaagaaggtttgtgtgaagactccctctttcatcaggggaagaaggtttatgtgaagactccctctttcctcaggggaagaaggatgtgtgtgaagactccctctttcgtcaggggaagaaggatgtgtgtgaagactccccctttcatcaggggaagaaggtttgtgtgaagactccctctttcatcaggggaagaaggtttgtgtgaagactccctctttcatcaggggaggaaggtttgtgtgaagactccctctttcatcaggggaagaaggtttgtgtgaagactccctctttcatcaggggaagaagggtttgtgtgaagactccctctttcatcaggggaggaaggtttgtgtgaagactccctctttcatcaggggaagaaggtttgtgtgaagactccctctttcatcaggggaagaaggtttgtgtgaagactccctccttcatcaggggaagaaggtttgtgtgaagactccctctttcctcaggggaggaaggtttgtgtgaagactccctctttcctcaggggaagaaggtttgtgtgaagactccccctttcctcaggggaagaaggtttgtgtgaagactccctctttcatcaggggaagaaggtttgtgtgaagactccctccttcatcaggggaagaaggtttgtgtgaagactccccctttcctcaggggaagaaggtttgtgtgaagactccctctttcatcaggggaagaaggtttgtgtgaagactccctctttcatcaggggaagaaggatgtgtgtgaagactccctctttcatcaggggaagaaggtttgtgtgaagactccctccttcatcaggggaagaaggtttgtgtgaagactccctctttcatcaggggaggaagggtttgtgtgaagactccccctttcatcaggggaagaaggatgtgtgtgaagactccctctttcatcaagggaagaaggtttgtgtgaagactccctccttcatcaggggaagaaggtttgtgtgaagactccctccttcatcaggggaggaaggtttgtgtgaagactccctccttcatcaggggaggaaggtttgtgtgaagactccctccttcgtcaggggaggaagcgtttgcatctgagtgggcagcattcctttttggcatttcttccaccctaaataggagtcacctttcacggtaagtgaatttgactgtcaaaaggtggatggttctcccaggaacagtgactcagaaactcttcctgctcttgcatcagacgcttcttaccatagatgtgcctggcacgaccatcgggacgacactttcaagatctaccctgacgtggccatttacagattcctcatgagatcttcactgcacggtccagggtcgggaaagagacagtcccctcccttgtatcaaccacgtcattcccgaaggaaagcaaccaggctccctgagaaagcagtacagcgtgcggggactgtgtgaacccacacaagccatagtcaatttagagagtggattttatggaagaatttggaggaggagcagacccctcctgactgagcagggcacagactgacagctttggttcagagggaaccctgtcgcatgtcagctatcctgcccgatcctccaatgccctgcaatgtttgtcttgttcccccgattttgcagggtaaataatgtaatgtgcaaaatcgccccgcgaggaagtggcggttaaacaaacaattggatctcaagccttgtaagctccagtgctcccatcctctctacagtataaaattgaaaaatgtgaagaagataataaggttattgatgtgtgtgaaagcgcttcaacacagatgctaggcagtcgatgatcctgttcattcgcagattctgtatttgcaaattaatttgtaacccccaaatcaatgcttatgccaaagtcattcctgcacacacacagagccataaagttcaggttgcctgacatgcctgtgctcaggtgggagaggacagctccgccttctcgtttcagctcatactgtaaaacaaggctcctctttatggtctattgagtgccacattttccacattttttgtgcttttcgttggtggttttgttgtttaaatggccccagcacagtgctgagtgctgactggtgttcctagtgttgtaactggctcaagtccagctgtttgccactcagaggccgaaaacatgagagtgaggtgtgggcagaggaaagcagttattaatcaaacgctggcagctggggaatggccaggctcatgcctttaacagaccattccccctttgtggctgagtgaggggtttaaggaggaaaaggcatggagctgtgtggagtggtgcaggcggacgccaggctgtgtgtctgttctgatggttatctcatcgtgcagaggcctggtttctatcattgtggcttcagcctgggagcggtgggctacctgttcctaactccccctcagcagaggattctgcagctcagtctctctgcctgttctgtttgaaaattggcccctggaatttctaagcaggtctgtaattagataggtgagcactgtgtaaggagcgcctggtggagaagggagccacgaagaatttcacagtatgcttcaaagccaaagcaggaatgggaaggaagtgctctgtgtgtgaggccgggacacgtggttacaatgtgcctgacggagaaaacacccatgtggatgggcgtcgtgtgtgtggatgggcgtcgtgtatgtggatgggcgtcatgggtgtggatgggcatgtgtggatgggcgtcgtgggtgtggatgggcgtcgtaggtgtggatgggcgtcgtgggtgtggatgggcgtcatgggtgtggatgggcatcgtgggtgtggatgggcatgtgtggatgggcgtcgtgggtgtggatgggcgtcatgggtgtggatgggcatgtgtggatgggtgtcgtgggtgtggatgggcgtcgtgggtgtggatgggtatctgtgtggatgggtgtcatgggtgtggatgggcgtcgtgggtgtggatgggtatctgtgtggatgggcgtcgagggtgtggatgggcgtcgtgggtgtggatgggtatctggatgggcgtcgagggtgtggatgggcgtggtgggtgtggatgggcgtcatgggtgtggatgggcatctgtgtggatgggcgtcatgggtgtggatgggcgtcgtgggtgtggatgggtgtcggagtgtatgggcatccgtgtggatgggcgtcgtgggtgtggatgggcgtcatgggtgtggatgggcgtcgtgggtgtggatgggcatgtgtggatgggcgtcgtgggtgtggatgggcgtcatgggtgtggatgggcatgtgtgaatgggcgtcgtgggtgtggatgggcgtcgtgggtgtggatgggtatctgtgtggatgggtgtcatgggtgtggatgggtgtcgtgggtgtggatgggtatctgtgtggatgggcgtcaagggtgtggatgggcgtcgtgggtgtggatgggtatctggatgggcgtcgagggtgtggatgggtgtggtgggtgtggatgggcgtcatgggtgtggatgggtgtggtgggtgtggatgggcatctgtgtggatgggcgtcatgggtgtggatgggtgtcgtgggtgtggatgggcgtcgtgggtgtggatgggtgtcggagtgtatgggcatccgtgtggatgggcgtcgtgggtgtggatgggcgtcgtgggtgtggatgggcgtcgagggtgtggatgggcgtggtgggtgtggatgggcatcgaggatgtggatgggcatcatgggtgtggatgggcatcaaggatgtggatgggcatcgtgggtgtggatgggcattgtaggagtgtatgggcatccgtgtggatgggcatcgtgggtgtggatgagtgtcggagtgtatgggcatctgtgtggatgggcatcgtgggtgtggatgagtgtcgtgggtgtggatgggcgtggtgggtgtggatgggcgtcgtgggtgtggatgggcgtcgaggatgtggatgagtgtcgtgggtgtggatgggcgtcctgggtgttttctccccgagagctgtaatattaggtgcagtacttgctcctaagagactctgcagggctctaggcatctttgttttactttttatttcctgattagtacagaaattccccttttgatgctggcaatatgcacatgggatttattcaattttccccaaatgtctaaagagacagaaagctgaacaagatggcagagacaaccaaggctccctggttagaaagaagttggtgggaaggctgacctcactccctacccagaagcctctcacctggaccacacagcactcagccatctgccacctgcacagcagacgtggcgggcggggtggggggtggtgggtggggttggtaacaaatgccagggcaagttcttcttgtggggagggatctctgctgctgatggtgctgggggcagagccagcagctcagctctggagcccccagtgttgcccctgtttactgcagacccgctgggcctggccaccagagtttattgaaaaccagggtctcctaggccaaagcaagtccaagaggacctgtgggccttgccacactcgacagctgagtaaactgaggcccagcggaagggcccaggagggccacagaacagtgactcatggagttagacctgtagtggggcctcgggatagagacttcttcccacgtcagagcctgcacatattcaagttagggaaggttatgcagttggggtcacgttaccgaccctctgagtctcctccggagacagctcctcatgccccgtcctcccacagggttcctgagagcacaagggccagagccagggctcagtgcaccgtgaccgcaggcacctgggtctcgctgggcctgacggcgatggtcactgggtgctcaccgcctgcgagatgtaccccgagggtgtcaggagcactccctggtgatgaccacagccccacgcaatggtgacgctcggcatgcgtgcaagaaaggacacgggctgtgtgggcctctcctgcggcccccacgtgaaatacggggccatgtatgggtcacatgcttcttcatagcataggggtctgggtctttggactctgaggaaccaagaacctcctcacagcctttagagaaaactttcagcacgtgagggaaaaattaggtttaggatattccagtcccatctgtcagggaatcttcagatgtggtcgagattacagtttcacagatgccgtgtgtaagcttgaagccctgtggctgagctctctgtcctcagcgttgtttcgggggtacatgagtgctgcttgtgttaatgaggactttctcttaattttagaaaaccattcaaccaaaatgttgaaccggtcacaaatatgaattgatcacctcctgcgtgggtgaggccgtggcagaaatcatcatgcatgcttcaaagagcccatcctgtgctcgggaagaaggaaaacatctataaaacgtctggtgtgccatttgagcactaaatatcaggcactcagggcccttctggaagactgtggagacagggagaatcagccactctcacagtgctcactcgggagtagggctttgagagggggtagaactcagcactcatgagcgagtggaacatcgttggcaggagagctgcagtccagggagggagtggcctcctcctttctgagggcccatagtggggaccagcagagggcccagccgaggcaccgtagacaggcctggggcctgggctcgagaagacaccagctcctgctccatggtcatccctggaggcggcttccaaggacattttgcatgcagtagagctggacgcaggaagtcactcagctctgctgtgacagggcacaggcttggactagaagatcacagtgggaaccaagaggcagtggtggacatggtgcattttccaagggtttccgcagaatttggtgactagctggatattcctggcataaggaagccaaagggaatatccgtaaggttagaatgctgtttgctcctcagagcaggcgctgattcaagggagaccttgttgagttcaaagtgatgctaagacgtccacatggaatattcagccatggtgttaggatggtaattgtgctgcctcgtaatggcacgacagtccccttcaccaagggcttgcacatggaggagctggccctggctgggagaatgagcaaaaatcccaaggaggaagaccagaggttgggactgaggtatcatgagcagagatgtctgaatcaaaaatacatgtgaggttgaaaggattttgggtgcaaaatccacagcctgggtgtcatatgctgccttgggatgagcctgtggtggagggtgtgtggctgcagtggggacagcaagggaccctgggctacatggtacccagtttcacagcttagatgtcagtgcaggcacctcccagggaccaggaagcaacagtcttagctgccctctcccacctaaattgggtcctcttcgcatttcctgtctgttccagggatttacttcttagaagacatttaaggggtctgttccaggaagagctatctatggctgtcatctgtggacatggggtcagtctgtctgtctttgggaatggaccctggattcctaattcattttgagatggctgtaggcacaataatcagtttctactgcatatggggtcttcagatgaattaaatggtttaaaaagtaaggtattttttcaaaattgtggttgacatagcatttaaaaagctttgaacaattttgataattcctgtctagcaattccctgccagttgtttttatacagagtagttcttaatgactttggtagttttttaaatggttcctgtcaaaagagtttaaaaaatactagtctctttcctctctgctctagattcatacatctcccttggggaccaaagactaaaatctatttcaataacaacttttctttttctctagcaagaatatctgcttgctgttgctgggttcagaggttgatgtgaattttttaggatagcatattacactgtgatgtgtgttttggaaaagcaaagcccaaaaacggaattcctggcaaatggaaacaaaggtcatggtgtgaaggaaaaccgacgtccagtggagtcgacgcctggagccacagcggccttggatgtttgcgtttttaaaaacacaccagtgttttccatgtcgttttcagaaaagcggtgtggcgcgtagacttcgttatgaacttattttaaattatcccttccagggttctcggaccagcagtgaccttcaaagtgagcgccaatgtccaaaacgtgaccactgaggatgtggagaaggccacaggtgaggctgtttccacacacacgtacacgcacacacacgtgtgtgcacacacacacgcacgcaaacacgcacatgcacagccagggcagagagagactcacactacccacatggggcaacccagaggaaggtctcggtttccgtggaaatctggtgtgcagtgaggggacgaggggcagtcacagggcaatgtggctgtccgtgggcaccatctgggatttcactgtgtggagagggactgggctgccctgatgtgtggaactggctcagatagaaggcaggagacacagggctgcaagtgaccgagaacaaatccggcttttggaaaagcaagatttggtgtttgtagtaatcccagtgtgtgcagagcacgtgcaattttgctttgaggtttttcattttgtaccagaccaggagcacacaccggccctgctcccgactgcggtgggcagagacaccacaaagtatctgggaggtttcagtaaaaaccggccgacttccagacggtttcactgtttagagcccagggttctgggcattgcgaatcacacatttttgagatgtacttacagatagagcttgagtaatctttgttatatgattaataattgtcattgagtgaaaaacacaaagctttactctccagagtcttgaagaacagaatgggatggtggacacaatgttgcattttcctcaacctgcctttttttttttttttaaacttgttgaaaactcttgtagagtgtattgtttaatcttcctgcctagtaagaaaaatacaggaagcataacagaaccttagcctgatggttttcagtgcattagggccattccgcaggcagggtgctcccgttccgtatcattgataagacaggacggaacacactgacccagccacagcgggaaatgacacttggttttagccagtcctttatattgctaaatctatgaacttgtttttttttttttttttttttttttttgcttaaatttgtgtctttttttcccagtgtaaaatgcagcaaaatactctggtttatttcgggatttcaatacttagttctcgttgattgaggcgtcactgtactggcaccctgtaaacttgaagtttctttttccagtgagagtaatcaaggtgtgaagtagccaccatgttctaagggatggagcgaattgctggtcctatctgttttggctgctgcgggttttgcttatgggatatcctcgtgccctcagtaactcctttgctcaaggtggtgatttagggggctgagaatttgtggttgaaatacagtgctttgcaaagttgtactaaacttctgcagtctgatttaaggtttgtggagacttgagtccccagtctcactttgttgccatactttgctgtgaggcttgtggagctggggtacaactcggaaaagcagcccagcatcctcactccagctgggcggtccagtgcggtcccagcatgaaaagtcagtgggatccataccaaacactcccacgcaagaggaatggggggtcccaacaacggcttcagtgcctcgtggctgccagagctccctccctccatggcatctgtttcgcttgctctagttccctgtcagaagtgattattggagatatttaagaccaaatccgtgatcaggtattatgcagaaatgcattgataattatcccatgattggcagtttctccagtactggggagcaatgccactggaattaggtttgcaggacctcaaggatgctaggaatggcaatcttgttatatttttaaaaatcataacaatatactcacagacaaggacctttgatttattttatggctctctagagaaaatgaggttgattatttgaaagctagtttctcagtcatttcaaatgtgttcatgttatttatcgaagtgctgcaccaagggggagccacataggaaatgtacatttgagtctcatattgacaactttctaaacacctgaatttgctaacttgcaccagtgcctccatgttaactcctgtggctgtgtgagtcagaatgtttcttgcttcttgaacgtgtgcaaaattgtttacattcatgcatgatttttaaagaattattttgaataattctatggtgtcatgaacgtgcctgatgctatataagaaacagattggccgggtgcagtggctcacacctgtaaacccagcattttaggaggccaaggtgggcgggtcacttgaggttgggagttcaagaccagactgaccaatatggtgaaaccccatctctactaaaaatacaaaaaaattagctgggtgtggtggctcaaacctcagctactcgggaggctgaggtgggagaatcacttaaacccaagaggcagaggttgcagtgagccaagattgcatcactggactccagcctgggccacagagggagaccctgtctcacaaacaaacaaagaaacaaaaaaaacccaagagattataaaaaagaattttgtgactgtgaagatcttgcaggtaggcagtggacatgcccatgtgtggtgactggcccatcggcctcaggagagcgcttagcacggttggtgactggtgactcgcccattggccttgggagagtgcttagcacagtgactggcccatcagcctcgggagagcgcttagcacggtgactggcccattggccttgggagagtgcttagcacggtgaagaggagcctcttactgagtttcaggtgagacgtagacaggctgacatgatagcagggaagaatttcaaattcaaaaggagtttcttatggtttgtgttttaaaagatgatgtggaatcctaatagtgtcatcacaaacgccctgtggtgatgggcggacacctatggaaggacgtgtggtggtgcctgtgttaccaacatacagaactcaagagcctgctgttgaaattactgggagtgctgggtgctgcctgcacctgccacctgccagctgcctggaagcccaatggctgctggcgtctggttccctcaagggcctgaggacctgaggctgctgttattaatgcggggagatcaccctggcggtagaattcaaagggcattcattttgctaattttatacaaaatgatacaaaacctaatgaataggcgtgtagttaatcccacattagtccccatcaaacgtcacgtggtattgatgccgaatgagaagggcagctgctttccattactcagcgtctcctctttatcgtaggcaatgctttcccgggaattctgctaatttatgaccttgggtatgagcacagggtattagtgaatattaaaaataagtgggttttgctcaaggaggcacttactctaccacaaagtacatagaaatgactggtagctacgtttaatctccgtggctcagtcacatagttgaactggcagaagagaaaaatcctttttattcttcatttccttggtagtttcttcttaaatagtatatttctgatcaatttttgtattgctcctttcaaagaaaaggaaattcatcatcctttagaaactgtttgcttttgctggctcccagtctgcagagaccctcacccggtggcctgtggggctgcctgtggtttatgagcttattgccaggaatcccctcccatgctcggccgtttccttcaggccgagttcaggctgtttcttcaaacattccctctcgggcgccacggagggtgtgtctctggcactcagccctgtgtggtgggggtgtggctcatagggggctcctgtgctgaccctgaatggtggggtgaggctcatggggggctcctgtcctgagcagtttccccctttgacctcagcatcctccacctgacagcctctaagacacggcattcagctgccattgtttctttcagcctgttggagaggcgccccgtgtcatttcagtagcggcgcctctgtattcagaggtacggtgactttccgtgacgtcctcctgcttctgcctgttcggcatctttgtgaagctggtgagtgtcagaacagggtcgtgtctgctgtgctgctgtctgtgtttcacgtctcatatgtagcgggtccacatggaggaagaggctcccctcctctcttgtgagcctctcttgaatcccggctcagaactggactctgtgccgatgcctggaccccatagcccgcagcgttctgcgttagtcacaggcctctctgctggagcaagggctgcccaggcttctggcctctcataaagcagacaaacgtgcttattttgaaaagcgtaatggcaaagtgaagtgaattcctttataacacatacttacaatccagccagccttaactatcgaccccaggcaggcatcggtgcttcacagtctggtccgctccgtgcggattctgtcttcggcaatgcatcacaccttcctaaggtgatatcactctggatgtcagtggccctgccctccagaagctccccccaaccccggtgccagggctgttcagacgggagttcttaggggcagtggatggcacatcggggagggcagggcagggcttagatgaggctccacagagaagctggcctttgggcagagcacagggactagcgtgggtctcaggggctgaaggtgagaggaatgagaatggtgcagcctggatgtggggtccagtgtgccaaggacatgccagtaagaggctggcaaggtggaattcagaatcggacttcatagtgtgggaacttcatcttcagcagccactaagaaggacttgggcctgagtttcactgcagctgatggaatcagctccgctgaggtggacacaggcaggttggccccgggggagggggaggggtgccttgctgctgcagcattggtccacaagcggcagacgttcctcatctgactcccatgcaccagctccccagggaggccacgccaggtggagctgcatgctggtcaccagcagtggggcctaaagccatccacgctcccacacacccactccccagggaggccaggccgggtggagctgtgcactggtggggcccgaagcccatccgtgctccggtaccaccctcatgattaagagattggagcaagacaagaggaactcctgagccatgagtgtggaagggaagttgcactcttattagaaatgaaggaggatgctttggaaatgttcaaaacagccacttgctgagaaaattgcctccatgtgcaggtgaatgagacacctgtcagactgatgaaagtgactctccaaggacctgcactctcctcaagggtcttccaggcacagggatcccagcgctccccttcgccagacctccagggtgcagctgagaaacagcgccagagcagtgagactggaggtgtggcctgggcagcccggctccaggttccgctgcacgtgggccgctgtgtcacgtcctccatggagctgagctgctgccaggatcaacgcaggctgggggctcctgggctccagctgtggctggcgtggggctcgtgctcatcctgctgctccgcagccatgaggttgacgatcccacagctcgcctggctgaggtgtcacccagagtgggcgagggagatgctcagagggaagcaccacgctctcctcctgctcttagaacatccctgactcacggcacagacacagacgatgaggagtaactaaaaagaggagcctctaagagaaaaagatgaagaagtggagggcgcggcgtgggaagcgtgggccggtggtgctggtggggtctgcacagtgggccccgcaggctcagtgcccgtctcctgctggacctgctgcgttgggggcggggagggggcctgcagtgtgtgaaccagccccagcttgtgtccagggccacgtgggctggacatggaacaagaactcccacctgcacgggagcgcctcccctgggctgccggagagaccagcagacaggaacattggtaaggactatggcgaggttctgctgccaaagagcaggtgccctgtggctgcagccccaggaggttgtaaacaagtttcggtttggatggaggctttagggaatcggagatggtaggagctgcaccccatgactccattctgaacagccaggtaattacttctggcattttgacaagtgtttgcaggagtggagctcagggctggcagcacccaggacctgtgctgaccttcccggctgcgaggacagaggccacccatggctctgtaattacaagtcccgaaagccgccttcatcatggctttaccctgagcgcagacaacacaacgctgtggtagaaaataattgcatcgccatcgacagggctaccagcgtggaacgccaggagccgcatgtgggggacactcggggatactgctaaaccaagggctaggaaactgcgttgctcagcagccacttttctgtgtttatttttacacagagggggtttatgcactggacataccactcatgggagcagctcgttctcacctgcaaatgaacgagcaatgctgatcctgctggcagagggtgctgccttgtcccctccgactcactgctggggagcacctggcccccctccaactcactgctggggagagcaggttccatttcatcctcactttcacgttcatttagaattcataccctgatcagggagaagagcccccagggcctccagcttcccctccacctcgggagccacgtcggcacgtctactgcgaggggctgactgtcacaggtggccacgggagctcacccctagttggctggggtttgggagcagcctagataaacacccatagaaatgccactaagaccttttcatgccaaaagttgtaaaacccgcttctgaaaaacatgagtgagagttttgaagtgcgtgggattctctgcaggctttcacatgtgcaggaggcttccgtggccagaggacctgttagaaacacagtgaatcaccaccacctccctgcgccttctgttgcctgggaagctgccgagggggtctcagctgttctctccacggaacgcccagcctcccagcagagggatcgtcggcaggaggctgtgatgctggtgcagtcggctgccggggcaggtgaaatccagcagaaggccctgtaccctggatgtgcaggagggggttttgctgacggtgtgacggtcatggagcacactgtgggcgtcgctgagtttcccaagtattactcttccctgcacatgggtttctgtcttcactgccccaggccccgtggggttagagactgacgggaggacggcaggatggctggcggctgtggccaggacacgtatgtcctcctgtggtagccgtcctagcccactggagatgagctgtgctggaggggagtcccaggggagccgcgtctgctggtgaagatgccgctgggctgtgggcctgggggacgaggcctcaggttttgctggaggagcctgctgtccacttggctctctgttttgctgtgttgaagccctggtccttccatgatgcgaggctgccatgcctgttttcacagccttttcttttcctctttgtccataagcgaatgctgtttccactctttccctcacctctgaatagaaagggcagtgtcttcataccttagtaggaagcggcctcatctccgcatagaaagggtagtgtctttataccttagtaggaagcggcctcatctccgcatagaaagggcagtgtcttcataccttagtaggaagcggcttcatctccgcatagaaagggtagtgtctttataccggagcagaaagtggctcattttaaatcagggctgtgttctgcagggcagctgggcagggcatagctttgagacctgaaggaggaaagcaaggggtgcccgaggaaggtgcacttggagcctgcagggagaggccagtgcggccctgaagccaacgcatgggcccacaccctcccccgggcacctggagacacaacttccagccagcacacaggtgcccaccatgctccttcctcctgcagccgcggctcacaggctgtctctgagctgaggggaggccgatgtctgccagaagccacttcttgggagttcttctaccaatatcagttcccatggcaactcgacagaagcagtaggggcagaggagccgagatggttctgagtgcaaagatggtgctgagtgcaaaggtggtgctgagtgcaaaggtgatggagagtgcaaagatggtgctgggcacctacctccccagcagatcctgcctcagctacagccgagccactgccctctgtccctggtggtcggcccaggagtcctgccctgtagctgcaccaggtcacaagcctgggccatcttgggcagggcagagggtttctcctgctctgccatacctatgggccccttgggacaagctcaggtcttgagacatgaattgtccaaatattatgacttttgagagactctgaagggctcaattatttaaaaaattatgttccgccagcccgttggcatctgaaactctcccttgttgtctccttgtgctttggggaccctacagggctacacagcagctggagtgtgtggcacaaaccccttggcagttggtgtcccctgtgagtgcacagttgatcagactaacacagagtcaccttggtgagcccaggaaagttcctcctgacaccaggactccggagaagcagctcttggttggaaggcaggggaggttcagtgaagtccgagagctgcctgggatgggtagggaggggtccctgagcacttgggaccagcatgaggctattcagcacttgggaaacaattgctcagaagcttgtctgctggggacgcttgtcacaggcaggtcttacctggtcaacacctgcccaaggcccctgggctctcaggccttgcatctgattctttgcacttttcctcccagcacgggaatgccaaagctctgaaggcccattcttgaaaatttacatgatgattcacacggcaaggctggcatctgagtcccctggccctgtaatcgttcttaataaggagggcactgcacaccatcaggcctcggacttatcggccaggacagcattctacgtatttgcattattggacaagagtccttgggtgaggatgagtgggttaaatgcacgctggtcagcagaaccaaaaggttcaactgaatggcatttagatcctacatgagcacctccaccaccatgagcacctccatactacgagcacctccaccaccacgagcacctccaccaccacgggaacctccaccaccacgagcacctccaccatgagcacctccatacgacgagcacctccaccaccacgagcacctccaccacgggcacctccatacgacgagcacctccaccaggagcacctccaccaccaggagcacctccaccacaagcacctccaccaggagcacctccaccatgagcacctccatatgacgagcacctccaccaccacgagcacctccaccacgggcacctccatacgacgagcacctccaccaggagcacctccaccaccacaagcacctccatcaccacgagcacctccaccatgagcacctccaccaccacgagcacctccaccaccaggagcacctccaccacaagcacctccaccaggagcacctccaccaccacgagcacctccatcaccacgagcatctccaccaccacgagcacctccaccacgagcacctccaccaggagcacctccaccaggagcacctccaccaggagcacctccaccaccaggagcacctccatcatcacgagcatctccaccaccacgagcatctccaccaggagcacctgcaccatgagaacctccaccaccacgagcacctcaaccacgagcacctccaccaccacgagcacctccaccaccaggagcaactccaccacgagcacctccaccacgagcacctccaccaccatgagcacctccaccaccacgagcacctccaccaccatgggcacctccactaccatgggcacctccaccacgagcacctccaccaccacgggcacctccaccaccacgggcacctccatactacgagcacctccaccaccacgggcacctccaccaccacgagcacctccaccaccatgagcacctccatactaagagcacctccaccacgagcacctccaccaccacgagcacctccaccaccacgggcacctccaccaccacgagcacctccaccaccacgggcacctccaccaccacgagcacctccaccaccatgagcacctccatactaagagcacctccaccacgagcacctccaccaccatgagcacctccaccaccacgggcacctccaccgtgagcacctccaccaccacgggcacctccaccaccaggagcacctccagcaccatgggcacctccactaccatgggcacctccaccaccatgggcaccaccaccaccacgggcacctccataccaccatgggcacctccaccaccacgggcaccttcaccaccacgggcacctccaccaccacgggcacctccaccatgagcacctccaccaccacgggcacctccaccaccacgggcacctccacaccacaggcacctccgccaccaggggcacctccgccaccacgggcacctccaccaccaggagcacctccaccaccatgggcacctccaccaccaggggcacctccaccaccaggagcacctccaccacaggcacctccaccaccacgggcacctccaccaccaccatgggcacctccaccaccaggagcacctccaccaccaggagcacctccaccaccacgggcacctccaccaccaggagcacctccaccaccacgggcacctccaccaccacgggcacctccaccaccacgagcaccaccaccacgagcacgtccaccaccacgagcacctccaccaccacgggcacctccaccaccaggggcacctccaccaccacgggcacctccacaccacgagcacctccaccaccaggagcacctccaccaccacgagcacctccaccatgagcacctccatcaccatgagcacctctacagcagttggctgcttacctactgaagctgagggcaatggagcctccttactctaggtcagtccctgcttttggatgtctgctgtgttggccatagtgcagtgccccatggattaggcaccaatctaggtcaggtatcagcctctccagccctgcctggatgttctgtgccacttcatggcacctgaggttggcaaaatggaagaaggaaaaacaagagcttggagtttagaacttgagttcacagcaccctcccagctatttgcttgttttgtgactttggacgactcattgactgttttcaaacctcagggtgccttctctgtcagctagggccaatagttacactccgcgaggctgcattcagatcaaatgaagtgggaataatttgatgtgagagcaaaatgtaaagtctgagcagtttataagttgttggttgccattgctcactcaagatgtccattggccttgcgtgcctgggcatcccacgaatgcctggagtgggaaagatgccatggcaaatcctcatgaagtactctcttttcagtagtgttctttacttggctacaagcagacagtaagatgtcatggggttagaagaatagcaacaattgtgggtaaagaatggaggaggtggggcgtggtggccatgcctgtcatcccagcactttgggggttaagaatggaggaggtggggcgtggcggccgagcctgtcatctcagcactttggggggtaaagaatggagaaggtgggggtgtggtggccatgcctgtcatcccagcactttgggaggccaaggcaggagcatcacttaccaggagtttgagaccaggctgggcaacatagtgagaccccatctccacaaaaatatttaaaaatttagccaagcgtggtgatgtacctgtaagtcccacacaggaggttgaggtgggaggatctcttgagcccaggagttccaggctgcagtgatctgtcacaaccatggtcacaaccatgccactgcccctgagcttgggtgatagagcgtgaccctatctctaaaaattttgtttaaaaagaatgggagaggatcttgagctgataagacccaccgtgtcaggcactaagacatcttcttgcagtgctgctcactcctccctggactgtcttcagtgtcaagatgaggccgcttcactaacgagatgcgatgattcgtatgatgcaaagcccacggcttacagagagcacgtgaagatggtgtcggcagcagggttatcacatcctctggcaggcagcttgggaagggaagtttcaatctgtgttgatattttagcactgattaaaggtggatgtacaattagaccttttaaatttaaagacagtttgcactctatcaacaccttgtcttattacagttgtaatccatgagaaagcaagttaagaatgagaagtcatgggcaaaagtaattacacaatttcctcatgtggtataaaatggtacaaattgaaaatcccatcagcttcacagcccttgaccgaccaaaatgacatcccccaatgaatgctggtggcaggagcttaaggtgcttcctgcttagagagatctgcatttctgtttagaatgaagcaggtgtagataccttagttcacagtgatgatttgggctgagtgctcacattcaataggcacccggttccagtggtttgcggggtttgatgatgcatttttaaagtgaagccgtaccaatgcaggcccatgcttccctgaggacgcggcctccgttctgctgagtgcaaaggtggtgccgagtgcaaaggtggtgctgggcacccacctcctcagcagctcctgccccagctgcagtccagccactgcactgggtccctaatggtcctggcgtgggagctgtggcctgggcctcctgtgcactgcaccgtaccctcggctgccatgagcacgggcaccccacggggacagcaagctcagcacccagtgggcctgatcagacagccacctgcgtcgtttcatggctttctccttcatgttgaaggagtgacagggacactgagggatgaagtccccacgctctggcctgctctgctcagtcagggccgctggcatgggccgttcttcccctgggactgcacagcctggacccccaccaagtcctgttgcccaccctggctcagctctcctccagcccagcatgcctgccttcctccctcctttccccatacccggtcctgccatctcccagctgcaaggtccatgccaccccacaggaagagcctcagcggctgtcctcagaccccaccctgtctgccccgaccctgccgcctcaccaaattctaagcacaccatgacccggcctgccctggtgtgctgcccatggcccggcgtgacccagtgtgctgcccatggcccagcgtgacccagtgtgctgcccacggcccagcctgacccgacccggtgtgctgcccgcggcccggcctgacccggtgtgctgctctgggaaggaagcctggtgggaacagtgctcactcactcactctgtcactcgctcactccttcacgccttgtctctggcagctttcgccacaggcagagctgcgtggtcacggtggactgcccgacccacaaagcctccgacactcactctccagcccgttacagaaaccttttctcaagattgtagaacagcagttctgcaaacggggcccctgagcaccagctggaggtcgttaaaaacgcagactcttgggccccaccccagaggttcagaacatgtcctggaggcaaggccagcaagccattgggagcagcccccagggacctcaatggcactggagccgagtaccactcacagctgcagtccaagagctcctgaagacaaacccctgccccctgccagctgggagctcctccacagtagacactcagcaaatgcctgctggccggagcagcggcagggaaggtagacgactgcaaggcattggaaacggcccctctgcatcaggagacaccctgggtgcaggaggaggcttcgctgaaaagcattgcaacagcattatcacatacgtggaaataagaattgcatctcaacccttcccttgccctccacccatctaacatgcctcagccctcctgtggccatagtaacctgaacagtaactacagcagcaggctgcttaggtgccaggtgtaagaagagaaatttcatgaaaacaggaaaatatagcctgcttttctccccagctctaacctttcaacctataactactccctactgtaatttttgtgggatttgctgatattgaaggaagatgattgaaaatctgcttaagatttcgtctttatttcccgcttgacaggcctagggccccactgaggaagtgtttctctctgcagagccctcagccaccccatatgtcccagggatgtgctcaagtcacgaggaccagtcctttgtgtcacatcctgaggtccagagtcacctgccagccttgccgtctgcttggcattattaattttcccataaagtatacaatctgggtaaggatgtattcgtaagggacttcaccaggtgagagtcaccacaactcaggtgtcaggtgtgtgttttctaaagccgatcttagcgttaacgttctcctgtagggaaaactactttctgtctctctacagtgcctggttttggaatttctccacggtgttttgtaaatgtcttgtgacaccagctgaaaaggctgtgttcctttgagcactcagagcccttccatactgaggagttgggaggtggttgaaggaaaggaagcagcacagcttagagcacattctgtggcaaaactgccagagagagcctggggtagccatgctgcaggtcagtgtgcctgtcggccctggccctgagcctggcagcccatatttagagcctcatttcatcctggagccagaagggtggctgtttgcagagaaggccttgaatggaggggactcatccacctcatggaaggtgccatcccaggctggtggttgggaacggagagggaggcagagggggcacaccatcttgctgacggagtcttattttttgtgatgcctccgagcctcaagacccccaagctcacagccattccttgctagagaaacaaagcagcatattatgtgattttcagaggaaataaatggaaacatacaacgtcatgtcagagggacgtgggacacataggtaaactgaggcatggaaagaaagcccgtccctgtgtgaggttagagagccagggcaggatctttccctgaacgaaactctttgcatgcattcctgcccatccacctcttcccttttaaaaacattttcttcaagaattgaatggccacataatttcttattctaaaataagacagaaagacagtgccattcccatgctctggggtaatttccattttaaatacgcaatttctcctcttttaatagaagtcagatttcttttatctgtaattaaatccagaatatggttttttttaaggtcctcgtggagttttgactttactgttctgaaaatgaataagagttctgagcgtcagtttagtgaacaactcaactcattatccgctggttgtgaaatacaaaaccttggtctgacccgtgggggccgtgtggtggtggcagcccctgccctccccccgggtctgatggctccatctgccccgccagccactgtctttctggccgcagcccgttagcccagggccctttcagcactgacctgagacttggctctgacttggtcagatgaccatgtgaacacagctgcttctggaggcccatattccgcaaaccatgcccctgctcactgcaggattctgcacgttgcattttggagtaagtcttcggtagaccttacaggactcccccatgatcttatgtccttggttttcatgaagggtgcgaggtaagaaactcattgagaaaactcacctgaagctgctgaggaggctccgccaagtctctcagccaggacacgcctgagtgcatcttggggcccatgaccaggagagacgttggtgttcctggtgaactgcatggttcctgccaccagacagtcagagccactgccatgtcaggcgtttctctcgtcccgagtcggcaatctcactcccagattttgtgctcacctgcttagcttctctcacccagaagtatgccagattacagtcaattaccagatgcgcagcaccatctttctgcctttcttcccctggattacttgtttctcagccttggtctttattaagctgagtgtttatgcctgcgctgcctgcagcccctttggaagcaggtgaagcatccatcatccataaaattggccactctgtgccccatccccaggaggccctggcactcctttccccagggacacccgacagcccagcagtcatcacagagccacgctgtgacttggaggagaatggggttgagccaggagtcagttctgttgcggggagggtgaccctttctcttccctcccctgcaagtagaaaatgtcccccccaccagtcagcttctggaaatcactggcacagggggggctttggtgagtgggagatgacagaggccctgaggagaagaaaaaggagcatctggggaggaaggagtccttggcgtccctcagacacagtgtgtagatggctctctttttagcagccagattccaggaaacagctggacaggaaaccatggggcagtgtccggcgtgaccagtgtgtccaagcaacctcacagcgctgggctccccaggctcccccggctcccccatggctgtgaccccagtctctggccccacagctccctcatgcacctcccatgctctcccgggggctgtggctgtcctgggcatctcgtcttggtcgtctgggtaacaggtcctgagagacgtccccaggagaatgctgtgcatgtcccgggctctccagctgcttctgagccctggacttggacacccagcacatgttcaggttgccagagtcaatgcggttaaaccccaacttgctcgggatgcctgtttgttagatgaactatgtggaattcaccccaggtttctctgtcctcgtatgtgggaaggtttgtacttagaggctgagacctcgtcgcctctagcagcaggcacaggcccctgcatggccacattctgctgagatggtccctgctggtggaattgtggtatctcactgagcatgtgtgttgtcttgctgtatgagcccgtgtctcactgtgtgtgtgagtgattgtatgtagtgtgtgtctctcactgagtgtgtctcactttctgagcacatacatatgtgtgtaagtgtgtagaatggtcattagctaattggtattaggttttgtcgtggttgccttctggaaactctgtagggcaccccattccctgacctgctgtgtccagaatgggtgggttcttggtctcactgacttcaagaataaagccacggacccttgcagtgagtgttacagttcttaaaggcggtgtgtcccgagtttgttccttctaatgtttggatgtattcagattttcttctttctggtgggttcgtggtctcgctggcctcaggagtgaagctgcagaccttcatggtgagtgttacagctcataaaggcagtgcagacccaaagagtgagcagcagcaagatttactgcaaagagcagaagaacaaagcttccacaatgtgaaaggggacccaagtgggttgccactgctggctcgggcagcctgcttttttccccttatctggccccacccacatcctgctgattggtctattttacagagagctgattggtctgttttacagagagctgattggtcttttttgacagggtgctgattggtgcatttacaatccctgagctagacactgagtgctgattggtgtatttataaaccttgagctagacacagagtgctgattggtgtgtttacaaaccattagctagacacaagagtgctgattggtgtatttacagtcccttagctagacataaatgttctccaagtccccatcagattagctaaatacagagcactaaatgttgtatttacaaaccttgagctagacacagagtgctgattggtgtatttacaaaccttagctagacacagagtgctgattggagtatttacaaccccttagctagagataaatgttctccaagtcctcactagactcaggagcccaactggcttcacctagtggatcctgcaccagggccgcaggcggagctgcctgccagtcgtgcaccgtgagcccacactcctcagcctttgggcggtcaatgggactgggcgccgcggagcagggggcggcgcttgtcggggaggctcaggccgcacaggagcccatggcgaaggggaggctcaggcatggtgggctgcagatcccgcgccctgccccatggggaggcagctgaggcccagcaagaatttgagcgcagtgctggtgggctggcactgctgggggaaccggcacaccctccgcagctgctggcctgggtgctaagcccctcactgcctggggccagcagcgctggctggcagctccgagtgtggggcctgccgagcccacgcccacccagaactcgtgctggcccgtgagcaccacgcacagccccagttcctgcctgtgcctctccctccacacctccccacaagcagagggagccggctcaggccttggccagcccagagaggggctcccatggtgcagcagtgagctgaagggctcctcaagcagggccagagtgggcgccaaggccaaggaggtgctgagagtgagcgagggctgcaagggctgccagcacgccatcacctttcactgccactgacagtacctgggaaactgcagagccccacacacatgtgcactgactgtaacagcaggaatacagccagcacctgcagccctggctggtgtccacaggactgagtttcagtcccatagccttgacttacctgtgatgttggacacgttggtctcctccagccttgttttctccatctgtgaactgggccaacgctcctctgctgtgagctgatgcgaagccacctcagataacctctgtgctcagtgctctgtgccatggccgtcgcccgtcgctttactgaggctattgcagaagtcagcgtgggctctgggcttccgcaccaaggtgcgagatgctcaccccgtggaatgaggttgctctgacagcaggaccatggccgtgctcatgcccagctccgccttcgtgggacaccacgcatgggcactccctctggttggggaaaaactgtcatactggattgtgttccttttttgccttaaattattagctgccatttttgctcatcaaaaaagtggcattaggcacttccacatggatcgaagggccctgtcactagtgggttcctgctcagagcgtcttgtgtgatgtttcatcttgatgctttgacaggttaacaaccttctcatcaggatcattgttaggtccttcaggtgtggtcctggggaccggtgatgaaggacacccccattgcatctcagctacggctcttggaccatgggcagcggtgctgaaatgacaatcctggagccacagccttcctccgtccacagccagtgtgctcacggacgacacaagtaattgtggacaccactttgccaccacgactgtttatgctgcagccccaggggccacagcagcagctggtctctcctcaatgatggttcagcgccgagtgcattggcggcacggtccatttctctgccgagcgcttgtgttgtgcctggggtctgagccacagcggcaggtggatgggagagattccctcggaacaggtgtctggagcaggtgggttgcggggccactgtcaagcacgtggggactgtgcctgtggcttcatccctgcgtggactcagtcctccccttgttttaagtggtccctgggtcctttgtgcacatcagtaattgcagaggcgggacgcgcactctctgagcggagcagcttggctgggcttgtccctttaatttgcgatgcatcacaacaaatgattgtaatcagtcaccgcccgacggcggcctgctcttccatgaccacccttcagtgagccggcagctgagcgacacggacaaagccgcctggctcagggttggggaaaacactctttagtcagtagagttaaaccacctgatttattccatattgtggaaggtcagtctgatttaaggaaatgtcagtttgatagaatgttttgaaagaaatgcagctcataaatactgcgctgaaagctcagccttgatacaagctcacttggtaaaataacttaataaaggaaactttcgattcaaacaaaaagccttgaaaggtccttcttcatccctccaggccatccttcttagcaaggcctacatggtctctttccatgccattcatcgctttgcaaaaccttcccatattcataaataggcaaaggtaatgaatgcaatgtctctagcaggctgcctggtgtgcagtggacactctgtcaaccatttctgggtgacacctgctgtggggataatgagacctccagaaagttatggtcaaaacctaacccctgctacctgtggatttggccttatttggaaataggatctttgcagatgtcaataagaggaggtcagactccatgagggtgggtcccaatccaacatgactgtgtccttagcagaagaggggatcacctcgtgaaggtacagacacagagagcggccatgcgcagacagagacggagaggtgccgccacagccgtgggagctggggagaaagcaggttacacacacacggcgagacagtgagacctgtgatggcggccgctgggggctgcatgggagatgggggagtttctaccctgcactgatgtgtcaccgtgtgcagatggagcgtggctgcagtgatgtgtcactgtgtgcagatggagtgtggctgcagtgatgtgtcaccgtgtgcagatggagtgtggctgcagtgatgtgtcaccgtgtgcagatggagtgtggctgcagtgatgtgtcaccatgtgcagatggagtgtggctgcagtgatgtgtcaccgtgtgcagatggagtgtggctgcagtgatgtgtcaccgtgggcagatggagtgtggctgcagtgatgtgtcaccgtgtgcagatggagtgtggctgcagtgatgtgtcaccgtgtgcagatggagtgtggctgcagtgatgtctcaccgtgtgcagatggagtgtggctgcagtgatgtgtcaccgtgtgcagatggagtgtggctgcagtgatgtctcaccgtgtgcagatggagtgtggctgcagtgatgtctcaccgtgggcagatggagtgtggctgcagtgatgtctcaccgtgtgcagatggagtgtggctgcagtgatgtctcaccgtgggcagatggagtgtggctgcagtgatgcgtcaccgtgggcagatggagtgtggctgcagtgatgcgtcaccgtgggcagatggagtgtggctgcagtgatgcgtcaccgtgtgcagatggagtgtggctgcagtgatgcgtcaccgtgggcagatggagtgtggctgcagtgatgtgtcaccgtgtgcagatggagtgtggctgcagtgatgtgtcaccgtgggcagatggagtgtggctgcagtgatgtgtcactgcagatggagtgtggctgcagtgatgtgtcactgtgtgcagatggagtgtggctgcagtgatgtgtcactgtgtgcagatggagtgtggctgcagtgatgtctcaccgtgggcagatggagtgtggctgcagtgatgtgtcaccgtgggcagatggagtgtggctgcagtgatgcgtcaccgtgtgcagatggagtgtggctgcagtgatgcgtcactgtgtgcagatggagtgtggctgcagtgatgtgtcactgtgtgcagatggagtgtggctgcagtggtgtctcactgtgggcagatggagtgtggctgcagtgatgtctcactgtgggcagatggagtgtggctgcagtgatgtgtcaccgtgtgcagatggagtgtggctgcagtgatgtctcaccgtgggcagatggagtgtggctgcagtggtgtctcactgtgggcagatggagtgtggctgcagtgatgtgtcaccgtgggcagatggagtgtggctgcagtggtgtctcactgtgggcagatggagtgtggctgcagtgatgtctcactgtgggcagatggagtgtggctgcagtgatgtgtcaccgtgtgcagatggagtgtggctgcagtgatgtctcactgtgggcagatggagtgtggctgcagtggtgtctcactgtgggcagatggagtgtggctgcagtgatgtctcaccgtgtgcagatggagtgtggctgcagtgatgcgtcactgtgtgcagatggagtgtggctgcagtgatgtctcaccgtgggcagatggagtgtggctgtagtgatgtctcaccgtgggcagatggagcgtggctgcagtgatgtgtcaccgtgggcagatggagtgtggctgcagtgatgtctcaccgtgggcagatggagcgtggctgcagtgatgtgtcaccgtgggcagatggagtgtggctgcagtgatgtctcaccgtgggcagatggagtgtggctgcagtgatgtctcaccgtgtgcagatggagtgtggctgcagtgatgtctcaccgtgtgcagatggagtgtggctgcagtgatgcgtcactgtgtgcagatggagtgtggctgcagtgatgtctcaccgtgggcagatggagtgtggctgcagtgatgtctcaccgtgggcagatggagtgtggctgcagtgatgtgtcaccgtgggcagatggagcgtggctgtagtgatgtctcaccgtgggcagatggagtgtggctgcagtgatgtctcaccgtgggcagatggggcgtggctgcagtgatgtgtcaccgtgggcagatggagtgtggctgcagtgatgtctcaccgtgggcagatggagtgtggctacagtgatgtctcaccgtgggcagatggagtgtggctgcagtgatgcgtcaccgtgcgcagatggagtgtagtgattctactgcagtaagtggctagattttcatggaagaaaagaaaactcttctttatgcagatttacttacaatagatcattgtacttatttatttctagataattatttgtaaagcctgcaactaaggaagcattctgtatatgggttgtgaggagggaaactttcccattaaacagattagcaggaaacaaggaaaaaaagataatgtcgtattcgtagacctgaggactttaactccttcacggcccgtgttccttgggaagcttttgctgtgtgtctttccaggtgtggtctggctgccgttgtggaccttgtgcacatgaacatggcagatgggggcagatgaggggtcccaagcagccacgctgaggagctttggggagtggcggggatgctgaggctgggttcttggagactttgctgtggtccttttcctcatgaggaagtggggcctgggctctctggggtcctccatgcacccacttccctttgctcaggaggggagggcagctggccgtctgcctcacccactccaggccacagtgccacagcgttacgtgtgtttcccaaacacagactaggaaagaatccagaactctgttgtggggccagcaggtgagactgcagaggctattcctcgggtgtacctgctcggtctgtgactgactgtgttatggaatccaaatgcttgtcctgaaaaagagaccatcatcattgggctttgctgcctgtaacgtggaagttcatctcaaatcctgtttttccccaagtttgacgattctagcagaacagtcatgggaggctgtcaggagattcagtttcctgtgggcacagcagaagagcaaagtttctggttcattctgtggttgccgagaggcagatgtgctgggcaggtgtcaataggaaaaagcaaaaaggagggaaaggtgggttaagggtcatttctgtatttatcataaaatagaattgcagaggattgatgatagatgctcccgcgtccacaggtgctgagcggaatcgggagctgggcagcgtccccgagttgccaataaccacagagggcgtgaccttggggtcgctgggtgggtctagtgcatcttttgtttttgtttgtgaattttaaaagcttgatggacacatccgaggtggctgatcatcggataagggcgacattgtgagcctggaatgccacgagtggagcacgcgtcccgatgtgggtggcacagctgcacctgcttccaccatgctggatggccactcaccgtcccctgacctgggatgatgcgtgggacttaatgtgcagcttctgtaaggactccaagggggtcaatgagaggcactgccagggagagccactgtcctgctgtgttgattgtaggcactgaacaagaatcactcaaaagcattggcaaaatgtagctataagaaataggcctcactggacgctggagaagcagcagcaggagtccagcacactcctgctccagcagctgaccgagctttgtggagaacgggtctgctgtggctggtgacgggatgcacacgaaaacatcccatcgtcaaaccgagcaccctttcaggggcttctcctgcccatcctaaacccaggcacatgtggaagtattttgttctgttgaaaaatgcacacaaaagtgatttttacaaatgtgtttttcccaacactttcccctgggctcatgggaggacggagagagcacccactgtttgagcaccaaatccagtgcctgccgcccccatggggacagagaacaagccaggtgtgcccccctgctcccggcctctgtgtggatgaggccccggggagtgcctggtggccatgctgtgatggctcagggcatccattaaggagatctgaccttgtctggggcagggtaacactccttggcagaggtgacctttcaggcgagattagcaggacctgcgggagttaccaaggccaatacgaaggcaggaggagcttccaggtggagggagtgtgtgggagaaggtctgcattagagcagagcaagagcctccgaagattccagactgaaaaaagcagcaagaaccagacagagaggaaggggcctcggcccggactccacccacaggcagtggggtctggaacagggccccgttagaagtgtcgctctgtgtagggtccagccccacagggtcagtgggtttttctccccgtgtgtggagacgagagatcatagaaataaagacacaagacaaaaagataaaagagctgggccctggggacaactaccaccaagtcacggagaccagtagtagcccggaatgccaggctgcgctgatatttattggatacaaaacaaaggggcagggtaaggagtgtgagccatctccagtgataggtaaggtcacatgggttacgtgtccactggacagggggcccttccctgtttggcagccgaggcagaggagagaggagacagcttacgccattatttctgcatatcagacttttagtactttcacaaatttgctactgctatctaaaacacagagccaggtgtacaggatggaacatgaaggcggactaggagcgtgaccactgaagcacagcatcacagggagacggttaggcctccggataactgcgggtgggcctgactccacaagaggtggaggagtggagtcttctctaaactcccccagggaaagggagactccctttcctggtctgctaagtagcgggtgtttttccttggcactgacgctaccgcttgaccacggtccgcttggcaacgggcatcttcccagacactggcgttaccgctagaccaaggagccctctggtggccctgtctgggcataacagaaggctcacacccttgtcttctggtcacttctcactgtgtcccctcagctactatctctgtatggcctggtttttcctaggttatgattatagagcaaagactatgataatattggaataaagagtaattgctacaaactaatgatgaatgatattcatatataatcatatctatgatctagatctagtataactattcttattttacatattttattacactggaacagttcgtgccctcagtctcttgcctcggcacctgggtggcttaccgcccacagctctgaccacagtgaaggggacggctgggcagagcacgaaggatggggagcaggcaggggccacctggcctgaccttgggcactggcgtgcgggctgcagtctgcaggtgtcttggaggtgccagcagtgggatttggtgatggattggacagaggggaagatacaggaattaatggtgcccgcgcccccaggcacatcagctgcaatcatggaaggcagggctgacggtgctacggggcacactatgggcaggacttggtttggggtaggtggaggctctggtgcctgggagcagccgtgtagaggtgtgggatgggcagagaggtgcatgcacccccattactgggcccgccaaagggcctctcctggttgccagattctggagaggaggctgcacctgcgagacctcacccatgggccacctgaaggtgttctgacgtgttcgttgcatgaataatcaaccgcagaaaataatctcacggcatgtttcatagactcgactcacagacaaaaacagccggtaaatgtgtgtttttccttcgtgtcttcctctcttgctctgtcccccatcccacacagcagtctttttgagtgtctgcagaaagggtgtggcctttctttcctgaggagtgtcctgtccccaaccctgtcccactttgggacttcagcagttttcttcttggtctcaggacaagcacacagtcgaatcggcccacgcatgggaaaatttcggagagctgtgttcacatcacactccacaggcacattcctacttcacacaggccctaatcagaatagtaacttttagccgaaacctgtgtgtcagtgacttctctctagggcccccatgctctctagggtctctgcatctctggggtctctccgtctctggagtctctgcatcactggggtctctccatctctaggatctctgcatctctggggtctctgcatctctggagtctctgcgtctctagggtctctgcatctctggggtctctgcgtctctagggtctctgcatctctggggtctctgcatctctggagtctctgcgtctctggagtctctgcatctctggggtctctgcatctctggggtctctgcatctctggggtctctgcgtctctggagtctctgcgtctctggggtctctgcatctctggggtctctgcctctctggagtctctgcgtctctggagtctctgcatttctggggtctctgcgtctctggagtctctgcatctctagggtctctgcatctctggggtctctgcatctctggggtctctgcatcttccgcagcggctgtcccacagcttatttacaagcagcttcgggcaaatgcctgccatgtttaaatacatctccttttaccacattaaacctattgaacctctttacgtgtgtttataaaacacaccaggaaaatgtttctttccattttgtcataccattcgttcctcttcagaatttcccataatatcagaagctaaagctggttctgaattcttttcttttctgtcttcgctgttttccccttttctgtgatctttagctacacgttaattaaacagtcagagccacatcggagttcgctgtgctgtgagaggatgctgggcccttccagtggtgcctgcaggccctcctttctcatccagctcatgtttctccctcagtcactatggctcatctgctccagttgtgagattttcctacagtgtcagtcatttttaaagcgccttttagttcccagctgcagatggcccaaccatgaaggcacactcagaaattcccaggtaagcctgtgtctccccagccataaaaattcctctaggttagtttatgaaaatcacttttattgacatgacttgaaattgaaaaaaaatcccctcccaggactgagagagactgtgcttctgggggttgtgcccactgggtgcttgggaagcagacgccagggtgggatcgatgggggccagcctgggcagggagaaggcggcagagcctcagaccccagcaggagcccccgaggtgcagttcgcagaagggcggcactggccagggagggctgtccctgtagcccagggagctttgtcctaggctggggacagcctgggtggagcctggcctcgagggaacgtggtggaccccgagtggctgggaactgtggccaggtgtctccaaaagatccaaagggcacccctccacagccccctcgaggcaaagcagtggctgcacccctctaccctctccaggaggtccaaagggcacccctccacggcccccacgagacaaagcagtggccgcccccctctaccctctccaggaggtccgaagggcacccctccatggcccccacgaggcaaattagtggccgcacccctctaccctctccaggaggtccgaagggcgcccctccacggcccccacgaggcaaagcagcggccgcacccctctaccatccatgcggcggagactcagggcttccccaggaggctgggtgcctttggtgctgatgctcttggtggccaaaccacacttaattttatttcattattttaagaacttcccccaataacccacagaaccagtagtcactgcttctagaggaatctaattaaggctttctctctgtctttaactttcgcaatccaattttcatacctgggtttcttcactcccttctaagaggaagtcggaaaccaatcaacaaatgaatagaacatcaaaggcgatcacttatgatggagaatgcataataaacattagcacgtttcacaaaaacatttcctcccgtagaagtcattgccatattaatttaatcctgctgtctaagataatataatctctttgaaacagtcttgactttagtgcacagggacttttctggatcagaggcgcaatttccatcgcctggtgagctaattggatgtggcagcctcctatgcagatggggactctcttgtcaatggcctcccttcagagacaaagagagacaaatgtctatattcattccctcccctcatgcatgagtaacactaccttttccctcttcctcgctctctaccaggtagtcaccgcacatttaaatcttagcttttgtgtttcgagctggccaagcctgcaaagctgtttacagatgcctggcagccgggcctacttgtttaagtacagtgtgtattttgacatgtaaatttacatgaggcatatttaatcagtcacagtgatatgctaattggattcatctgtgaactgaataaaaaacacatctaaaaaaaatgaagtgaacatattaccagctgagacactttgtaatcagtgctgaacgtcaccaaaaggggaaaagatgaaggtggcgggcgctcgccgggggagcacgacatggatgtaattcagttagccacttttccagcttcctgagacagacagacagacagacacagctactgcaaaaggcctgcttttgtcctccttggtgctaatcagccaggaaccttggtgcacctgacacagggagggtatgtgaggcctttgcagctgctggcagacagacttgggagggacccaggctggggccagcagctccttgggagtcttgggaagttctgatgtttgaggggagggctgtgcttcctgtcctttaatgtccccacagtcccataatagcctaagaactgggttacatctggaacggagatcaggcagtttcctctctctgcactgtgccgtctcccctcagcaagctggtccagagctgggctggtccacaaagtgacactgctgagagctggctgacactgctctgtgctggatggggcccttggggacaacatagtgccctccagacccccaacagatgccccctgcagatgccccccatgggcactgctagcatctgtggcttctcagatgtacacaccacatctctgcatttcatcttttgggcagagactggcaaaggaagaagaaatccccggggtggctccaccgccatggcgtgcccctgggtgaccttccactccaggtggctgttgtctcagtgctcctcactcctgccgtggggagagcacttccagcgggaggggcaagcatccctgagtgcagccagaacccagacggggctgctgaggcctctgagctttcagtgcctctttgcataaagaggtgtgcacagaggaaggaacaggacttattttcttggtaggcaggtacttgaggagatggagactggcatggaagagtcgtgtgggggacagaatggtgtgggaacctggcctggcctgagtcttctgcagagaaggaggccttccctacccaccctagcacagagctcagcgtgacgggggagagcggggcccgagctgtgctcctggcacctgggagggtgtgcagctgagggaagccgggaggctgtgggatgcaagctgggtggctcctgcatcttggggaagctcagagagaaccagaggactgtctggatgcccgaaagacttctaagaacagcaggaggagtttccagagggagttggcttgaggctctgcagatgggagtcagtaaaaggcattgaggttgctgtgactttgttgtcactggtaaatctggaggacactgagccaaagaaatgtgaaggaaaattgcacccaagatattttcaaattgtagcttagtagaattatgaattaagtttttcattgattctaacagaaggtaaaaatataagcatgatcactttagaacatgaataatctacaaaaggctgcattccctgaatattttcactctttttaaagtaattctaataacagtgttttaaacagtaacctttctgaggccacttcaaaagcattctgactttgatgtaccttttcaggaacacgcttgttatataaatcacaatgtgcccattaccctacatgtattttatttctttcctaataaaatgggggtcactagcagtgaattaatgtgtgcctgcatcattccctgcccctttcaactccttcaggaaccaaaggtaatagctacattgcaacaaataagaactgagcaccacatttctatcaggttgcatttttttttttgagatggaatcttgctgtgttgcccaggttggagtaaaatggtgcgatcttggttcactacaacctctgcctcctgggttcaagcaattctcctgcctcagcctccccagtagctgggattataggtgcccgccaccacgcctggctcattttttgtaatttttagtagagacaggatttcaccatgttggccaggctggtcttgaacccctgacctcaggtgatccacccacctcggcctcccaaagtgctggggattacaggcatgagcccctgcgcccggcctcaggttgcattctttgaggaccatgtgggatcagctgtgaggctggtgccatggaaaaatataatgttgggccgagttcctcaaggaacttcagctcaaggatcagctgagggtcagtccgaaagagtgagtcctggcttcaggcctgtggatgctcaggcagcagttcaggaggtgagatgagcatgaagagctgtgaaaggaaggaagacagggcagagcatgtagtgtcggagttggagtcacccaccagtgtagcagagagggctgaacatgtagaggaagacggcacagagaatcgggagtggagatggctgggggaatgatgggagatgcccaactgaaaggacaaaggaggagttccagggccaccagtcagatggagatgctgatgacaatgatgatgatgatgatgatagtgatgctgttgatggcgatggtggcaatgatgattgatggtgatggtgatgatgtgatgatgatgatgatagtgatgctgatgatggcgatggtggtaatgatagtgatgctgatgatggtagtggtgggatgatagtgatgatggtgagggtgatgatggtgttggtgatagtgatgatggtgatggtggtgatgtgatggtaataacgatgatgatagtgatgatgatgatggtagtgatgggaccatagtgatgatggtgttggtgatagtgatgatggtgatggtggtgatatggtgatgatggtgatggtggtggtaatgtgatggtgatagtgatattggtaatggtggtgatgcgatggtgataatggtgatgatgatagtgatggtggtgatggtagtggtgggatgatagtgatgatggtgagggtgatgatggtgttggtgatagtgatgatggtgatggtggtgatatgatggtgatggtgatggtggttgtgatgtgatggtgacagtggtgatggtaatgatggtgatggtgatatgatgatggtggtgatggtgatggtggtagtggtgatgtgattgatgatgatagtgatgatgatgatagtgatgatgatgatagtgatggtgatgatggtgctggtgggatgatatgattatgatgcttattgatggtgatgatggcaatagtaacaatgatgatagggatatacattattcctatgtaacttactcaccttaaaatacatcattcaagttttcagagtcaagtcatgttcccttgctatgaagaaaacttaagtctaagaaaatgtaacatgaggaccaagaggagatgcccgtggctagcaggacctggtgatttatagatgcatgtaggacttttccccacatgtttctacatggtctgtaagataaggagagtttctgatgctatagagctctcacattgcagagatgaaaaggcaccatttccccaatattttatgatgaaaatatacaaacagaaaagttgaaagaatggtactgacctgtgtgtgtgtgtgtgtgtgtgtatacatatgtgtattcatgtatgagtttctatctagacagaaagtgtccttagaagaaagtgtgtatgcaccattcttggccaccttcgatatccatcgggtcccctgtccctgttgctctgaattcggccccattctagctcttcctgcctcatgcctgaacaaggagctgccttacgtgtgttccatgtgctcggtactcctacccccaggtcaccttgcactgccctgttcatcctcctgtaatgccacattggtgggttgctgactcacttgagagctcccggcttgcccattttgcactgagaaaagactggctgcatgttgctctgtgctttgctgtgcaacccagcctcagctctcctttgcagaatggacctcagctgcttctagtgcaccagctgtgcccagcagctgtccctccccggtggcctctaacatgccatcggctctgaaacgccagatgtgccgtgcctcctctcccaagcgcagtgactgcaggcagccctcacatgctcagtgactgcaggtagcccttgcactctcagtgactgcaggcaggcctcacacactcagtgactgcaggtagccctcgcaccctcagtgactgcaggcagccctcacatgctcagtgactgcaggcaggcctcacacgctcagtgactgcaggcaggcctcgcacagcacaagtggcctctccttccctgaggtgtgcagtggctccagcctctttggttgtggttactaagattgcccttggacatgatgtgtgtatactccttgtttattctcctgagctgaaagctccttgagagaaagggaactgagtgacctgccctcggctcctggcctgttctgcatggcccatgggctccagcctggcttttttggacttcggtgactgtgcttcttccctgctaaacctgcccatggggactgttgtattcatctgtgtgttcctcagaaagtagcagtgtgtgtcacacagagtctgcactcagcaaatgctctgtgaccagatgagtttgcatgagagaggaatgggatgtggtttgagttgagtgtatctggaggctccattccggggcgaggggcgggggcgtttttaggccaggcctccctcgcagccgctcgcctcccttgtgtaaacctgattgcctgcccctgtactgatcctgcaggattaaggttaaattaaaaataagcatggatggatttagatggactttttggtgagtgggcggaactggtgcaaagctagcggtacacacaccaggaaggaagacaagagctcggcgcctcaatggcagatgagggattattgctgagaaacccgtcctgccgtctccaaaatgtcaggttaggaaatctgcttcaggaaactcaagagcatgccaaggtggctaacagggatggcttttccctgtgttctgacacccagcccggcatcctctcctggttcctgcagccacagtattttaaagtctcgacatcctttagtcccagagctgctgcataacagtgcattcttagaaaccagctgggcctcaggtcatggtggaaggtgtggtgctgagaacctgccacatgagaaatcgcgggattgcctcagtccctgaagggcagtgcacagaacaagacagtgtcaggatgccaggattgcagtgtcaggatgccaggatcgcagcgtcaggatgccaggatcgcagtttctgctcctggacagaacaaggcagtgtcaggacgccaggatcgcaggttctgctcctggacagaacaaggcagtgtcaggacaccaggatcgcagtgtcaggatgccaggatcgcagcgtcaggatgccaggatcgcagtttctgctcctggacagaacaaggcagtgtcaggacgccaggaacgcaggttctgctcctggacagaacaaggcagtgtcaggatgccaggatcataggttctgctcctggacagaacaaggcagtgccaggatgcaaggattgcagtgtcaggacgccaggatcacaggttctgctcctggacagaacaaggcagtgtcaggacaccaggattgcagtgtcaggacgccaggatcacaggttctgctcctggacagaacaaggcagtgtcaggactccaggatcgcaggttctgctcctggacagaacaaggcagtgtcaggatgccaggatcgcaggttctgctcctggacagaacacggcagtgtcaggacgtcaggatcgcaggttctgctcctggacagaacaaggcagtatcaggacgtcaggatcgcaggttctgctcctggacagaacgaggcagtgtcaggacgccaggatcgcaggttctgctcctggacagaacgaggcagtgtcaggatgccaggatcgcaggttctgctcctggacagaacaaggcagtgtcaggacgccaggatcacaggttctgctcctgggtctctcactgactagctagccaactattggcaagccctttgcactctctgttccttaggtttcaaatgataaaacaggatgtctgtgctaaacaatctctgaaatctgcaattcagagaccgtctctgaatgtgccagctgcgcccacgtcctggggcacacctctctgattcttctttcctctccttcctgtttctcatgtcttgctatggatgtgagtatttagaatgctgacacaaggccaagaccaccaggagatgtgggtgctctgagtggcatttatctggatagctgggatctttaccatggagaagtgaaaaattagaaatctgattaatgtaaacatctttccaattacttttttaataaaaaatttatttctccagccatttggagcttcccgacagaggggctagctcagcctcacggatttgttgctgcctgctggaaacaaagaatgggctgctgtgcgccacatgactgctgtcccaaagccaccaactttctttaaagccgggtcagatatcaagcttccagtcatggaggcttttgggtggtttcagcatcaatctctgatcaattcaggggtcaatatcatgcatatgtgtaagttcagcccagtagggtttaagtggatagcaccatattttaatttagaaaggctttctgtaaaatataaccgagcagtggttattgacataactctcaagggtgtctaaggaagagaagttgttgttattgtttggggctgcccttcactgtttataatttttcctgtctgtgatgctcctcctggtgtcctccaggtgctctcgttgagaattaaatgttgctcctgcagcagactcttttgtacttagtcatcgccgaactggcacctgtcggcctatggtgcaggaaaagatctcttttccaagtagcagagaagatgttaacctgggccacttgagccctggacactgtttctgaggcagagctcccatcttggtcccctgggaccagctgtggtctcttcagcacgggttctccttgtcccctgtggcctcctgcagcctgtcctctgctggtgagtttggttgcagcagagtctttacaaatgatcgaggccccgagctctctgtgcctgcctgagagccagaggctgaccctgcctgagccctggagactgtgctctctttggtgatgcagataatttagaccaagctccaacacgttcccatttagtaggaaaaagaaagacacacacattggagtgcttgctttgtttttatgaattcctatgcaggtgcaggatgtgcggggagaaggggccccagagtcctgtacagattcagcagcagtgaggacgccccccacccctgcctcagggctgtggccgcccacagtctgctggttcaattttctcctccagaggtgagctccccagacgcaccagcttcaggattccccctcctgcctctgtgccacttaagtgttttttatttaaccaagactttctggacatttcttcagttgctgacttttaaaattgtgtaactcagataaagctattctaaatttttttatctgaaacaccctgcagggttgctttgggagttaatgacttttatgaaaatcatgtgtggcaggatgtagtccataagcataagatttacatatcctcactgcccatcacagcctcggcgtgtggcctttctctttatgctttgctccctctgccacgtcgagtgacgtggtcagcgtacgttaggtgctcaacacattttttgagcaaatgacaatcagtctcacacattttatgtaattgctaaatgctgagccaactgtgcaggatggtctgtgcgcttctcccctctcgccacactgtgaagtgtcatttctgaagaaatggtgggtctttccagaagtgtctgcagtgccgggaaggaaggcttgcttacttgggtgccctggcattgagaacaaaggctggtgagtaggtttataaatgtcaagctgcatttcctggcaacctgccttgtgctcagaaattggcctctttaatgcagacggccttgcagtgaggtcaggcccttctccttcccattcacggccatgtctgccacccaaatgccattctctcctgcaggagcttggtgctggggagatattattgttggtgagtatttttgttgaaaaacttaccaaccctttaaagtcaggtgacgagaatgggagtccctctgatgttcatccctgatccctgatcctcctgtccctggtcatgagagtccctctgatgttcatccctgatccctgatcctcctgtccctggtcatgtctacacccaggacacatctctgatttaactaataggtaagaatgttgttagtaaaggtgacacttttttctgtccatgggattaaaacctgggatttgctcccttagattagaggaaagtgttcccctccacatggcacattacttttatcactaggaacttttttttggtatttttttcttcatgagatggggtcttgctatgtttctgaggctggtgttgaactcctgagctcaagtaatcctcctgccttagcctcccgagtagctggaactatgggcatggccaccacgcccatcaggagcttttcactgtaacttcccccaaactttcctccatttttttggtctctgtcttggaatggcagatgcgttgcacactgaaggattccagaacctccaagagtgttttgctttgtattgaaatatggaatttataaatgaggaaactgttacaagcttttcttttaattatgaaaacagcataatacaaataaattcagaggcagttcataaaacctgttttctagtagtttcagccgtaagtctctgcaagccagtactccctttcttccctggcacagtgggcagcagatgctcgtcaccctggccctgagacactgtcacagacacccatcggattcttcactatggtgtctatcagccggctgtggctcaggacagccaggtcccttaggaagccctgggcctggcctgcccctgccctcccgaagcttgcaggcaggataccagcagcacacagcaaaaacgtgaactcagccgtgacgggatactgcgaagatgttaagtgcggggaaagtaaatggaaatgttatatttaggattagttcacagttccatggatctctcatctctttctgaataaatgattcatgcgtgtggtagagagtgcattaccctgtgctgcagagagtgacgtggatcctaccctgtgtctggtgcctgaacttgtgcagttctgagctgtgtttggctttgctccgaagcggctcaccattgatgggaacactgaatccaccggaactcccgacccctctgctggggaagagtcaagcacgatggggcagtcggatgagctcctggtctctgcgtttcactcccctgacttcttttttctggacgtttggaaatccattctctggtttctgtgggtatgaagtatgcacccaaaagctggtgtttcagtgcccgtggcatcttggtgcattgcatcacgagatggaggcccctcacaggctctttcgtgggcagaaagtgcgtgtccagccgcacgatctactgggcctgtgatcgttcttgtgatacagatatctttcttttgacattggtctttgctgaggcttaaagcaggtacatttttacataaagaattcaaaatgatgtgattactaagagtgttgcaagatacaaggatagtaaaggagcctgacatggctgaaggaagtctgtcctttcaccacagactcagccgtgggtaggaagaagtgtgattgggaagggtcacatgtcaatgacagcaaagacttagagctggcctcagaatcaccaagatcatgcaatactcgtttcgcttttttggacccaagcacgcaggtttctctttggccatagatttttcaagagactaaatattgactatttgtagccttcaattgtttcttttcttttctttttgttttctctctcttttttctggagacatagtccctctctcttgcttagactgtcaccgaggctggagtgcagtggcaagatcttggctcactgcaacctctgcctcccaggttcaagcgattctcctgcctcagcctcctgagtagctgggactacaggtgtgtaccaccaccccaggctaatttttgtatttttagtggaaacagggtttcaccatgttggccaggatggtctcaaactcatgacctcaagtgatctacccacctcagcctcccaaggtgctgggattatgggcatgagccaccgtgcccagcctcaattgtttctttattgcaatgttgttaagaactacttagaaaaaaagcaataagctattattgataatacagatgatgcatttgtattcttgctgtgaacttccctttataactagtagatctcttccaagtaccctggcttccttgctgttcctcaaacatgccaagcaggattctccagggcctctgcagtggctcttcctggtggtgcctggaatgctttccctggtatctgctgtgtcttgtttagatccgagtgtcggacctgtgtcactttccttctgtcagaagagcttcttttaacactacttgaaaagcaggtggaccgggcgtggcggctcacgcctgtgatcccagcactttgggaggccgaggcgggcagatcacgaggtcaggagttcaagaccagccttgccaacatggtgaaaccctgtctttactaaaaatacaaaaattagccaggtgtggtggtgcatgcctgtaatcccagctactcgggaggctgaggcaggagaatcacttgaacctgggaggcagaggttgcagtgagctgagattgtgccattgcacttcagcccgagcaatagagtgagattccatctcaaaaaaaaaaaaaagaaagaaaaaaagaaaggcagatcaactgctgacaaattcctttaatttttgtttgcctaaaaaagtctttatttcttcttcagttttgaagtattatttcactggacatagaattttaagttgggtgttttcttttaacattttcaatattttacttcattctctactcgcttcttcctaaaaagaagtccagcataattctctccgtgcttttctatgggtaaggtaaggtttttcccccctctctggctttgtccaaaaattcctgtctttgatttttctgcagtgtgtgtgcacgtgtgtgcatgtgcagtgtgtttgtgtgtgtgtgtgtgtgaagtgtgtgcacatgtgtatgcacgtgtgtgtgtgcatgtgtatatgcatgtgtgtgcgtgtccgtgtgtgtgcatctgtgtgtgtgagtgtgaatttgtgtgtgttgtatttacccttcttggtgttctctgagtttcctagatctgtgatttggtgtctggcattaattttgaaaatattcagccattattacttcaaatatttcttctgttcccttttctctttatctcttcctggtattcctattatgcatatgttataccttttgtaattgtcccacagtccttggatattctgttttgtctttttctttttttttctctctctctctttgctttttgtcttggggagtttttattgatagatcctcattctcactgattattcctcagctatgtctgctctaccaatgagcccatcaaaggcattcctcatctctgttacagtgattttgatctctaacatttccttttgattttttcttagagtttccagctctcaaatcacccatctgttcctacacattgtccgttttctcactagagcacttctcatattcatcatgggtatttgagattcattgtctgataattccaatatctctgctatatctgagtctgattctttttctctttgtgatttttttcccttttagcatggcttgtaatttttttgttgaaacctagatatgctgtattggataaaagaaactgaggcagattggcctttagcattaggttttatctttacctggctgtgagttaggctgtttactgtttgctggagctgtaattgtcagaggctaaaatttcttctggtgtccttgttttatctccctacttttctttgggtttccctagagacttctccttaaataaagtctgatgtgtgcagttcttttatctgtaatcccctgtcattatgtgggagccctgttggtattgatgtggtggtctggtgtggaaggagggcagcatcctctggccctgtgatcaggtctctgtctcagcctgaacctgcacacctgggctgtgacctcaagaggacttctcagctttttcttttcctcccataagtgaaaggaaggccagatgggttggaattgggtattttccatcccacaacattctggacttatttcatgactggtttcatgctgtagctatcctttcaagatgtgtttttcacacagaattatattttgaggatttatccacgcagatacctttagatctagtttatatgtaactatggcatggtattacagtataatttatgcattcttcctctactgcaggatatttaggcagtttttacattttttctatttccccacaatataatttaattaggtgttatcagacctctctttagtttatgccaaagggggagggccataaacttgtatcttattacaattttcatttgtctgtatctggcagacaaataaggtggagcagctttctatagctctgttagccattcaaatttcctcattagtgaattgcttgtttgaacacttcaattttcatgctgtgtttttttttgttattttattattagaatgtaaggattcttaatatctgtgtcattattctagaaatacatattttacatattatgtataatcttatatttctatattttatactttattatctaatataaatactacatattatataatataaatatacatgttacatataaatatatatgtagaccatatttatatagaaatgctatatgtgttatatatagcatagtattttattataaaatgtatgtaattatatttgaatactagttcttggtcagtgcattatatatgttataaaaatagagatatagcttatcttttatcttttttatggtgtctttttaatcagtgttttccatttgaagtctttgggtttcatcatggcatctttctctagtgatttcataaaaatatttgcccttattttcttctgaagttttagaatctttaatctgtcaggaatttttgttgttgtgagacaggggttgaattttatctttttctacttagatagggagttgtcctggcccttgtatttaattgttgaaataccctttctcctgcagtgtatgtcttcacattggttgtctatccagtccccatgtgtgtacttatatttctccctcctcagttttattccactggttctgtttgtcagtctttccaaaaccttgatgattttcttttctcaattcaactttctcatcttactttatacatgaatttctactggagtataacatatacaaagtgtgcacatcttagtgcagagcctgttgactgtgctgtgtagtcaccatccagctccagacagagcccttggcagcccagaccctcccctcagcatctcctcccaagtgagacccaaagcgggaggttagcggattcagacatcatgcactccatgtgtctggcttctctaactcaccatacatctgtgatactcacctgctgtggtacagagtagacacttggtgtctcaatcgttctgacaatgtgaaatctttctgacaaggtgaattgcaaccctcccccattctttccccaaattatctacatgtcccttattctaaaatcatttttcagatgagcttgtcaaatttatgaaaaaagactgattgggttttttgttgaatttcgatttaatgtatagtttagtttggacaaaactgtacaaaagtacagtcattgccacataacagcgtttcagtcaactactgactgcatacatgagggtggtctcctaagattataatcacatactttaactataccttttttattagatgtgttcagacacaaatacataccattgtgttagcgttgcctacagtactcggaacagtaacagtaagctgtgcaggttagatacgcaaatacataccattggttacaattgcctacagcactcagtacagtgatatgccgtgcaggttgtgggtgtgcagtgggctgtgccagctgggtgtgtgtaagtgcactctgtgatgttggcacaacatcagctaacgatgtatgtctcagaacatgtccccatggttaggagacctgagagtgtatttacgacatttggtcttcccatccacttctgtacttacatggcatgtgtcttcgctgagtgagatattcctttgccattcaatgaacttttagtatttttaaatgtaaagttcttaaaatattttattaaaattttttgaagtagcttaacatgatcaggattatttttaaattaacttctaactatttcaagatattatataattggttgttgctggcatataggcacattggtttgtattttgaccttgtgacctgtatctttgaaggaatcttatatttgttataattgcttgattggcagttctcttagattgtccatgtaaacaaatatgtcatctgcagctttcttcctttctaatgctgtatatcttaacatttgtcattgcattgagtatctagggtgttccaaatagtgttgaatcaaaggggtcaaggaaggcttcattatctatcccaagcattaagaaaatgtctttgacattttaccttgttaaaggatgattatttctgaaggattttattagataacttttattgggttaaggatgctttattcctagtttcttaaaatttaaaaaattttgaatggaccaaatcttattcttgaatctctaagatattactggactttttctccctttaatctcttagtaaagtgaattacatggagtagaaccagttttgcatttttgggatatacctttttggtcactttttgttttactgatttccctctgttatatttggttgctattattttttgagaaatggaattcccttattttcattgtgttactgtttttcagtgctagtatcgaagtaatactcatctcataaagtaaattgtgtcctagactgaaaaatctaaaatccgcataggaggaaacagatgttgcttgaagctttagtaacagtgtttaagtcacctggctttagtgctgtttatgagagttggtttttgaatactgatttaactaatggttacaagtatagtcagataccattcctttcaattcaattctggcattttgtgtttttgttttttttcctaaaaatgattcatttcacttatgtcttccaattacgtttctgttgtgcgttgcagtttcttgtggttttgcatatctccgtatatgttattgttatgcccctaattcatttctagtgttatttattttgcatctttcctttctggataattttgacagacatctttgtatttccttcatatttttaaacagtcaactctgctcatgtctgtgctctctgctgctttctggtttgttaatttctgccagtaagtctcaggctatcattttatctccaggtcagatggggttaattctctagtttgcgttttcttttaaattttgctcacactttctcattacagattgttttctacgtggtttataattttttattacatgcttgtctttgatgtctttcttttcttatgagaatcctgtggaagtcccaagaactctcattgttggaaaggttcctccaacattttataattagcaattcaaatcaatgtgttatgttagatatatgagtattttattatattaggatttgacactcatgtgggatacaggttcaggcttctatttctaatgagaggcatttgtgttttcatccagagcctgagaaagagaggctcttctgcccgcctgcctgtggacgggttgttggcattccttttgtgcagggcaggtatgcacagtccttgggggtgcgctgccagcacctgccccctgccctcctgtgggcagaccccaaccccagcctgctgggccctaacagacccccctgcctgccactgccacactcagctgcctcccttgcctgctctttgccccagctctgtgctttctctgttctggcatctgggatttctccttccttcctttcacgtttactaatgcttcaaaatttgtgcctgtccctttttatttacagtatttatgcattagactgggagcagggtctgtgctgtttttacaatgtgtgctcgaaatggacatctctagactttcttctcttcttatagttttatacttgagacacttgttgactatgaagtgagagtatttaaaagtgcatatattgtcatgctgatgcgtgtaaacacactatcgtgacgatgcgtgtaaacacactgactatccacactgggttttctgggcagtacaatttcaaattttgttcctcctaagctcaggccacatgttctgatttggagttttaaagaaatggagagtgagcctggaagaatttactaaattgatcccagctttctaatgttttgctcagggcagatagcagggaagcattgcaaatagggttttggctgacaggcaggctcctgtgtgcacacacaaagcctaccccacaaaagtagagtctgcttctccgaattcaggccactctcttgcagctgaagcctctgctactgctccctgtcagcagctcccagctcttacaccccaagtggcccaggcctcagctacgatgcaactcgactcagccctgttgtgtttgggggactgaggtgctggactcagggtgagacactcacacacctgccctgatttccagatcttggcctagcatgggcccctcccagcctgtgttagttttttttcacactgctgataaagacatatctgagactgggcagtttacaaaataaagaggtttaatggacttacagttccatgtggctggggaggcctcacaatcatggtggaaggcaaggaggagcaagtcccgtcttacatggatggcagcaggcaaagtgcagggaaactcccccttataaaaccaccagatcttgtgagacctattcactatcacacgaacagcatgggaaagacctgcccccatgattcaggtacctcccactggggtcttcccatgacacatgggaattgtggcagttacaattcaagaagagatttgagtggggacacagccaaaccacatcactgtgcagccagccacacacagagcattgctgaccagggatgcttgcccgggcctcagcatgcagagtttctattgaggtctcagtgtgcagccagccacacgcagagcattgctgaccagggacgctcacccaggcctcagagtgcagagtttctattgaggtctcagtgtgcagccagccacacgcagagcattgctgggcagggatgctcacctgggcctcagcatgcagagtttttaatggggtctcagtgtgcagccacacagagcattgctgaccagggacgctcgcccaggtctcagagtgcagagtttctattgaggtctcagtgtgcagccagccacacacacagcattgctgggcagggatgctcacctgggcctcagcatgcagagtttttaatggggtctcagtgtgcagccacacagagcattgctgactagggatgctcacccgggcctcagtgtgcagtttctatcgaggtctcagcgtgcagtcagccacacacacagcattgctgaccagggatgtgcacccgggtctcagagtgcagagtttctatcgaggtctcagtgtgcagccagccacacacagcattgctgaccagggatgctcacctgggcctcagcatgcagagcttctatcaaggtttcattacattggtgtgagggattgaaccattggccacaagctttaacccacccaccagccctcccctctcctgagatcagactatatcccacggctcagagcccccactcacccatcacattgttggtctttttggtgtggacagcccccgtcctgtcacctcatttgcataaacaatcaggtgtggtccgaggggcccaccacaaatgacctcactcccgtgactcaggaggctgcaaggactcaggctgcttccaggaacaggaccaaggctagccaaactccttatcacacaacatggctaaaacgacttatcattccagctaatcaccgactcgtttcttcctcattctctcgtcccacatcctcctccactgcccaggtagtcaagaagatcaccacagctccatgtgtggccctgatggctccatcaggcttggtggccaccaccaggcaccaaggctttattcgtggcccccaatggctctgtcaggcttggtggccactgccgcttaggctgacatccttcagattcatgcctctagccctaaaccattctgactccagagcaaattcttatttctctgagcacagcacctgggagacagaagttggctgattgcatcagtgagcgacttacagaaaaaaaaaattactgggtaagcacatctgaagaaacaactcattgaggtttctgataatgagactttcccttcctctgcagtaatgccttttgacaataagcttagcctattcatctctcccagcgtggtgcagcagagctcctctcctgaaaacctggaggcatggaagatgtaccgtcctccacacggtgctggacgtggggccgttgtggtcctgggtttactctgctcatgtcattaagccccatctgccctgcatgtgtccctctgagtggtcagtggagccaaatgcctggtgctctgtgattttaggtctaagccattttagaatctctgcatttagcgttgtatgaattcactgctcactgcacaatgcgtcctttgctctgaattgacccagttgagattctcggtgtccagcccgagtctattgcatacggaacgtctctgtgcatcagaggcgctttttcacctgccttgggtctcttggcatctgtctctcaggcggaggagccactcactgcatccggccttcctcctgtcattttgtttgcctttgccctcctctgaactttaattctcctccaccatgagaactgaccagaacttgccccaaatgcagcacctctgctttcaaagccggggaaggaggggcaggagagggccaggggctgtgctgtctctaatgtggcctagaggtcagaggaggggccttcatcagagcatcagccaccccttcctgggcccttgcttccccacagagggcatcttgctgctcccggcgaagcaataattgctgaaaatgggaagttaattggatgtgagtgcaatgccatttggctttttgcttagccagggccaggcgtgggggcaggtttccgaaagggaagccgaagactccacacagcagctggaatgccggggcctgagcagcccccagaatggctgctcttctttctcagcagtgctggagaaaacagccaaaggtcccttgaaagtgagagctgggctgctcaccatgtccttctgcaccatgaagaagaaacaaaggagacccagagacttcagaggctcgcgggcccccggagcgccggctgcagagcagcaccgtctttgtagttttgcagcgactgtaattaatgcatcttcctgaggctgctgtaaacagcccccgcgtctgacttccgcccaccttttttactcgatgatttaaattgtttttctgactttatctgtcactttatttaccagctcttaacctttcttctttttttaaaatataaatgagtataacatccactgaagattacgatgccttctggaaagtgtggctgaggctgtcttcctggagaatatcctctgcttgccctccatttatctttttctttttttcctgaagtctaataagcattaatttcccaattcctgaatatgcctaatgattatattttttcatttaacaagtaaaaagcagcttaaagggctttctaaatctctcacttgggtacactgtattctcacagagtgacggaatttggcacaaacatattggttataaatgaatattttatgacaattaagagcatttctgtggctttattatttgttgctccaccctctggtgagacctgtctttccttcaaaaccaaatagaccccaaatgtcagatactggaaatgagtgagtacagggatgcaggaaaaaattcaggaaggtgcaaaagtcatgacctcaccattgatgtctccatcacggtgagatcgaggtcgtctgtcagatcacacagtcttccagaacagacattcagctctgtttttacattttagaaaacccaggaagactgggaaaatattaaaggccacagtggtccagtttatcagcaagtagtgttttattcatcattcttgtccctggtttgtcaaattaaacacattatctgtggaccttcagcagatactgcagatttatcactcgaggatattattcaacgtgatgccttctcttctctttctgacttagcaacaacagtttagaaaggagaaggcttgcagagagagaaaacgagggccctgaggaagagctgtgggcctggctcatcgctgagctctggctgtgtggggccagagggtctgagatggcgcgtgcagtgcccaaggctttggcaacggagccccgcacactggcaggcttagaacagtgcaaagctctccaggccctgcaccccccagggtctgagatcaaggtcttagcggggccgtgcatctctgaaggctccagagagggtccttcctgcctcctccagcctctggtggccctgacacccctgccattcctcggcttacaggggcctccctcccacctctgctgggtcaccaggtgttctcgggaattctggcctcgccttcccactgggcacttctgtctctgtccagtgtctccttcttagggacaccagtccctggattaggagccactctgatggcctcatctttaactggcttccctcttcggagaccatttccaaatcacatcccatacacaggagctggagccaagactcagacgtgctttcctgggggacatagtccccaagcagctggctcagctctgtgctttgctgggggacatagtccccgagcagccatctcagctctgcagggggtcaggtgcttgcgcagagctgcctcatcctgcgggttctcgggtgcggtgaaggatccgtcctggggatgcaccatgcctgcttctggtgaattattttctgcagtcttctacctttaagagggacctggctccagacagaaggtacaattgccctaaggaaatgaggtcaccaggcgggctctgcactctgacctggtcacagggagcacgcctggcccgtgctttccactgggaccccaggtgatgttgcttctgtccaggaaaaatgcttctaatctaacaaaatagtattagaattatcattgttattattacctgtgtatgtattttctctctacatgtctttgatgatgtcgtaaactggtagatcgagtactgtttacttacatagagcccatcctcattttatcagctgttttgcagctgagttgggagtggggaggagaagcctgtgaacgtgttatttctggttgctatgtttgctgtgtggatgggcaggacaggagcctccagcccctgtgaacatgttatttctggttgctgtgtttgctgtgtggatgggcaggacaggagcctccagcccctgtgaacgtgttatttctggttgctgtgtttgccatgtggatgggcagggccggagctcccagcccctgtgaacgtgttatttctggttactgtgtttgctgtgtggatgggcaggacaggagcctccagcccctgtgaacgtgttatttctgcttgctgtatttgctgtgtggatgggcagggccagagctcccagcccctttgaaggtgctttctggaccttctctgcttggcaaaaacagctgaaggtagaaggcggttaaaggcttttcttctatttccaaatggcatggccatacacatatctcttctttttcttcaggcggcctgcagagattaggaagcctgatgttgagaaatgtcactggtttctttggggtagaattcggaagaatgcttttagagggaaatcataggattggccttaagtttaagggacacttagaggagacagaggacaggatatgaaccccatgccctagcaagtggatacggaccccgtgcccccggcgagaggatacggaccccgtgcccccggcgagaggatacggaccccgtgcccccggcgagtggatacggaccccgtgcccccggcgagtggatacggaccccgtgcccacggcgagtggtggggaggctgccaggcaggacagaggtgtgggttcttctttgctccagagcaggggtgttcgagtctcagtggctcatgtcacaccaggtgactggagcaaaatagccccatgtgctggtttgaacatgaagacagctgattccaccaggttaaccagccttcagcctggtgatgtggtggttctggcctggccgtggtccccgccctttcagagaccctggtctcctaatgccgcaaggagaggtggcctccctccttctggtgcacgctggactctccccacgctccctgagccagcagaggctcctgagggtctgcagctgccccgccctcctgggcttcagccagtgttgccttgcgcgggacatagtagctctgggtaaagaatggcccccggtcagtgttcaaaaaaattagggccttcttcctaaggccactactgttcaaacagtgttttccttctgacagttaaatatttactttctccaggtggcgtcggttggtcagtggagtccgcctgtctccgctgggctgcgtcggttggttagtggagtccacctgtctcctccttgctcctggcttgcggttctctcctctgccgtctctggctgggccttgcaggctctggctgcttctcctgcagttcattttgttgttctttcctctctcgtctgaaatggcctctgtcctagattcaggagggaaaggaggaaaccggtggggcctggccgctgcttctcctggccttgttcttcaggctccctttgaaggtttcgagcttctgctcttgctctcctgcctcttcctccatgcctgctgcttctgcgagctgtagtttacattctggctggccgcagccgggtcctcaggacttgaggagagggtcctgtcagggccagcgttctggtggggttttcagccatgaaaatgtccagagaattttggtctgagctggagaggagacaacagcgtggatgtgacactggggagaaaaagcttgggccctgattcttgtctggccatcttggatcatagacgaattattcacaagagggtctctgcctaaaactcaccatggtggctttcttggtgtacttttcatgtctaaaatgtatgtaaagttcaaactttaaggctgcagaaggaagtgaaggcttttgatgctgtttacaaatctctggtttctgactcaagaccatgacggtatgggggaacccaggcctgaccttctcccagttttgggggagctgcctcctgcgattctccctcggtggccctgttggggtggggcccatttcctctttgaaaatgacatcccagtcatcttactttctcggctgtgaacactcacaatatgttccacaggatgccagggctctgctccgctggagaaacctccgtcccaaactctgtcttgctttctcaatcatatttttagaaagtgaggctgggtggcttgtgggttccagaagcattgaggttgaatcacaactgtgaaaatatgggagtgaaaaacacagtggagacacaaaaggagcatcgtgtcaggatagaggattgtggagggtgcccatgtgttcccactgcagctggccccaaggttctccctaaggtttttggtcccatctctttccctctggaactcacgatttggccaagaatgagcactctcaggctgctcccaaggaggcccaataccagcccatgggggccgagagccacgtcaatccacatctgcccctcctggcatcaagggtcagccagtgccctgccttttaattttccatttatttaaacaggatcacatgatttcatttgagagtatttcctccaccacttctgagtggaagccaggagacgaggtggctttcagttccatttgacttcctgccacttacatttacctttcacgtacctgtggaaggatgaccagggcctggcctaggcatgtgggtaaagtcctggctgtggctgggcactttccacaggggccggctctgcctggggctggggtgggtgagccctgttggttctaggaccccggacctgcctggtcagcggagatgatggaggttcggtatgggaggagcaggtgtgctgtgcccgtgaatggcagttcctgggccaaaagggtcgagtgtcacgatggtggggtcatttgaaccgtttgtcaccagcatacctagggcagtgccaactgacacagtgcccagagccgagtggctgctggaccatcactgctgtgtgtcctgtgttcacgcagccctgcagaggacagggccgtgtggtcaggcctcttgatggggcctccttgcacctgacctgtcacggtatacgtggagggcactctgccttcctcccggtgtcctgtacgtctgagtggaagtgctttgtggggtgagggcacctctgtggggctcagggggcagctttgaaacagtggccagggtgctccccacagccaggcccactgcagctccctcctgtaccatctcacgtggaagagggtctcggttttgtctttaattggtaaaagttgttttagtgtatgattatgtaagaactatgaacacaaggaattatcttacattgtaaatatttgagtaaaaagaataatttcgatcaataaggatgcatatagcatgcatcactcagcttcgccaaaatccacgccatgctgtccggctggcatctgagggcagccttggtgcccgtcctcggccagtggaccttcccacatggatgttgtttgctttgcgttattatggtcccccccagcgagcccagcccaccagatcagaccatctcctcctgaatctttgcacaaataccttccatcatccctggtattttacctgtgaattactgttagggaaaatatatcagtagcagagatactgattctgtaatttttcctaaataggcacttactccggatgaaaccacaaagcctaaataatacattagcatgcgaagctcaccgagctccttccctccgcgccgaccccggtttccatctaaatcgatatctgtgctgcctcgacggggcccggcatgggccgtgcttggcatacagagcagctgcacctgagcagcagctgaggggtcttagggaagccgctgccccttccaaacatgactgcctttgaagcccctattaattgtcaataacaactgctacctccattacaaaaggaattgaaagcaaaaataagacccggacaatagaacgtaaacggaagagcaaatcccactccggattggaattgtctgccgggctcgttaatccctggcctggcgctgggagtgtgggtgccgcttttcttagggtttgctttctgatcttgtgtcaattactgcacaaagcttcacaccacacagcgaatcctttttataagtgttttagtttttgttcaatattttatgtttctgcttctaaatcttacttgccgatatccaactgataagctgagcagggaaatacaaatacaccagccatcatcccccaaggtggtcacatatgtgtgtgtttctttagcttaagtgaggttatttgatactcgtgtttgttctgtgtggagttaggccttgtcacatataagcagttgtgttcccacagggctattaaagaagtaaaccaagttggccacacaattcagcctctaaaatctgacattgttttctggggaaggcggccgtgctgggggtgccaggagagacttggggatgtcagtatctctcagcatggccgagaacaaacacccatccagttgtatcataccatgggggcctttgtctgctttttaaaatattaacaatgtattttggatgtttaataatagagcagatgagggtacatcaactgcattgtggctttacctgccaatctagttaccaaccatcacactgacaaggaggcgcggctctcccactctgaaatgatgcctttctcttctgagctcctaaagtgcagggtgtttttcagactcaaaggtcaagtccttcttagaatagggctgcatgtgtctttgtccagtgcatgtttgcctgctttcctcggggcacctgtcactgcaaagcccagctgcccgcttacccatctgagaagaaaagcttattctgacattcacaaaccacccactgcccacaatcaagcagacaaggactctgcaggccccaaaccccactcaatcttttcgtttctgttttcctttttcttttttaggtaaattttgttgcttattgaaaacttcctgtgtgtatgacatttttctaagtgcagtagcagaaagaggcagtggaaaggaattgaggtcaatgttgagagcacaactgaagttgctcatgccttatcctccctggaaagccttcatcagctcctgccaagctggccttggcccccttcctgctcctaaagcagttttctcttccattgcttgtttgtcacaaggtgtcttagtttctgccccacagatcagccccatggggtcaggagccacatcctggtggtcgtcttcttggagggcctaggatgcactcctggcttacaatgcctatgaccttgtggaggacgtgggcagcgagtgtccctagaatcacagctgcacgggtgccctgtgtgcccagggaatgcccagtgcatgtcttggcaatcattttggcatttttttcctcttaaaaatctaaatgtgtgtgtttcactagagatcttgaagttacggagggctgcagagcgattatttcagctgagtggacagctcagggaacctgtgttcttctgattgatttgcttcttggaaggaactgactgtaggtttgctgagactgaccagtcaattaagtcagcactggccatccagatgcctgggtttctgatgtgcaagtgctgaatagcagtgaggactcggaacctcaccgctctagagctttgctgggatgcactgggcatgttcacaacatcccggagctttgttggggtgcactgggcatgttcacactaccccagagctttgctggggtgtgtttggcattgtcatagaagacaaaatgaccctcacacatcaagaggaattgaaactgctgatagataccagtggttagcagctctgtttggaggtaatggtggtatctaccaaatatagaacccatgtgccaggccctgtgtgtgtgccggcatgtgtgtctgcatgtgtgtgcctgcgagtgtgtgccaggccctgtgtgtttacctgcgtgtgtgtgcctgcatgtctgtgccaggccctatgtgtttgcctgcacgtgtgtgtgcctgcatgtgtgtgcctgcttgtgtgtgcctgcatgcatgtgcatgactcaggagggactgacatgactgagtggcttgatgagggcaagggtaaggaggagatgacaaactgggcatgaagatttgtttactcatttcaagataggttaagaatgtgtgtgtctgctgaatgcaagctcagggtctctacgcaactgtcttccttagtttcaggaaatactgtagtccaggcagtgggggacaccgcaagaagggagcagaacaaggaactcgctcctcggctcttctcctttgcagtggatgggacagtgctgcagaatgtgcgtgtttgaaaacttctgcttgagttatttcaaaatatagattagagaaattttttttagagtgttaattaccgcaaagaaaaatacacacagccacagtagaggccaagatgtcttcagatattgggagcagcactggccacggagtgcagccatgggagcagagcctcacctggggactgagagagcagagactcacctggggtctgagagagctgtctgtcagtgtttcccaggacacaggcctgggagcgcttacgtggtgagctcctcctttagcgagatgttggagaaataaaccaggattggcttctggctactccttgtcgacatgggcttaggtgaattcattaaagtggttttctgtgctaaattgttgagagttttccaagatgaatgagtttaaaacttgttaataatgagtcacaagaaaacagccaccgttctgctttgtgccgtgatttttgtttatcagggataaatgcacactgaaaacaaagccctttcccatttcccattgaggactaaacaggagtgcacagagttcagactcaccagggcgaccctgctcttgccatcccctgcagaacaaggtgaaattgggcaaccgtggagggaaacgctactcttgatcattgaggtttctaaggtccagggatattgtcttctttttcttcctatttttcaagtaacccaacagtgccctgctccaggggtgctcagaacgcattccagactcatggcggaagcctccgtgggggaaagccttctggcgtgggcagcctgatgctttgctgcatcattaaaagccagaggctgccccagacagagtgcccaggtgcctgggccttggctatgaacacattacaggctgccccagacagagtgcccgggtgccggggccttggctatgaacacattacgggctgccccagacagagtgcccgggtgccggggccttggctatgaacacattacgggctgccccagacagagtgcccgggtgccggggccttggctatgaacacattacgggctgccccagagtgcccaggtgccggggccttggctgtgaacacatcatgggctgcgctggtcttccctcagtaatcaccgtgggaaatcatggaactggagagtgggggtgcttccttgggccctcattaaaggatgacctgaagtctcgtggtggaggccgtcaggaaggatggaaaacgctcggaaccgtgtaggaaacggagtcatcatgctgtagggtcagcaatggggaaagtaaaagcactcaggtgatgccccttgagtttcacaatttaaattcatccttgaatgtctcctctcaccatgtctgtggaagctgctgacaagcagaggatgcacttggctgggaaaacctttcctaccaggacaagcccaagaccgaagcttctggggacctgtcacccatctggcccttcagggaggaggccagctggagtgtggggtctcgcctcatggtggatgggcgaggctgcccggctcagccagggcagtagcagcagccatttctctgcctctccacagggaccttgtgaggtcacctcattttttattttaatacttactaggacagaggtgggtagattctaacccatggacagccccacctgttttagtaaataaagttttattgaaactagggttggccgatgtagtggtcttttctggtggactaaaatgctacagcctgggcagcttcagcaacaggagttcatcctctccccactatggaggctggacatcagagatcgaggtggggcagggctgctcctcccgaggcccctctccttggttggcaggctggacatcagagatcaggatgtgggcagggctggctcttccagaggcctctatccttggctggtgggcagcgccttctggctgtgtcctcacagtgctgtccttctgcacccatctctcggggggagatttatattctgtgctaattaccgatatattcccttctttttaaaatgatatcctctgtgtgtgtgcgtgtgcgtgggtgcatacacacacatttatgtatctatttaggtatttggtttttgccggcatcactgatgaagtttctcatggtcttgtcctgaattagaaaagcattatatgcattggtcattatcttccatgtttcctccctcttacctgctgctttcactcaaggcttttgaacttgttttcccttataattactgtggcttgaatagcatccaattctttcctaatacctgctgtgttctaacaaagcaaatataggcattagaaccttagaaaccagaggatgtcaacaaattggaggaaattcagagaaaagcaacataaatgattaagagactgaaggatttgtttgtgagaaaagtggaaaggaactaagtgtgtttgtcttggtaaagcagcaactaaggcagggcaataaatgcctttaagaattttaagtatagaaatctcaaggagagggaattatttttagggtggtagagggaatttaattaccttaagcaaaaaccgtctgacccgatgtccgtctaggaacagcctcctctatagagggggctccggctgtcgggggagcctgagtgaggacggcatccacacttccggcaggaccagggccttggaagaagaaggttattgcagtgatcccagtggctcaggcttcttccctttttattcagcaaaacacaactcctgtgcactcccttagacttgacacaggatccctacttttgtctttcttacctattccgtttctgtatcagtttctaccataatcattgggtgttggctggtgggctttgggagctgagacagccacgtcagaggaggagcacatggtgcattttacccccaacatggtgggcaaggctgccccagcccctgactgcttctgtcctgacggcttcaccatgaccccgggccggcctctcctctccgcacccactatcaagcccacagtgacctcgggacgtaggatgcaggccaaaccccacttctgtgccctcgcccctccctctcctcttgtccctcacgttccccgcaacccagagctgcaggtggcctctgcccaggcatcacctgttcctgggacaccccctcaccccctcatctctgagagctcagttcaggcaaagcccactcactgtaagaagtctttctgcgtctctacccagatggctgcacaaggccaccctccctggagctcatgtatgtgtagtgttggctgaaggaggtaagttgcagtagctgagaagcacaggtgtaactcacagagccacagtgataatgacagtggcagcaataacgggcagcactggggctggggtcaccccacctgggctctggccatcacacagatgctcctgagttcaaaccatgctcaacaaggacacagggccccagcttgggctctcaccaagaggatgagctgcagtgcagaagcctcagggctgggcattgaatctgggtcctggatggccggtgtggtttggagcaggaccgcggccaatggctggacctgaggagcagggtctgggatccagggatgtctggcgaagctgagggactggtaaaacagtggaaaaccgtgtcctgcggatgccgggggccgctgtgctgtgtctgtgcggccccagccacaccaaggccgagctgtggcctcaagaccgagcacagggtccgtttcatgctgcgcggctcccccggcattgccaggcacagccaggcctgcagatgtggggtccctgagaccaggtgggacttggaggggacacagcccgctcaccatcttccactgaacactaactctacagcctggtttgctcaatataggtcttgtctatgatgggacctcaaaaaatcctgctgatttaaaataatttaagcgccctctttcattctttgaattttttagaagaaagatactaaggaaggaaaagaagtaattgcacaaataaaaaacagttaatcacgaggccttgtgggcatcctgtgcagccccatccctggcctctaccgcgctgtctgacacggtcactccagctcacgtccttgtagccacccttaaagagaggcggcgtcagaaacaccacggcctctgccccctccttctatcgcatgtcctatccatgtgctatttaattacatgccgattgatttagcatatatttgttcattggaaataatgcttgaaacaaaataaatatcatttggtgacaaaacacactctattacagaaacagccccaggatcggggaggcccctgcagctgtggtctgagtggcattttgccagtgctgggagcccgtggtgggaggatgggcctgcgtgagcccttcggtggtccggctgcaagtgcttccgtgggggatccagacccagtacagttacacggtatctcatgctagcgtgggtcacgttagagtgagtttctacttcctaatgttaatgaattaatttcactctgtttatactttcttatattctctttttttttttttttttttttttttgtttttgaaacaaagtctccctcttgtctgccaggctggagtgcagtcgcatgatctcggctcactgcaacctctgcccctgggttcaaatgattctcctgcctcagcctcccaagtagctgggattacaggcacctaccacgacgcccagctaatttttgtatttttagtagagacagggttttaccatgttggccaggctggtctcaaactcctgatctcaggtgatcctcccgcctcagcctcccaaagtgctgggattacaggagtgagccactgtgcctggcctactttcttatattcttaaagagaaacaaactgaacgtttggttaggaaccgtctctaccacatacggtaacagtacaccgaggcagccactgtgggacaagagatccatttcaagccgagatgattttccttgtagaggcctcattttctgaaacaaatttcaaagttaagtgcacgtcactagtataggctaaaaatgtgaagctcccagaagttagcatttccaggcagatccagcttcacggttttctacgtcacaaacagggatttatatgctcccggttataaattccatcagagcatgcacgctacgcctgtcttctctggccaccttagccgtgtgttagaaacatcatacaggcaagagccttttccttctgcagacagcgtcctgtcctgttgtgctaatttgtatggccagcggcgcctgtgaacaagcacacagactgttccagttacccaccacttcagcagcgcatgtggcctagctccagctccacacgttccttgaagaggaatcaggctggtccttttaaattcccttccctagccatttagaagtccgcaacacataccccatcttggctcagaatctctgggaactttcaaacccactactcgcttggccccagaaactgtgaggtgcagggacacatggaatccgagagtgttcacaacactggggagtgcacatccaggccccagcccacagtgatgggctcggaggctcttctgaccatctctgagcagaggcttccattggaactcccggggctgactgcaatgcaaaattaaaagaaggggaccccgatgggcacagcctcaggtggcttctgtctcggaagctccttgtgcgtgtgtgaaatcctgaggtgtgagctgtggagccgtgcagagtcctgcgtccttctgtccctgctggccgcccagccctggctgggtgctcctcctttgtagcaccccagacccctctgacaagggtccccacgtgggctgctgctggggagtcagtcattccctcctgttcccagccctgttctcggctgctgagttagtcaacgtcagcatcaatgctgaaactgtgtggttaacatagaaatgaggaaaaagacataaattctcatggggcattttgaaagctgacctcaccccttaaagtagccacaccccatttcagaaatgcctctgctagttcaggcctggactccctgcacacaggtgctcctgggcacccctctctgcccccaagcactgggatggagcctggagcctagacccttctccctgctcctgggcctcatcctcccctccccagggaggggctgggcactgggaacctcaggagcactggactccctgggaagcctctctctagtgattccagcggggcctctttgatgttcctagctgggaaagccaaggtctataattaccatggccctttcttctgaaacaagctccttcattttgagccactcttgtcagcatgtgctggcgttcatttgcaaatgcaccttgctatcgttttaaagcaaaaaatgcatttcaagaagcaccactgggccctttgccatggcgtttgttaacgttattaatctgatttaaatgaaaattatcctttatattgcttcccacataggcacactttttttctctttaaaattggaaggttataccaaacgcaatgttttcctttcctgcaaggatgtgtggggctgttttaatacagattagtgagagtgcagcagcagggcactgtaggtggtgaagcccggttatcatgtgtatgattagtttcaccttgtagctatgtctctgaaaatgcaattaacagtttcatattcagcgtagccagcttttattcctgccgcatggtgtgcaacatttgcatcataaaaaaaacctaattggtaaacacggtcttgccagcttctctgcgatccacccaattctctccacgttaattggctcagcttcagcacacgctggatggaatttcaaaggacgccgcagattagagagctggcaagcacttgtgtttcacggaactgactccaaggagactcggggaaaaatattttaaattaatgccaattgcaggcgacttgcttgtccaattgttgccatggagaccgttgggtctgctaatctgatgggtgtgtgtgtatttattgggatccatctctaatgaccttcagagaggaagtcagccatgctgggctccgcgcctcggacagggaggcccctgagtggccccttctcgactcggcccttctctggtgactttcttacactcacagcccactccccctcgcccttcagccaggcgcgtctgtgctgtgggcccggcggggcacaggacggggtctaaacacacacaggccacgcaaggcatctgtggcttgtgaagtgtgacactctgcccgtgtccgtggggaaagtcatccggacctcccgagccctgcccatcctccccacctcccttgtatgagagactcggaatcatcagggggctcctgaaatcggaagcatcgttttttctctgagaggcatccgtgttgatttgctgattacgagtctgaatgagagttcttgggagtggctcttattccctgaacgaggaaaaacagcgggtgtcaggccatgcactgtgcgtgttttccaccgaggcccccagaacctgaaaaggccacgcaggtgacacactgggaccccacagccgtccctgccacgtgtgaggaaagacatgaaacttccccagggacgtggctgaggctttcttagcggaagctgacccttttgttccccctcctcctcgatcgcggcttccgtgtctatttttgtcttaattactaggctgtagtgaatggatgtgtttcccttagtgttggacctgggaccattagacaattgtaatagacagacatgtttgtgatttgttttgaactcctaataatagctggttgcttaattgcagaaaataggaagaaagacctcgtacgttctctgctactggcaaaaatcagttgtctttagttaaaaattaacaatatgaactgctggtgagtaaagagaaagggctctgctttcccctgaaagtggattccagatgcacatacaggggtgaggggcgggggcggtgaggacctttctgtcttcctcccacccctccctctatctccctctctccctctctccctctcttcctctctctctctctctcaccacccctcctctcactttttccctctctctccccatctcttctctatttgtcacacattaactaaaaagacctcagagtttttaatcggtagacaggggatttgttcattttaggttaaaaacaaaatgaacaatcagagaacaagtggggaagagggaactaaaggtataatggcttagagaagttcaaagatcaacaaccaaatcactagattcaaagattcaacgtggagtagaaatgaggcacagactggcactctgcagtgctcatgaagaaaggtcagctgaccgcctagaccccctgggtatctggagctgaattgtttccctctgctctatctgagcctctcatttcagcaacccacttttatctgagggatttgcaagatacaagggaagaaaaagagagacaaatgagagagcaaaaagggaaaagatgatattcaggagaagttcttattctcttaaaaattaggaaatgaaagtaagcttttgcactaaaaatacttgataaaaacaatcaaatcttttttgaaacaagaggaaagacagatggagataggtaggggatggatggatgaatgaacaggtgaatgggtgggtagatggatggatgtgtggtggatggatgtgtgggtatatggacgggtggatggatgaatgtgtggagggatggttggttgggtgagtagatgaatgggtgaagagatggctggctggctggccggatgggtggatggatggatgaatggagggacagagggagaaatggatgggtaaatagatggatggatgatgaatgatggatgatggatatggataggtgggtggatggatgagggatgggtggaaggaggaatgaacgggtgaatgggtgaaaagatggctggcttcctgaatggatgggtaggtggatggatagatgggtagttggaaagatgcgtggatggagggatggatgactggatgaacaagtgaattgtttgatggatgggtagatggatggagggatggatgaatagatgagcaggtggattgtttgatgaatgggtggatggatggacgaacaaacaggtaaagtgatggatgtatgggtgtgtgggtagatggatgctgaatgatggatgagggatggatgggtggatggatgctggttgatgaatgcatagatgagtgaatagatgggtggatggagggatggatggatggacaggtgaatgggtgaatagatgggtggctggctggatggatgcatagacaaatgacggatggggtagatggatggatgaataggtgagttggtggatggatgaatgggtgggtgattggatggatggatagagggatagatggatggatgaacaggtaaactggtgggtggatgcaaggatgggtgggtgagtgggtgggtgggtggatggatgggtggctggctggatggatgcatagacaaatgatggatggggtagatggatggatgaataggtgagttggtggatggatgaatgggtgggtgattggatggatggatagagggatagatggatggatgaacaggtaaactggtgggtggatgcaaggatgggtgggtgagtgggtgggtgggtgggtggatggatggatgggtaggtgggtgagtgggtgggtggatggatggggtgggtgggtgaatggatggataggtggatgagtggatggatggatgggcgggtgggtggatgagtgggtggctggctggatggatggatgggtgggtgggtgaatggatggagagatggatgggtaaatagacagatgatgaatgatggatgatagatggattgatagatgtatgatggatggatagatgggtgaatgaatggatagatgaacaagtgaattggtagattaatgtatgtttggatagatggtaggtcaatagatagagggatggatggatgaacagatgaattggaggatggatagatatatggatgggtagatgtgtgggtggatgggtggatggaaggaaggaaggaaggcaggctggagggatggatggagaaatggatggatgaatggaaggatgtgtaggtggatgatggatggatatatagatgaatggtttgctggagaatattcagcaattgcaatagctctgattaatgaacactctcttggaaacttgccaagtctgtgcagggagctgcctggctaagcaggaaaagaaggcacagggccatgattctgaagtggaattcaaggaacccagtatctccctcaaggagcctgctcttcagcttatggaagccctcctaagcttgagggggtaacattaacttttctcctttatggttgattttccttcagattcttacaggtgttcactggccttacgagtcatatatgagaggacaaacatggaagtgcttggcatcccgcctgtgggtggaaggatgggcacatgaacttttctaaatctctacttctgtctgaccacctccactctccatggagatgtggctgagcctaaggtctactttcctcttcttctggagagatagaactgagggtttgatttgggtcacagtcacccctacttggagtaaaatctgcatttgccagctccctttcatctaggtgtggccagtggatctcagctagaaggttaggtatgtgcctttgctccttcatttctctttctcatccctgctcttggaatgcagatgtgatggccggagctgatgctacaccatggtccaagaggtgacctgggaatttcaagaggggagaaaggagggcttcatggatgagtccccatattagccccgacctgcctgctttcacatttttatatgagaaacaaatgtaccatgttcttcaagcggtggtaataagagctggtgccagcagaggcagcagtccagggccactgcccatgcctccgtacccactccaagtcaatcactggacatactttttaacaatcttctttctacgctttgtgaattttggaaattcttccatacagatttgttactccttactttaaaatgttcttctgtggcttactaaacactatggattttttctttgaaatatttgccgtctgagtgatgtaagcttgctggagtcagtctcaccgtgatgtggtgtgtaaagccagcgtcgtgtcatctatgtatcagcccccggcagttcccccttcattccctaaccttttacctattcacgcactcactgagcagattgttttaaacatctgcttccgaaaggcacgtgtcagacactaagaacagtgcacaaagatgtgtggttcttgcccccaacacgtgggactctctcagccaaggagtgggagggagcagttatccaacaatttcaggacgaatggctctcctacaaactcgggatcggggcagcttcatccacattcagaaaaggatgctcttctcacccaagttgattctgaagtctttggtgagttatggaatatttgatctcttattgttgtagtttttcaaccaaaaaaagaaagaaaccatgatttgaccaagaaagaactgtggggaaaaagcacctcagtgtaaaataacaatctatgaccaactaatccagctggattttttctgagtaagattgttctttttctctttttaaaaacaaaactcatctcgcatatatctgctctcactttctctgtgggtccgagggaactcctctgtgagacagaaaattagatgacagttttttcaaaccccttgtccccgattattagtttgtaggataagttcccaaaaaccacagaggggacaaaatataaagtgtagtttcctactttcattttcactttcagtgttatataattttatatcttcctttgcttatagctccttaagaacctaagcatcatgatatgttcttaatttgtaccattttctaccacttaatatggtgatcgtcggtgacgatggtctgacggtttgggggtttcttttaaacatgtgctccctcttctggttgaatggatgcttcaaactggaatgaaatcaaacacctgtgcatcttttgtgcatctttgattcaggccattggtatttgttaaaatcataagggattttgaaacaaagatgatagagaagaggcctctaccaacttttaacaatcaccgggagacatagactctggcatgctcttttgtaaatttccccttctttctatgttgtgagaagacgggctgatgtgaaaaactttcacagcatcaaacaggcacatctgatgtctttagcaatgacgtacagacccaggtggggttttgtgtgggtaaaatcaccgcagagatcctagcagagaccactctgtcatctgcacaccttcctgtcatttgtacacctttgtggtgtttgctgggatctctgtgcaaggtgcaaggtgacagtcctatttcaggattccgtctgtgtttacaaactggtaacttctaaaaccttctccgtggaggcgattgttattctaagtggaaagatcttgttaaaatggggctcttcctcccctgcccacctgggaccatctggagtggggggagcagacccactggtctttgcagcatctgaggtgctccatggggggcccaaggcctcactgaaatttaaaggaggagtcttagtcatcaggaataaattaacttttgtttactgtgtgtaaggcagcagagaaataaacaatacttttttaaaaaatagactttttaaagtatataaacttctcatactggtgttatgtgggtaagtttaagttaccctgaaaatatatttatttggaataacttttactggtgctatataaatggggtgctactgtatcttccttaaaacttgaatttttttccatagtttctcatagtttcaagatttcttcattgcctgttagcctaaatgcacagtgggcaggacaaaacagaactgatgtttgtagaagtagctggtcagtggtgtttctgaggttttgagtaaatccatccatcttggaattcttactttttcaagtgtagaaatgatgtagtgtgtaccccactgggaaccacccaatgctgttaacacacttttaaacacaggttatttgtgtgtctgtgggttcactctctagatgtctctgtagcacctacaacgtctgaggcctgaagtaggtgctgagctggtggatgggtgagcagaggaaggaaaggacggacctggaggatcctggccccccaggatctcgtggtagtggaggaaaatgaactccgtcctcccgtgttgaggctttaccttgtgctgagcttgctgagggctgctggggatgccggagtaagcagggcagttcacacaggcccctgcctcctccacaaggacagggacaagatgaagtgctctacggggtcctgcaggggcatggctggaagtgagggtggagggtctggggcaggcaaaggccagcctggtcttgaaggatgggcgggagacagtgcctactcagtgggtttggctggtgcccatggtggggcaggatggcatggggaattctgggaatggcgtggcgtagatcagtgatgatgagtgtggaaatccaagagtttcaagtgtgcagtgagtgtgtcattagcaatgctcatagatccaaatcagaaatttaaatgcttggttggtgttacctcgtgtgctgtttccaacaaagctcaaagattgatctctttatcatgtgctatatacccagaaagagctgtgcccaggcaggaaggaggtttggaactcccaggataagctttgctttttggccagaatttaaatgtgtccttatactcagcttgatgtcgtggtttttatattaagtgggaaaattttactcatctaagatttttgattaagattatccaattattaagaatcctggccttatcattggaaacattttatctattatatttttaatatgctgttatttacaaatcacatataccaacatttctctcatttgcgggttctgcttgtacatgctgaatcggcttcatttgcatttaaaataagacactatctttcccatggataagaacaagttgctatgtagaatgaagacttcttttgggaaattcttggcaaagaacctagctgagtggtgacggttaataaatagcacgtattgtgtataatcgtgcctcagaactgcttgcatttgaattgggtggaagcagatttgatcattgatcagagcgttttcaagtccgacctggagagtgagatggtgaaatgtctgaagcgtcgccttgtgcatgggaacctttgcaggttcactgagggggtcggtcacgggcaccaggtggggcctcctggggctctgttcgtttggacaaatgagaagaattcctgctatgcctggtggaactgatcacataggaagctctgtgagtgcagtgacctcggggaagtgcagggagtgcggggagctagaggcaggaagagcatcttggaaacaaaggtgaaaggagaaagcctgtgtctcatttcagaagaagtctgagtatatcaacgtgataaaattgaacagtaaacatttactcaccacatttagtagcatatgtacttagtaaaactttttaaaaaacaaacttacaatgactagaccatgagaaagacagacacgtgcgtggaagagaagatagaaagaaaacggtgatactagagtcactgaaattctaaacattcgttagaggcccgcatgcgccaagcgctgtgtgaagataaatcacaacgtggccctgaaggtttaaggccccatggagacacgtcactgctgcctgctggtggggggcaggctgctgcttttggaatgacttcctttattgttcaggtgcaatttgtaaaataaataagaatcagtggaagacaaaaatatgaaataaatgctaagctgctctttgatagtgagaaagcacctgagggtgtttccgccgtgtaagccgccaccacgcgcgcgggacaggttcatctgtttatgaggaaggacagaactgagttgaaatgcacagacctggcggggagcccccgcggccttctctgtaaacaaagccctgcgttttggtgtctcactcctgttttctttctcctgaaaatgaaaataagaatgggcaattattccatattttcccatcatgcaatcagtagaaattttggtgggtgtaatcattgattcatggatccgttcattcctcagaacccatcaggcagtgtgtatgcacatgcccacacacatacacgtgcaatgcacaccccacacacagcacacccacacacactcacacatgtgtacatgtacacacccacacacacagcacacccccacacacagcacacccacacccacacacagcacacccacacacagcacacctccacacacacccacacccccacacacagcacacacactcacacgtgcacaagtacataccccacatatacacaaagcacacccacctacacacccacacccccacacacagcacagccacacacaccctcacacacgtgcaatgcacacaaccagatacatacacacacgtgcacatgcatgcatccacacacatgcagcacacacacacccacacacccccacatgtatatacccacacacatacagcacacccacccacacacagccacacacagcacaccctcacacatagcacagccacacacaccctcacacacatgcaatgcacacacccagatacatacacacacatgcacgtgcacacagcatagggaccaggctgactgtgatacttttctttctagccccttcctgtccccttctgtgtcttcatgccttcatcagatgcacctggcgcttcctccacagcagggccacatctcatcaccaccggccatcgtccgctctctgctccctgtgggaggtgccctgtgaggccccactgccctccgtagtccctgcgtctgggtcccctccatcactgtcacaccctgtgatcactctccccttgtcctctctccttgatgtggccttggtgttgggtgggctcaggtgaggtttacgagaagcaaaggaaatgttagggccaggacacctcctgcctctgatccctcgtcccctgcttacccttcctgcccacccccagcaccagccacaccccgcactgccgcagctccacctgggatgggctgacgtgtgttccccaagttcacctgggaagcgccaacacccggggccgcataaggcgactgtatttggagaaagtgtctttcaggaggcgattgaggttatgtgaggtcgtggggtgggcctggctccagcaggactggtgtccttgaaagaagagacactggagaagaagccacgtgaggacacaggaggagacggccgcccgccagcctgcgcagtctcaggagaaaccgaagcccggacctcagacttcagcccccagaactgtgacggagtacatttctgttgtttgagccgctcaggctgtgaggcttgttagggcagccctagggagactagcaggcttcccgccagaggaccacacaggaggccctcctggtccaaaatgtcatgaccgcatgatggagctggggtgtccatggggtttcctgtctttgagacatgatgcgttacaggtttacttttggaaatgtgggtacagccagggtggccccagtcagacccaaacaagtctcttggcctaagggaccctgggcctaccttcctctgagtgacaaggacactcagcgtgcacagccacaccaggtggctcccaagccctggcatctatctccataggggtgggatggcccttaaggaagccattgccgtccacagctgcaaagaaatgaggttgtggaaatggcaagtgagtgataagtgtgtctgcatcccgggcggctcttccctcgccagatctttgcctggcgctgggactcacccttgctgggactcaccgcaggtgtccagcaagcttgtgaggctcaggatggcaggaggtcagctgtgtttctgggttgtcagggagatgttctggatgccaaaagaaggctccagggccagaccaggctggcactgaactgtaccaccatggaggagcaaacatgatttggactttccttggaaaagttggtaaaaatcgatggagtctttgcatttccattcatgctgcctataggatctgtctctctaaaaaggaaaagggatgtgaactcagtaattccacgaggaacacagtgttggctgctttcttagggtgtcacatctgcaaaactccgtaagttggttgcaggtgcctgtgctgccccaggagaggcaggaggaaggggcagcaggtgccccaagaagggagaggttcacagcagaagccttggtgaaaaggagctttgaacatgtttatttgggcagtggctgctgctagtaccacctttccatcagatttgacatgagcattccaaagaaattcagatgcaggcagaaacccctcagcctctaaggttttactttccttcatgatcccatagagttaaaaggagccgtgcagacttcccactctgagtgcactagagacacgcatttgcacacacgtgcattttagacgcagtgtactgaatactaacagcatccacgtaagatgtgtgcctcagcgtgcatgaggacattgctgtgggaaaccacggtgggcccttcctgtctcttctggggagaacccctcgtgggccacgagcaccacctgagccttctccagctgtgcagtgactgaccagaggcctcaccgcagatgcttcctgccctgcacctccccctgcaccccatcttccagctctctaagacaacgtggacagcaaaacgctgcagctaatcttattttgtgcatatcaagtgggctttactagcccctactttttaaactctagccagtgttagattagtgaattccaaaccagcttaggtcttttgcttagtgacctttctctttgcatttttttttaaagaaatcagcgaaagccaatagtaacctttccatattcgccaccataagctgcacccaccttaagagtgaccacgactgggtgcggtggctcacgcctgtaatcccagcactttgggaggctgagttgagcggatcacatgaggtcgggagttcgagaccagcctgaccaacatggagaaaccccatctctactaaaaatacaaaattcgccaagtgtggtggctcacgcctgtaatcccagctactcggcagactgaggcaggagaattgcttgaatccaggaggtggaggttgtggtgagccgagatcacaccattgcactccagcctgggcaacaagagcaagactccgtctcgaaaaaaaaaaaaaaatagtggccacacagctcagaccgcaggtacttcatgggtgccaggccgattttctcaagccggaaatgctgaggcttgtgaggaaagggggaggtgtgtgtttctcccgcttccatcttactgtttatgtatctattagcatttagcatttctacaacacacttcataccctaagaggttttaaaatcagccatcataaacattaccattatcatgagaggaacagaaacaagcattttaaagatgaaatttggcaaagtagaagaagattttctaaaaccattctttaaaaatgaactcagagtcacagaagtgaaatttacatgcatttgcttgaaggagatggtttgtaaaacctctgggaatcaaatactgtcatgaattttttaaaaaatgaaaaatttaggaagagcagagtatagtgggatcaatattttccatataagcacacatagcattatcagatcctgaaaatgaaactgtcaggaaagtgataagatgtgcctctttctgttatctcagagaaatataatgtaaacaagcagcaaacccagtgaaaaaggattgttttgaattactttttttagagtccactaaggtgttatttatagcaaaggaatgcatgcagttctttaaaaatagatgctggttaattttttaatctgctggttttttaaatataaaaaacctaaaactagaaccaccacccagctgtggacacacaggaagcatctgggaggggttaggaataaaattcgggtgccattgagggtagctctgagtcctggggccacacaggaagtgggcggttccctctctcatcctctgggatgggaggaggctaggatggcccctagaccctgcctacttctctcaggcagaaacatcatgtgaagtcttctttttggtgataaaacccattctttactcccaaattgggcactggaagcattaacagagcaatttttgcttttcctatcaccttagagagtcaccaagttttccaaacgaggagccgaaaagcagccatgggggctgctcccatccgagagccggagtcttctggaactcagtgaaatgaaacactggccaggctcccaaggtgctgacacgtttcctatactgctatgacagtagcaaatgatttttcgtagcttgtggaattgtaaatgaagtttgctgattaagtcggcaacagtgatgaaattaatagatgctctcagagtcattagacaagctattctttaaaaaaagcagaggcccgttttaccactggccttggcgtgttgggaggtgccgccaagcccatgtgagaagctcgccaccaccaagaaacctggatcccgccaaccgcagggctggagcccggatggcgtgcttccccacccctgtcagtcagctcgggtggccacggtgaagccccacaggtggggcagacatccatcctctgcagtccccaaggcctgggtctgggacgcctgtgggcagggcttgttcctggggccgcattccctggctcacggtggctgcgtcgtggccacgtcctcaggggctgtccttctgtgtagatgcaggctgtgtgtctcttcctcttcctgaagaacacaggtcctattggattggggccccctcaggacctcatttttttttttttttttttttgagacggagtctcgctgtgtctcccaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctgggattacaggcgtgagccaccgcgcccggccttacctttacctctttagaggccctgtccccaagtacagtcacatgagggttcagggcttcccctgtggattttgggggacacaggtcagctcatgacagaagccaaacatctcctgccctctcctgtgctctttcctcctcccctggatccaagcggcctgtagcagacccccacttgtgctgccaaaccccggccaggaccagggcactccatctcctgccaggagttccacagatgagatccagcccagccgtgtccacgccagggtggtccaggccagctccccacctcacggggcttgttgaagagccttgtgtggctcctgctccgtggacctgctgagctttgaggcagccgggagttcctccccggcaagtccatttctctcgctgcagctgacctgcccgaaacgtcctcagatctgcttccagggagcaggccccggccccaggattcctggacatttcccaggctccctgacccccgtggtgtccttcacatcctcctcttcacccctcagatgaaccctaagctccagggagggaggggcgcagtgggagcttttgttttctccctcatccacacctgcggcatttggccccgttgttccttcactgcatgctggccaggttgccatccggctcacgaggcgccgtccactgtactggggattcgggcaacaaaagtgactctccccaccagaggttttagtttacaacatttcccctcaccgtgaaactggaagctttttaggggccgaaactctgtggcactaatttttcatatgaccttctcccaaaacacgtccctgcctctctcatcctccgtagaaccaactcttaataaaggggtgagtgagtgaccatccagagcacagcctctgcagggggcgggtctctaaggcagcactcgcctgatgaccacgccgtgtttcccgcgggggctgcttgcctcaagcccccgctttgcacctcagttcccataaaagggcatttggtggtgagatgtggctcccgcctcggtggggggcagagctggtcagtgctggccatgggggccaccccatgtcacccgaggtgactccaagggaagaggcactaagtgccatttctgaatctgaagctggcggccatcgtctccactgaaacaacgtgatcccaggacctggagacagcttggccagcttccggctggaggaggatctccaggagtcccagtgcagcagcgggtgcctccggatgacctcaaatacgatgcaaccccatagtttactgagcacctcctcggtgcctggcacggttccgggtgagggcacaacagccagtcacgcagactcatgttcctggaaggccagcgggcccatgcctgctgtttgtgtataaacagatgaaaagtgtttgctaatctccctgaggcagtgccgggctctcagcacggattgggagttggcatcatgacagggcggtcctgaggctgctgatggttttcggccgttttaccatctactacactgcctgcgtctgtctgcatggtgggagcgcccgtgaggctgaagtgccgccctcccggtcctcaggtccccctgctgtgcacgtccccagccgtggactcaggccctgtggtcctgaggggtcatgggtataggaggtaggtttggaatcagctgtacctgcttccagattctggctctggcttttgctgctgcctgaacttaggcaaattatttaaggctccagcttcccattctttgcacgtgaactctacctctgggttgctgtgagtgtggagtgtggtcccctctgtgacatgcacagccaagagcaggcctgtgggagaaggccctctgctctctacctgtggccgaacctcagccccaccctgtaccccacctacggccagatcccagcccccacccttcaccccgcctgcggcccgaccccagccccacgttgcaccagacctgcggccaaaccccagccccaccttgcaccccacctgcggccaaaccccagcccccaccctgcaccccacctgcggccagacaccagccccaccctgctccccacctgcggtcaaaccccagcccccaccatgcaccccacctgcggccaaaccccaccccccaccctgcaccccacctgtggccagacaccagccccaccctgctccccacctgcggccaaaccccagcccccaccctgcaccccacctgcggccaaaccccagcccccaccctgcaccccacttgcggccagacaccagccccaccctgctccccacctgcggccaaaccccagcccccaccctgcaccccacctgcggccaaaccccagcccccaccctgcaccccacctgcggccagacaccagccccaccctgctccccacctgcggccaaaccccagcccccaccctgcaccccacctgcggccaaaccccagcccccaccctgcaccccacctgcggccggacaccagcccccaccctgctccccacctgcggcccgaccccagccccaccctgctccccacctgcggccggacaccagcccccaccctgcaccccaacttcagtcatgcttcccagtagacctcaaagccgaaatgtcaggcagcttcctgttaagaaataaagaggaggaggaagaaggaaaggtgtgcagggcgttagtggtgaccaggtgctttcatcccggcctctccacggctttcacgtgttgggtgattccagctgagaaccctctggcctgaaaccaagcatggccctggggcttttaaacccttctcttacgggccttggcaattgtttttgaagtgatcactttaaccttttgttttaatcctctggttattcccctgactggggaatgcaacctgagaagcatcctttggcaaaagagaagttttattagtgaggcaagcagttaattaaaaaaataaaaactaggttgggcaaggtgactcatgcctgtaatcccagcacttcgggaggccaaggcgggtggatcatttgaggtcaggagttcaagaccagcctggccaacatggtgaagccccatccctactaaaaatacagaaattagccgggcatggtggcactcacctgtaatcccagcttctcgcgaggctgaggcatcagaatcacttgaacctgggaggtggaggttgcagtgagctgagatcctgccattgcactccagcctgggtgacacagtgagactctgactcaaaaaataataatgaaaaataaaaaaaaaaagtaaaaataaaaaccagaggccaaagttcatcaggtaaacatctgagatcaagtgtggtatgtcggagctgcgaaccccagtctgcaccccacctttgagtggctgagatttaataaagtgcagtgaagtctcagacccacacccccaccttgatgtttccagttacggaactcgttatcaggtgggccagggactcgcggagaacagctgcagacagcacctcttccccctggtctcgtcgtgtggacgagtctcccgatgacaggtttcctggaggcctcatctccggtgggtgccagcaagtccagccagggagcaggtcccagaactcaggttcccaggccaagctttcccctgcctgtgttggtggaaaacgcagggtaagtgggcaagagtgagagaacacaaaagccttcagccgggtctttattgggctgctttatctttgtgtagctccgtggcacgtgaaaacgagagcgtctgaggttggtgagaaattcgggcagcacacggtgctcagtcaccatgaaactaatttcacattgggagctgagttgtgaaaacggttttgctgtttatttaaaggagatgagagtggacaagccgactagaaccccctgatggcttgagcgagggagaaggagggtttgtgttcaggcaactaaatctgccttctcttcttttaggctggaaataaaagccggtcagtgcaggggtgtgaggggctggctgtgggttctctggcatgaggctcacgtttacaggaggtcctcttggtgggcatagtgtaggggccagggcggacccctacggccgctcggaggaacagccaggatcggacccgggaccgccccacactgtcagcactgtaggggtcactgttgctgcagctcacagtcccctggcccccggatgcctcgcaccccgcacaaagatgacttctctacccagaacacaaccctcttacgtggggcatgaaggatggagtccagccaaacgtgcttcaaaatctcagaattacaacttgaagtagagttttttttttttttttttttgagatggagtatctgtcacccaggctagagtgcagtggtgcaatctctgctcactgcaagctccacctcccagattcaagtatttgcctgccacagcatcccgagtagctgggattgcaggtgcctgccaacacacccagctaatttttgtatttttagtagagatggggtttcaccatgttggccaggatggtctcgatctcctgacttcaggtgatccacttgcctcggcctcctaaagtgctgggattacaggtgtgattaaacattacatttactgagcttgaaatgtgaggtagcttattcggtctacatttagactctgtccaacacagcatctacgttggaggctggacacgggctcctctcacggcagagctgctgctcctccgcgtctcacgcaggtggtctgctgtcctcagcggatggatggcgtggtcagagcccaggagcctccgggccagccctgactgctgctcctggctctgagctagtgttttaattctttaattatttcatggctcttttcctattccacagaggagtacaaattaattatttggtaaggcacttaattaaaagtagagctctgaggctgccgggtaaaagctgaagccaggctgcagcccgggccctgggcctctcccttggccctgcagtccttttcccgggccctgcattcctctcccccagccccacactcctctccccctcgccctgtactcctctcccctgcactcctctccccccaccctgcactcctctccccccaccctgcactcctctccccccaccctgcactcctctcctctgcactcctctcccctgcactcctctcccccagccccacactcctctccccacctccctgcactcctctcccctgcactcctctcccccagccccacactcctctccccctgccctgcactactctcccctgcactactctcccccagccctgcactccactcccctgcactcctctcccgtgcactcatctcccctgcactccattcctccggccccacattcctctcctctgtgcaggggctggtctgggggctccacagggtccctatgacccactggtctctgcctgcccctccctgcactcctccccccaggctctgcccctccctggcctcctctttctgtagaaacccggctttctgtcatgcctccccccacgtttatctgcagggacattctggctgctgacgtggctttgcccacccagccaggctaatgtggctcccttctcctccctggtccttccctcttgagtgaggcccacctgtggcccttccagcccttgcagggccagtgtggatggcaggaatgactggctgtgtgggaggaacctgggctccaggcgccagccagggggatttatggaaagagcagccccctgtcctgaagtcaagggtctgtctccgtggccttcccaggacaggcaggaactgctggagggggtcctgccctgtggggcctgccccatccttggagctgaatgacccaggtgctgtgacctcagtgggagcccaggccaggcgggcccaggggcgcagttgctccacagacacagagcaaatggagccgccaggcagccccgcagggcacgtgggcactcaggaggcagctctgtgcagaactggcaggcatgacccaggccccatcagatgtgcccccaaccccgtcctcctggggagggcagacaccccacgtcaggggacctggggccgagccctccctgggcccccgtgccggcctcattgcactgtgggactgctcctcatgcctgttgagcagacagcaggacttagagcttggtgacagatgggcaagcaggcgacagctgctggtttccagagaagctcgtgcctccccacacccgccccgggcctaggatgtgtcagggaggttgggtctcctgagggcctggcgtgggggaagatggctcaggtcatacatggtcccctggggcaagggaaaatggtttgctaggagaagaaaagatccattctttatcactggatttgaaacaaaatgactttttttctttgcaagcacagattattttcaggagcaataaatgccttaaaaaaagaaaagctagagacgaagaaagctagagaagaaagctagaaggtcccctgaccctgttctcagttaagggcttgtccacaccagccagagcaaacccacaccaccctccaacaggcatgggggaccggccctcggggtggtgggagcccccatgtgcacgcaggagctgcccgccttggaaggaagggctctaagccgtgtgagagaccaaagctcccctggcactgactggcaggaaagcaaagatctatctgaccagtaggttctcttagtaatatttgttactgtatgaatgtttggggtccaagtgcggtcttactacgtggatctgttgtgtagtggtgaagtctgggctttgagtgtagccatcactgaataacatagatgggcccgagcggcgaattctcaccctcctctcccttcccagcgtcccgggtctgcagcgtccattgtcccatgtgctacatccatgcacgcatgtaatttggctcccacttaaatgtgtgaatgtgcagtatttgactttctgattctgcattgtttcactcaagataatggctccagttccatccatgttgctgcaaaagacaggatttcatccttttttatggctgaatagtattccattgtgtgcaaaagacaggacttcatccttttttatggctgaatagtattccattgtgtgcaacagacaggacttcatccttttttatggctgaatagtattccattgtgcgcaacagacagaacttcatcctttttcatagctgagtagtattccattgtgtggacacaccacgttttctttatccattcatccactgatggacacttacgtcgatttcatgttttgctatcgttccagtgtgcatttccgaagggtagtctacttttgcttaaacttgagtttgccgtagaagtcagatttccatggatgacccctccttctgcacctccacatgcacacgtggatcctcccctctgacaggaggtgctacgccgcctgctcatgtggacgctgaggcaaagcaggctgcccatgccctttgcggggctggcaagcccttggtccacacccagatgcacgttcaggggctgaaaggccccatcctactctaagactgcaggtttgctgccttccaggaatttacaattcatggcaacaaaccttggggtgtgtttaacaaatgctcattgaattgggcatttttatctcccagatgtggctggactggtgagatctctccctgagtgacaggcaggcctggagagagttggatgaaaataaaaccagatagaaaccgtagagtgtgacacagcgtttgtaagctggggacacagtgttgatttaggaacaaggagctgtaagctggggacgtggcattgatttaggaacaaggagctataagctggggatgcggcgttgattttaggaacaaggagttgtaagctggggatgcagcgttgatttaggaacaaggagttgtaagctgtggacacagcgttgattttagaacaaggagttgtaagctggggacgtggcgttgatttaggaacaaggagttgtaagctggggacgcagcgttgatttaggaacaaggagttgtaagctggggacgtggcattgattttaggaacaaaggagctgtaagctggggacacggcgttgaattttaggaacaaggagctgtaagctggggacacggcgttgattttaggaaccaggagttgtaagctggggacacggcgttgatttaggaacaaggagttgtaagctggggacgcagcgttgatttaggaacaaggagttgtaagctggggacacggcgttgattttaggaacaaggagctgtaagctggggacgcggcgttgattttaggaacaaggagctgtaagctggggacacggcgttgatttaggaacaaggagttgtaagctggggacgcagcgttgatttaggaacaaggagttgtaagctggggacacggcgttgattttaggaacaaggagctgtaagctggggacgcggcgttgattttaggaacaaggagctgtaagctggggacacggcgttgattttaggaaccaggagttgtaagctggggacgcggcattgatttaggaacaaggagttgtaagctggggacgcggtgctgattttaggaacaaggagctgtaagctggggatgcggtgctgattttaggaacaaggagctgtgggccaaagtggaaggcgctcgctctaacgctgcctcagattcatcccaatgactgtgggaaacacaggcatcttcctctcgctccctggtctctgtccttgtctaaattcccttccctaagatgtgttgtttgttttctgctggttattttctgtcagctttaagaggagaaatatgaggaaactttgctgtgctgcttcgtggattaaattaaaaaggaagcagtggcgggttaccattgccacccagtgttaagtggctcagagcgagtcacctgccctgacctgcatcggtattttctcctctagaagcagaccagtattaatggcctgtagtgaagtatcgctgtgtcaataatatttaaagaggaggaaaacaacgtgatacattaggtcttctctgtgggtttcaaagcaacacccaacacactggtcactgacacagggactttgcgataaattattcaagccacagctcagggtgtaaactgcagccgtgcattttgaaattaggcagtaaaataacagcattgtgtatgactccagacacgggcgcagggagacccagtgagctcagtgcatggggggccactgaccccccttgggttttgtcttccgaggccattggcattttagggagagatcgtccagctctgggcctgtctgctcaatcgacgctctccagagaggccttcaacccccgtagggtcaacactcatctcaaatcagagatttgaacttccgacctaggatgggttcttcctgctgtcctggacccgtgctgggttgggggtggctctccaggacctagctctgtggcccaccctgcccctctcttgcatgaaagtggagccagggcggggactcagggacaggacacctcccggctggccgacctctggctctccaggcctggcagatgattccgatcgccacctccccatgtttcctgagccctcatgggagtttctggaagcttcccactgctctttctcttctgtggttcctggccctgggtggacgcgtcatggaaattacatttctgaaaggggaggaaaaaaaagcacatggggtatgtcctggctctgaccaggtacgggatgtccccgtggggtctttttttgcggaggctcagggctgcttaggtggtttttttttttaatttcataaagtcatacaacctaggaaaaaatctattttcctcttttgtccttggtcttaatgtgaacacggacaggtacgcaccgatataggaaacctgctcttcagagaaatccgaatctatttacgttttgatagaaaatcttatgagccgcccataatatgttgtgggaaaatgagttagagctcgtgatcagaaaatggaaagttgcagctcacacctcaatagaggccacccacctgcgatgatcctcctgaagcgtggcctgtgggaggggactgtgacctgggcagaccccgtgggctccgtcataagggaacacctcccagtaagacgggggctccaggctcaggcgcccaaaccacagctccccactgggagtgacccggccgccacgcgtctgtctcctggcgtctgtgtgtccccttcaaggggcctgcgtgggcaaaactgaagatactgtctatgcttcctgagcagaaggagccaaaaggtcttcccatcgcatacttcttcttagatttaggcgtgggcagtgattccagctggactctggaggacagtccacaagctcggctgtcctgtggccacggtgcctgggggctcctggtggagtgtgaccccccacatctgcctctgctccctgctctctgttgggccaccccaacccctccaggggacccccagataaaggcttgtgtgcactggtgttttccagagcagaaaatcctctacagcttttgtgttttattttgttttgttttatttttatttagttctgtgtattctaatgtgttattaaaaccttagcaccataaggcgctgatttcaggagccctcctgttagaatgaggtggtgctgagagacccactcagtacagaccgtgtggccggtcccccaacctgccagctcttcccacaggcagaagctcagaggctgcaagggactccgtggccatggcgattccactcccaactcatcctggagagcgagagactcggggccatgagcagcccctctttccagagaacgtgtcgccatgcagtctttgatcacgtttaaatgaacaaaatttgggtgttttgttttcatggaactcacctttagggtggccttctcacagcaatgattctgcttttcatttacagtagtgatacacaattttccatgtattagatgatataattaaaaagtgaggctttaaaaacatactgagtgcctgacagctcgggtggcacatggggaccaccagtctccctgggcgaatgggctgtgggccgagtcccggcactcaggcgtctgttctcaaatactggctggagcctcctgcatgtctgggctgtgcctgtgctggcctgatggtgatggaggccctgactgtcatgcaggcctgcgaggggcacgggctgtgaccgatgctgggagccttttttgagccccgggagggtctgatctcactcctgctcagcgcttaggtgcccttggcctcgtcctgggtccccagccttgggtgcatcacttctgggagggtctaatctcactcttgcttggtgcttaggtgcccttggccttgtcctgggtccccagccttgggtgtgtcacttgctgggatctgctgagaacagccccgtgcagctctcaccccaacactccctgtagcccatctccacagatcctcactgggtcccaggcaggctgcaagtctgtgctagctccagggtttaacaggaaacaggtccgccctccctcgccctccctcaccctccctcagccagagggaaaccggccctgagtttctgtgccctgcacgggcagcacccggtgccaccagggctctgtgagtttccttcagtgaagaggacgtgtagaggagctgggtggggccaggactccaccaggaagtgcaggccgggcccacggcattgggttcataacaagtggcaagacccatttgtcaaagagaatctgttcctggttaggaaaaggaaacctcagaaatgccggccattgccctttttaaagtgtctctgtggcaggaattgtccgggtactttcttggggatccccttagccaccctccgaggatgggattgcgactcccatcacagggagactgagaaacagcagagcccgtcatgccccagcctgttgccctgtgctgcatcaggctgggtgcctctcagggaagctcggtcgccttggcttgtgacaggctggagcatatccagcagccctggcagtggagatagcagtgcccctgcatccacaccccaaagcctggcagtggagatgagcagtgccctcatgtccacaccccgcacaccttcagagtcagacgtggactctggccagggccagggaagttcgctggactctggggatctggggcacatcttgctggcagggttgacaccagcagctctctctgcctgactggagactcggcccccctccccagtcctcctcggtaagcgctgggactgggctggtcactcctgcctgtccattcactcacccactgtgcgccaagtcctccctcccactgtatcggagggaagctcggtgacattccagtgtcctagtccacgtgctttgtgccccaggcagccccagctcctgagcaccggcccagcaacatgagaggctgtttcctgggacttcactgggaaggggaccagcatgtcctactgtcagcaccgccctgagccctgacccccagcctgccctgctcccccatccaccgatgtctcctcccttgccttgtgtcgctctccccctgcccagaacttgccagaggtgggtgcagggcggggaccgttgggcatggtggcatggagtgtggcccaagccttggggagagggtgggtgggggtgccctgaaggaaggagaacctggatcccagaggacttggagcccctggaggccacccctgtgcgcaggtgccgtgatgcattcctggcccgtgcccaatctctgctgcacctgtccccgtccctcccctctgtgctccaggtcactcgcctgcttgggaagctgtgtcgctacacgaccctggatcctgcttatgatctgttgaactccacgagtgcccggtcttccccggtggcgctcatgaattatttatctgggcccgctctgccctgggctcgcactcacattaactcgtgtccccagctgcagcttcacctgggcttgttttcgtctcggtgtatttggagcgcagaagagcaacttgcatttttcttcatagagggatggagggcaggttttgttgagaaatacaaatttgatttatttccaagaaaacaacttttactgtcaaagaagggacacgaagcagctctgcatttggcagcccccagaagagttttctttgcagctaatgaggaggagggggagaaggcaggtcagcgcagccctgggcagggcggggtgggatgcgggggcagagaccttggccgagtgtggaaggaacacagccagcaggcgggggattgggcagaaggcctgccctgacctctcaatgctgcttcccttgagttacctgagccccggtttcccatctgtgaagtggggtggacatgacaaggatgtgtcattccggcccgtcaggtacccgaaggtgaggtggcacccgcccccgctgcctcccccagaccatggtgtccagcagaatcatggctaagcagccacgaaggcacccacccccctcatccctccaccccttagacgcacttggtcagagcggtgcagaaaggaaagggctacagcagccctcgtccctccgacccagccacagatggtgccccccacaagactccgctttcttctgccctctgagtcttacccccttatgaaaaccgctgtctttctttcttttctttttctcttttcttttcttttttctaaggtgtggtcttgctctgtcacccaggctggagtgcagtagtgcaatctcggctcactgcagcttagacctcctgggctcaggcgatcctcccacctcagcctctcgagtagctgggactgcaggcatgcgccaccacgcctagcttaacttttatatttttagtagagacagagtttcaccatgttgcccaggctggtctcaaactcctgggcttaagtgatctgcctgcctcagcctcccaaagtgctgggattacaggcatgaaccactgtgcctggccaaaaaccacggtctttcgactcagcctgagctgtgccgggatcttcttgcccattcagcctccagcccgggggtatctgcacctttagaatgtcagttccttagcgcagaggaatgtgttatagcggtaggagttcaggatttaggtcttgcctttttcttcatttaactggcatgaaagagacatgtttgcatatgaggacacagagggtgtccctgattttcctcaggtcacactgcccattcctggctttagacacagatgtgagaaggggatgcaccccaagaatgggacacgggtgtggcgatgctgcccagagcagccctgcccagggtgcagcccagcactgacattctgcaccccactgggggccaggaaacaacccctttcttgtaggtggttttttagaaagtgtggacgtgcatgacctgtggaccgggtcatgggcatttctcgcctgtgcatccctcccccggttccctccagcccccctgtgctccctggggcttgcagactgagtcttccaaagggtttgcacccgtctgactcactgttgttacttatagtagcactaagaagggtccctgattcatcactgttctgatgtacacacctgcccgggaatgcgtttggtgtgtttggtctatcagcacgtgaaagacagggaaccctcctgtggggccatgtcaagacgtgcaggcaggacactgtcctctgctctggaggttcagttgctttagctgggcccggccactgcaaaccagcctcaggagagctgggggcacgcctgggagttgcaacatgtggcaatttagggggaaatgagagagagagacagagactgcactgataattctccgtgtgaccaaagcacaaagaagcctgtctttgggagacaagctggaaatggccaggacgccagtgggggctccggggagagacagcatggtgttccctggtgctcccatggtgccacaggacatgcatcactcacagtccacaaacaattcgggaaaggcagggaacgcagcttctcctctccgtctgcatgaggcagctttgaccctggcttggagaagacaaaagggggagtggtgaggactccggtcccctgcatgtccggacagtgttctctggatccctgctgcagtaacgcagggaatggcaggtgtggggagagctgggggcatcagtgatgtccggagacccttctctggatccctgctgcattaacgtggggaatggcaggtgtggggagagctgggggcatcagtgatggaggtgtcagaagtgatggggccaccccactgggatgctgcattgaaaagcagattccctattgccctgaatgtcccactttctgcagaatggatgttcttagtcccccatccgctctgtaactgtggatcccacactgcataataactgccccatctctagagaaagactgatagcatttaggacaggcccgaggaacctgtattccaactgttcacccagtgtgaacaaaaccagcaggccgcttcctccagctattcagcatccagacataaaactcagcagtgggaccaggcagctcctgctgtccaccgggtctgctctgcccctgggaagtctcttatgcaagagataatgactgacaggtcatcacaccctattagtgaccggacactacgcccccattaatgacctgtcatctcaccccgtttagtgaccgatcaccccattagtgaggggtcatattgcccccgttagtgaccggttgtctcacccccactagtgactggtcatcacgccccctttccctttagtgactggtaacctcgccccctttagtgaccggtcatcttgcccccgtttaggttccagtaagctccacacagcaccttaccttaagggaggaagagatttcagaagcagatctggacacttcgtgcttcctaatcccaggaagaaatggaatctctgtgttgccgaccaagcgtgggcggcgtgctggggcagtgcagctgtttcatggctggctgtgaccttcacgggctcattccccactggctggtggagggggatcatcactccctagatgtgtaccggcagctactccagtgcatgaacccgttatatcctaaagcggggttctcctgggacacaggtgaaccccagcgtgtccagcagcctccctctcactgcggctatagctgataccgtgcaaatgaccccaaagtcactgggccccctcgctccagattcactctggagggtcctggaggaggggtggagtgggtcagaaaccggcagctcctgtcagtgggtgggcaccgaccacctgctccaaaatgtctcctctgcccagttacttccagtcctgccaactggatggtccttgggtttcattagttcttccaagggcagaaccccgtggaagagtgaagccttcattatttctaatttagcactattggcttgaatcaagcagtcctaatatcaaaccgtggtaatgctgagtgaatgggaattttgagtgaggacgaaaggaagcgtgatgtctgaatagtgcagatgtcgcagaaaggcaggcaggagggaaaggaccacagagaggagatgccacctgggagaggcaggcatggcctgtgcttggggagatggagacggatgcagccagttctgacctccagccccacctctgccactgaccacggtgaccacacacggggtgccctgcctctctgggcgtcagtttctgcgtgtctacaaggaagcaattggactagctgacctctcaggccattatctgccgccagagtccatggtcctaaagcgaagcctcatccgcttggcagtcttgcctgggtcctagtggtggagccttcacgttgcctcacatccaacagtgactcgtcagaggcagacatacttgctggcagctttgcagcaccctctccatagcttcccccggacatacgagagcggggctgtagatgagggtatctatctcatgctattgcctcactgagcaccagagaagatggtcagaacccctccctcctcccacctccatccatctggaagcaggaagtgtgtttgtgttctggcctttctcttgtcagtagtgagagattcgttacatttcaaccccaagcatttcacatgcggtggcatcttggaggagctttctaagcgaggccgggtctcgtcagccaggtgggctgtctggctggtctccctgctctcgagattcaaccccaagcatttcacacgcggtggcatcttggaggagctttctgagcgaggccgggtctcgtcagccaggtgggctatccggctggtctccctgctctccggatttggatgcatggtttccgtgcacctccctcaggagtttgttcaagagcagcgctggctgtgcagtgagtagaaaacacacttgctgtatctacacagagaagtttaaaagaacagaagaaggacagaggcttcaggaccacagtgatggatctgaggggggcctgaatcttaaaccctatccgtatagtctccaagcagggatcatatatggtataactacattttcatctctaatcactggggcggcatgtcagtatcttctctttctttcccattttgagtgacatagtgtgatatgtctaatgacaactagaacaaattctggtaatgaggtcaccttgggccaggatgactgtctgacggctgttttccatagaaattacttgtgaaggcacaccacacacacagaatggcttcctccaagtgtaggtgtcaacaggcaaatatgctaaactcgcaagatggaagtggcttgcccggtctctctagtttagaccgataaattggtctacattgagagagctgctgcttttttctaaaaaaagagtgattggttgtgattatttagtttcctccaggtgcacgctttttatgtggaatgcactggatggcttaaatgcaagtagggcccaaacatctgatgtcactttgttaaagggagtgttgagtgagcacagtcgacgctcccagaattgtggagaggatggctgcaggagaaagctgtcagtcaaggcccatgaaccaagaggagtgctagagaccaccacctgcaggtgggatttggaaaaggggaaagaagtgtgggcgctcagccaggggagtagcaccgggtggggagcagcacggggtggggaagccaggaggcctctacacagagagcctgggcctgaggccgacagtgaggggcaggaggccagtggctgaggcagggcctagtgcagaagtcaggggcagacgtgagtattgggctcgccacgtcctgtgactagggagcttctgcaggtctttagaagcggttggtgggataagagcccatgtcggggatgagctgcatgtggggagagctggagtcagggagaaaagtgaacagcctcaccgcgtggtcagctcgtggctgctgagcacagcccggtgtcagagagcaggactgagagtcagcttcatggagggcgcggcgggaacagcgccagcccccagcacccagcaaccatcactcaccactcacagggcccctggcattcacaccctggcctaggtttgggaaccttccagccagaaccggtgccgctggcttgggtggagcctggcgtgggatggggtggagcctggcgtggggggggtggagcctggcgtggagcctggcgtgggatggggtggagcctggcgtgggggggtggagcctggcgtggggggtggagcctggcgtgggattgggtggagcctggcgtgggatggggtggagcctggcgtgggatggggtggagcctggcgtgggatggggtggagcctggcgtggggggtggagcctggcgtggggaggtggagcctggcgtggggcggtggtttcaggtgaagaggactcaggcagggacgctggtttacacaaggtcattgttacctggacaactccctgagaatgatgagaaaatatgagccagaataaagaaggctgctgggttcccggctgtctccatggctaatgaaatgccattttccttcttggtgcttggctgtgcaagtgcaccctgtcaggcagattctccatctcacgggccccctgcgagtcaggaagagatgctcgcggcgctgggtgagccggctcctcctcagggattccagggaggctgcagggcttactgtgccgcagtttcagcaacagccccagaacatccgtgtgtccaggcaccaggacactagcgctgttggctcacacagccagacccacagcttttgagctgatgaactgcattacgtccagacaatttccacttaacagttgtccgtaacgctcctccctgggccagcagccacatgagaacaactcagcacagggattccagggactgggtcggcagcacggtctcaagcctacactcacaagctcacgtgtgcacacacacacgctactcctccggggcatgcaggcagcgtccctgagaatccctgcctcagactcactcccagggctggtggacacatgtgggcgggggcgggggaggccacagccctgaaagtcatgggttcaggtttcagctgtgtcagaagcacctggaagctggggtgggatgtgatcagcaccctcttcgtctctgtgactcggggttttgggggagaccccgcactctgcattcccctcctcatctctatgactcggggtttaggggggaacccagtactctgcattcccctcctcatctctatgactcggggtttaggggggaccctgcactgcattctcctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttgggggggaccctgcactctgcattcccctcctcgtctctgtgactcggggtttggggggaacctggtactctgcattccctcctcatctctgtgactcggggtttaggggggaacccggtactctgcattcccctcctcatctctgtgactcggggtttaggggggaccctgcactctgcattcccctcctcgtctctgtgactcggggtttgggggggaccctgcactctgcattcccctcctcgtctctgtgactcggggtttaggggggaacccggtactctgcattcccctccatctctgtgactcggggtttggggggactctgcactctgcatccccctcctcgtctctgtgactcggggtttaggggggaccctgcactctgcattcccctactcgtctctatgactcagggtttggggggaccctgcactctgcattcccctcctcgtctctatgactcagggtttggggggaccctgcactctgcattcccctcctcatctctatgactcagggtttggggggaccctgcactctgcattcccctcctcgtctctttgacttggggtttaggggggaccctgcactctgcattcccctcctcgtctctgtgactcagggtttggggggaccctgcactctgcattcccctccttggctctatgactcagggtttggggggaccctgcactctgcattcccctccttggctctatgactcggggtttggggggaccccgcactctgcattcccctcctcatctctgtgactcggggtttaggggggaccctgcactctgcattcccctcctcatctctgtgactcggggtttatgggggacgctgcactctgcattcccctccttgtctctgtgactcggggtttagaggggaccctgcactctgcattcccctcctcatctctatgatttggggtttgggggggaaccccacactctgcattcccctccttgtctctatgactcaggggttctgggcggtaccctgcactctgcattcccctcctcatctttatgactcaggggtttggggggaccccacattctacaaattctaacaacctccaggtggcacctggcgtaagggctgcatttggagaactgctgctttgcaaagcccttgaagaatgggctgatatgatagggaactggtgttatattaactcaaagccttcacatcatagcttgtgcctttccgaagtattgctaattaattaacttggaaacgcccaagggtcattttagatcaaaccttattttatgaaatagatgtaggttatgagccaataaaattttgatacattgaagtcattaaatcatttggtacactgagttattttttaaaataaagtaaactgaattactacaaaaaaaaatggaatcactccctgttaaattaactgaatgaaagggaaaagctccttttaaaacaggaaagaaactattgtttttactattttatcaatgactggagtcaaatttgtgtgtgtgttggtgtgttgaatatattgattggtttagttgaagttgagtttcatctgtcctggaatagcaggagtttgagcagtttcacccgtcccggaatagcaggagtttgagcagtttcacctgtcctggaatagcaggagtttgagcagtttcacctgtcctggaatagcatcaccgactatggaagccttctccatgtctcgtccacacacattattgtctaaatggttctggtgacaccactgtctgcagttcctctgaatttgtataaggaccaagaaatgtgtgggttcttgcaaactctgaggtcactcttagggtaaaaggctgtttatccactcaactttggtatatgaggagcctttctgcaagttactgatctaactgtgtgagtgcctgacaacacagccagagtgcgcagggcatcaccagtgcccgtgtgggaggcggggctccgtgggaactggctacttaccccccacctgtccccagagcccgtgtgggaggcggggtttggtgggaactggctacttatccctcccctgtccccagtgcccgtgtgggaggtggggcttggtgggaactggctgatcatgtcacttctttaagcctgggtttcctcaggcttaaagggaggagcgtctgcctactttccaaggctgtgggcagatgtgatgctaatacaatcacgtagtatcttttatttatttatttttttgagatggagtcttgctctgttgctcaggctggagtgcagtggcatgatctcggctcacttgcaacctccgcccagccaggttcaagtgattctcctgcctcagtctcccaagtagctgggactacaggcacgtgccaccatgcccagctaatttttatagttttagtagagacggggttttgccatgttggccaggctggtctcgaagtcctgacctcaagtgactccccacctcggcctcccaaagtgctgggatgacaggtgtgagccaccgtgcccggccaatcacagggtatctatggctgtatcttatggctgctcagtcctagaagtttcttttccaactccgacaaatagctggagtaatttagtttggctttgaaacacttgactgaatttctaagatatttggagaatgttcttccctgtaagttgacataaaaagagacagtggtttaagaactttcttactcagatgcagagatactgaattaccctctggtgtgcagcctgcctatgaagtttgcatctcagcctgcataaaatgaataccctgatcaacaagttcctgttttgcagagaaacctcagtgatgtaataatatggtcatgatttccatcagtactgaatttttaccaagtcatcaaaatgtgatggtcactgaaacttaatgaaatgaggattacatttcaaagactaaggagtcctcagtgattatctttatgaggcttttgggggatccttgtattgctgaggaaatagactctattagttatctgatgctatacaacacactaccccgaactcaccagcttcgttcctgttgtcacagatcccccagctgcccagtcgggggctctggctctgggactcacatgagggtatggttggcttgctggcctgggctgcgattgagcaggaagctgagggacctcttatgcctgtgcatcacgcactgtattctatgcaacggatgcgagtcataaagtccagcccatacctccaaggaccggcattcagcggcaccccctgcagagagcagaatacataagcaggcgttgtcagccaccgggagcaccagaggtagataaaggaaccggaggcagcgtcgctctggagccgggctgcatggctcttctgtgtagtgaccaagtcatctggaccagctgcctcagtttccctatctgcaaaatgtgggctcccatagtgtctgcattagaggactgtcatgtgttaaatgtgatgtgagaacttagaatcatgaccagtgcatagcggacactcagcaacgtgcagttgccagtgtcaccgtcatcaccaccattgctgctgcagccacagcgacgtgaagtgttttctcagatgtggaatgttcttaactttggtggtttttccagagaaaaccatggattaaaggataatattttctaaactgagagttagcatgtctttctattgggaatttcattccctgataacttaagcaatgtcctctcatctccttcaggtattttgaacatttaaaacatttttctttttttttctatccattcagcagacattcattagccatctgctgtggactgggccctgtagtaggttctggttgtacacagaaagagaaacaatccctcctgccagggccgcgggggcgatgggagatggcaggtaggcaaggccaagcaggtgcagtaggcctgggggagggcggcccttggtgtatgcagctctggatcctggccttgccagtgctctgcagagtcaactccagagagccacccccctctgggccttccgctgggcaggtgtcgtagacaagaacatccagccttgtgagtcgccaggaaggcccaggggatgtctttctcccatcatggcgctatgcttcctggggtctcgtctgtcagccccacgagcagtgaggttggccccaaaaccaggaccgacttcaccacgaatgcaacctcactgtgacagaaaatcaggggaaaaggcttcccttgaggaagggaacagaaagtgtgcagtcccagagggaagtgggggagctgaggactcttgttcagaaagaatcatcactggggacccctgagctggatcagctgctcacctctgagcaaagtctagttctggcttctgctttcatgagtgtttgtgactttgaagggtttgttaaagatgccagcattaagaccttttcattattttcacaaatgctgtagctttaggtgtgaatgaatggacttgccttgccagaaactgtcttgagctcaaaagctttcaaaagagtaaaagactcagagcattgctaaacaatttcccgaatggtccctggctttgcttaggaaggacgtgaagccatagtatcttgctgtgtcttgtctaggaggaagtgtttggctcttgaaaagaaaggccaaaagacatgcggtcagcataagacgtctttgcaaagccactcctgacggcggagatggcggcagcaccacacgggagctgtttgagaagcagatcaggcagagtttcaccgatgtctgagagctagtttcacagccctgtgccagaggagccgtgtcttccacaaaacacacctgagagctggtttcagactttccgggaaactgccctggcccaaggcatctgtaaacctcttttatcctaattagtggtaacaattcaggtccacctgacctgtcattggcctttttagaaaactccttggtatttagtctgtagatgtgcatgcgacgtacagggagttcaggatctgttgtgggcctagttaccaaaggtgcctgagcctgctgcctgcggcggtgagtcctgccggcccacagacacatcgggaagctgacctccttccctcctcctcagccacgactcttgtcccagctgccaccagtcttgtcagggtgatcccccttcctgctcccccagcagcagcaacagggagctcttaggtgtcactagatcttcaagtgtccctgctgcagcctctcgagatggtaccagatcctacctctcacttcctcccgcccccacctcccctgctcacaggtactggacagagcagcattctctctgctccctgaacatgctcaattcatcccacctggggccttgtacactactccatgaacacactcacgtcatcccacctggggccttctcacgtcatcccacctggggccttgtacactactccatgaacacactcacgtcatcccacctggggccttgcacgctctgggccctccacctgccaggcacaatcccacatttgcccaggtggctcttggcattcaggcatcagcttgagtatcccctcaggagacctttcctggctcccagatctctgataaacccctcccacccctgtcactccagagcacattaacccctcccacttgacgcagagctcagagccctgatcagaaatcaccttgttcattgaatttggatcagtgccaccacagatggtgagttccatgcaagcttcatggggcacagccaccctacctgtgggtcacaccagggagtccccggtgctggaacggcacctgtacgcaataggctctctacaggtgtgcttaatgaatatgcatttcgttaatcagttaactaattattagattcatggactattagctgtggttcctacccttgcatctgttttattttccatacctactcatagtttttcatggaaactactgtgtttatggcttttcataattacatatacctctgaaatttgacgaaatctataacgattcctggcatgacagctatctttgttaataaacttcgatttgattcaacttctcttccactatgcctggctttgacgatttgggagcttaagcagaagtgtttatatcctctgtgacttagtaaaatgctaccacacctctatacccccacagtttaatatcaacaagacaacatgggcttaggtacatttaaaaacaaaatattacttagttttgtgatgaattacagtttgaagagtgtaccttagttatctgctctaggattatttaccccaatctgcggcacaagtccacggctacgtgcaagcatggtcggcagacgctggaggcagggagagggatggaccagtttgcgatcttggaggccccagggtctggtagggcagccgcacaggcacatgcgtgactatcccaggaggcagcacgggaggcctcatggtggaggctccagtaaggtgctgggcagagtgggcgagaacctgggaactctgtagaatgaaggggtaattggtggggggggcttgcatctggattttaacccatggaactgaggaagaagcctcataactgaacaataaagagaacagaggccacagaggagagtgccagccggtgctaggagcaggagaatgcccaacacaggaacagccagaggagccgctgggtctcaactctgctggaactcggctgccaggctgagcaactcatcagcgcctcctgggaatcgccgagcacctcacatcagagaagaaagatcagagcttgattctgggaagattcgtttgctgataacgcgatgggaaccagccctaagctgccatggccctggctgaggcccctttcccggcgtttcaccaggacatctgagctggggtggcttttgcttccagctcaccttgtgctacaaggacttggatggtgagcactcaggtgagggagggccctgtgctgggctgctgcccagctctgctctgccatcctcgacagaagttccctctctccacatcgcatggggtacaacaccccacctcggccacactgctttgtccaaagcctatctctagtttgtggctgtccttggaccaggctcagagcagctggacctccaccctgggaactcctgcagacaggcattgtggttgggaccctctgcatccccagtgcccagggcacacagtaggtacctggtggttatttaaaggacatgcaatggaaaaaaaaaaaggtaaattcacatggaaaagacagtgaggttttagactcctttgaacatgaataccagacacggagggcaggcaggggctggtggggctgatttatgccaagcctggcaccaagggctggcctcatccttgaatctgacacccatgtgacatctgtgacactcactgaaaagcacagttcgggtctagggagctcgcccaagtttgtgtagaatgaagcacgtctcctcgtggggccgtgggaatatgaatagctgacagctgaggaatgatttgcctgcattcagggactcctaggtgcctgacccaggagagcaagaggacacaatggtgacctgagccgacatcacagggacgaggagattggggtgtctggagatggagaggctctcagacatgaggagacaggggctggcatccagtccttatccgaaagtacaggattgaaacttgaaggaaatctgggttagagaaacggatacagggtgcagatgctcggatccagtggttggaatcatggggtggacaagagagtggacagcagtgttggcaggaactggagggccccagcgtggacagcagtgttggcaggaactggggggccccagaaaggcctaggggaagccaagatcgaggtcccaggaggaggagaatgtgctgggcctgggctgcaccctgctgatggaggcagggtccgggccaggcctttagtgtgagttcttatccagaaacaccctctgctctccccagcccctcactagccctgcccagaggtcacaggcgtcaggaggcatttctgactagggcttgttccataccctggtcctctgctcactcccagacatgtgcgccatgatggtgaacatgcctgaggggctggggatggacgtgggcacctcttctcagtgcccgcccgcacagctcttcacccacagacactgcgcccacttctgccctgtgtctacacttgccagaccccccaccgccctggaaatttgcaaatccaccatgcccagcaacacctccccagcacctgacccgctacctgtgtcttcccatggagccctgcccaccccagcccctgccctctgtgtcttaccacagagccctgcccgcccctgcccaggctcccactgccatcacccgctgaggtctgaggtcccacccacccctgccggctgagaccagagatgtccacgacaaggcatggacgagcccccagtcacatcgtcccatggcaggaccgacggttcccactgccagtgaacactgttcttgaggcttcactctgtctctgtcttctcgaagtggacccactaactccacagtagggcagccccatgctcccaaggtgccacagggaatcaagggcaggtggaagggccctgtttgaaattaaaggggatttccccgtgagctggggaggagccccgtggaagaccttgtgggcagggtggcccggctggagtggcaccattgacaccgtgctggagatgagaaaatgctagtgggaggcaaacagacttgactgcagggtcactctgcacatcaaccagggtgctgtccattctttccacaatgatcatcgccggatccgcagggccggcgctcatgacctgtgcagcgtcaacaccgccaacccaccgtccagcagtgcaagtcaggcagctcagcctgtgctccatgttatggccacacctgctaccccgccaacgtcaacagcagtggtcagagagatctaatataaatgtatcatttggcattcactctggaaggaagctcaccaatggcttgtaacaccactgacaatgaatggagaaatgtgtttccagtccccccaacagaaggaggacagcgcgagaggccacttttcataccctgtggttccagtccaccctaacggaagaaagacagcgctagagactgctttccatgccgcgtggtcttctaaaagcatgctatttattttatctttgttgctatgctttcatctttttaaattttacattgccattacaaaaaatagtacagattttaaaaatcttacaacagtgctttacatcttatatcttggccattacctgaaaattagggctttgattcaaggagagccatctaatccagtgaggccatcctctgctgtgcagaaggatattctttacagggtaagccccacccggctgtggctgtgtctcatgtagacagcttgtttggctctatgcacatctttctctaagacctctgattatttagcaaaattatttaaatggtgtatataaatattggaaattcatttccctcccatcaggaaaatgacataagaagtctgtggatgtctggaacttttaaatattgaagagcctaccccctgttatttccccccaccctttccccattcctccccacagcatgctatttgttattttacatctgcaggttttatgtggttctatttggcctttaaatcctgtgtctgtcctatcagcccatgaactaaaggcaggccaagtagggctgtcttccccaaaactgccagcaaagctgcttcatccctcgaaggcccctgcacaacctcctcccacccactgctgctccagggcatctcatggggcctctcctgcaggccagtgaggccgctgcagcccagagtgcaggcttatgtcacccctggcttcagtggggccctgctatcacagtgtggaattcctgaggtctctgaagcctgttcttgtggtgtggagttcctgcagtctctgaagtcctgttctcgtggtgtgaattcctacggtctctgaagcctgctctcgtggtgtggagttcctgtggtctctgaagccctgttctcacggtgtggagttactctggtctctgaagccctgttctcgtggtgtggagtttctgcggtctctgaagccctgttctcgtggtgtggagtttctgcggtctctgaagccctgttctcatggtgtggagttcccatggtctctgaagccctgctctcgtggtgtggagtgcccgtggtctctgaagccctgctctcgtggtgtggagtgcccgtggtctctgaagccctgctctcgtggtgtggagttcccgtggtctctgaagccctgctctcgtggtgtggagttcccgtggtctctgaagccctgctctcgtggtgtggagttcccgtggtctctgaagccctgctctcgtggtgtggagttcccgtggtctctgaagccctgctctcgtggtgtggagttcccgtggtctctgaagccctgctctcgtggtgtggagttcctgtggtctctcccacagggcctggacccccttctcttgggtgacataggcattctctcgtcctgagctgctgtcagtcagcaggttaatgcccatgtgctctggtttcatcctttaagacccgaggtcccatttgcctcattccaggtgcctctgcatgtgtctgtcatccttagaatgatgtgcatttgaaccagtggagaaaaaacacagaatgactgacgtgagttttgacacgattttcgttaggaccttggcatgctgggtgccagagaacctgttctagtgaacgccttttacacttccaagctgtgcaatcttgtgatatgctccattttcttctgccttgatagccaaatgccaatcattggggagaaaaattctgctgctgaatgaggcagcgcacgatttgccctctggaaattgaacatttaccttaagtggtaaaaggtgttttccataccttgatataagtttgcataggactctctgctttcatagttctcacttgggtatgcagaactgacatctttgtgaattattctcttttctttcactggagtgtttaatatgcattttaaaattgcttctgtacatatgcagtggataaattaaggtacagaagaaggtttctcagtctacaccatccctggggagttctttttgcttcacttcaagtagtagctattgtcgcctctggcagtgaagtctctgttactttaccaatgctctcattactgcattctaaaacggtgggttttttttctttctttctttcccacttttttttttattggcttgggatttgtgtcttaatcaaagtgtgcaagaaatgcacttaatcgtaaaacagggtggcagttttacaagatgcttcagttaattagcacggaattgctggggaacgttccaggggggttcctggtctccattacatcaaatgagtttgctgtgattaatgttatcataggaaataccaaagaaattaataacgattaagccattacttccaagtggcgctcattacagcaagagctttaagaaaccccaccaacttcaatttctctgtcctgaggtgtgtctatgctgcactggggtggaatatccccagactcacctggatattctgaattttctgattcatttttcttccagaaatcttcaaatacggattcgtgatggataagaaaaaaataaccttttttattgaaggtctgatgcttcaaaaatgcatttattcattccaaaaaatattcagtacaagtacaaatatttagtatgtacaaagctctgagttggatactcaggggtaagaacaaagatgaacagaatccagctcttttcttgaagaactcatggagaaaacacccacataagcaagatgaattacaagggtgtgttattaaatctgtgatagaggcacaggcagaggaagaggtggtgaactttctctaggattatttcagctgactttactgggtaaatgggatttcagctgcttccaaaaatggtgcagatttgccaggcagatggaagtcatgtgatggagtggtgcctcgtgcgtgcagggacaagccagctttggtcactgggcagagagggggaccagggagtgtcaggggcactgtgagctctgaagaatgagcttagaattagggtaggaaacacgagaatgagccccagagagggcatgctgggcacagaagccactccactggctgcacagctacccctgctgggctgtccatgtgtgttgtgctgggcacaggtcccaccaaggctcaccaggatctaggtcttgccctggggtgggcaacctgtgggggggggggtccgctctgagcgtgacaatgaagcacactgctgccagttacagtgagaggaggaaacatgcccctgccatctgcgcagctgcatctggccacccacccgcaccaatggtgaggacgccatcagcgtggctctggcacagcttcactccctgctctgctctattttcatgacttcagacccttgtgctggaatagagactttccccttctttcttcccctgggattgtcacctccctgctagttgggatgctgtctctgtcccccggttctgctgagcagagcacctgggacagtgtgtgggtctaatgagcattgcttccacgatgctttctatttgcctgcagatgaccttgggtacttgtgtgctggtgtttctcaatgtgtgtcctgagctcttggggagttcatagggcaaaggtggcaagtatattgtgcagttatccctaaattattatttccaacagtgtggccccagtgtctaatacaaaactgagctggtagagccctggccctgtgggaaacaaatgtcttttacctttccctgtgtgttcctggaactgagcctctgcaacttccttgccagggccaccaatttccccaggccagcccagtgatgtttttcctggactcatcctctcacctgcattttcttggtggctgtgttaagtccctgcaccttcagggatcccgttggcctcaggagtctggcagtgtttgtttttgctactcacttatttcttggggaatttcccccaagaccctccgttcatttcttcctctcctctctcccttaggagatcaggagagtcaacatccaggtctgtgactccagcctttctcctgtgcaagctccaggcctgttcaggagcttttctgcttgggcctttctccaccatgcacagcccaatctgtctaagccaaactcccaggtgcccaaggtttctgctcccaccaggactcaactccagcttcaggctcagccacccccattcagaccctgtccacagcttccttccaagcatctcgcctcctccacaactcccaactccatggctacccctggcccccacctcaggaggttctgatgaaacccaggcagcacccagcctgccaccacctcccagctccccactcatgcccttctcatgatgatttcacttgagaaatcagaggtgggcaagtggccactgacaagtgcaggatgtgtgcaaagaggaaatactggcagccaggcacagtggctcatgcctgtaatcccagcacattgggaggctgaggtgggtggatcacttgagcttaggagtttgagaccagcctgggcaacatggtgagatcccgtctctacaaagaatacagaaataagctgggcatggtggtatgcacctgtggtcccagctacctgggaggttgaggcaggcagatcgctttagcctgggaagtggtggctgcagtgagctatggttgtaccattgcactccagcctgagtgacagagcaagatgaaaaaaaaaaggaaacattgatgccatggatattgcaagatgttaacccttcatgtgcagcatctgacatgtgcagtacagactctcataatttatcctggattaaaaatttcaacgagtatacatttcaaaaggaaattcctttgtggctacctggacaaggaggtctcttgctgtttcttcggcaccttccactgagccgacagaggtcacttccatcgcccatgggaaatgtgcctactgctcgttttaactcatgcatggatataaaattagttcccatatatcccatctaccaggatcaacgggatttttttctctcactcttttttttcagcatcttcttcactctacacacagcaataaaataagtaaaatgatagcaggaatttacttggaaaaaacaaaacacaaacccttctaggctgtatgatgggtcaggagacacccaggctggattcttcatctgcaaggatgaccctggagatgtgccaaatagagaagtcagtgtttcaggtctgaggagcccagccccagccggcacctgctgagtggtcgcagacatgcggctccagcgttcgagccttgttagatcccctggaaaaacagaaggaggctggttcacatccattcacacaaccccgagacccagaaactcttgaaaaccgaaagttttcacaactcactttgcagcaaatcatgccctgaacagattgatggaaggctctgtgccctcctcacttactgcagacgatgccagtcagcacaggcatcacaggtgctgcccaaggccacagaggctgaaatgcagtgagtggaatggacaccattctgaaagctctgcattcctaggaaaggtaacctcaaggtttggagagaaggcctggtcctgtatccccacttctcacagttaccgcttgttacatggtgtcagatgttcaaggctgccttgtaaaccataaaacaccatgtgaatttttttaatattgagtcaggtgccacccccacaaatgatcctggagtagtgggtcctcccctgccctccgctgtagtaatttactagtgctaggtggtactgggtaaacatccagctcccagaaagccaagtctataaagggaagatactgaagaatgaagccagtgtccaaaggtatgttactaacaaatgatccaactaatattgtatttacactggtcacactggtgttcatcacaaaaagagaaccgtgcatgagatgagctcattggacctccatggacttgtgtcccatagctttgtggctgcccagaccccttctccctggattcagcctttatttttcctgatcattcatcccaaggtaaatacatcttcactcacagagggtcagccagatacttttcaatgtccaccctcctgtttgttgagtttttctctttttaggtatgactgactctcagtaaactgcacatacataacttgtgcgagttgatgacttgtggaatgggtcagcatcgttctccttttccccatgtcatggagtatttgtctgcctctgagtgaggacggggacacacagccctctcagcccacagtcagatttcacccactcctccattgctttacggtccaacaaacagaagaaactcatggcatttacaactcccagccacgtaaatgagatagaacctgccacacagagtctctacctgcaccttccatcccatttaccgtcatccgcattcagaaaggagtgcagctcagccgacaccttgacttcagcccagtgagacccgggctggacttctaacctgcagaacaataagtttgtctgtttgttctgaagagatagggtctcactctgtcgcccaggctggagtgcagtggcacaatcacagtgcactgcagcctcgacctcctaggcttaaggggtcctcccaagtagctgggactgtaagtgtgagccaccacatctggctaatttttaaaaaaaatttaatagagataggatctcaatatgttgcccaggtggttctcaaactcctggtctcaagcaatcctcctgtctcagcctcacaaagtgttgggattatgggcatgagccactgcacccagccagcctgtgggttttttaagccactaagtttgtggtgatttgttacaacagcagccaaagaaaacaaatatactttcaaacacagaactttttagaatgcaatcctttttaaaaatgatgatgagagtggtgatgaagatgatggtgatgatgatggtgatgacagtgatggtgctgatgatagtgaccattgtgatgatggtgataatggtgatggtgataatgaagatgatggtggtgatgaagatgatggtgatgatagtgatcattgtgatggtgataatggtaatggtgataatgaagacgatggtggtgatgaagatgatggtggtgatgaagatgatggggattgtgatgataaagatgatgatggtgatgaagatgttgatggtgataatgaagataatggtgatcataaagatgatgatggtgatggtgatagtagtgatggtaatgatgaagatgatggtgatgatgatagtgataattgtgatggtgataatgaagatgatggtggtgatgaagatgatggtgatgatggtgataatggggattgtgatgataaagatgatgatggtgatgaagatgttgatggtgataataaagataaaggtgatgataaagatggcgatgatggtgatagtgatgaagatgatggtaatgatggtgatgaagatgttgataatgaaaatgatggtggtggtgaagatgatggtggtaatgaagatgatggtggtgatggtgatgacatgaaggagaaagaggagtctcaggaaacaaaacaggaagccttttctttcacaggaaggcagttaaaccaggacagcagtgttgcttcataaataataaaacaccagcctagaacatgttttcaaagcaatttccaaagagtttataggccaccgagataacttttcttagtgagaagaagttcaatgtggctgagtactcctgttggaattagactttacagggataaaactgcagttctcctggcacctgcctgtgaatcaagctttctgtgtctctgtgtctgtgaaactgggattccagtgccccatgcatgctttgggaagctgattccacggtgctggtcaaagtgctgggcacagaggcgttcagtggctctcgagggcttcctggatttcccacacttatttggaggcattttgggaagtgcacttttgggttaagtttttggtaatgagggggctcttatttttgaagcagcacaattcttcagaaagtcataaaataagactctgaaatgctatctgagcatctaaatgttgagttgggtgtggggcagagagtgagcagtgatttaggagaggggaaagagaagaaagaagatgataagaaaagaacaccttgatctgagagctggaacctgctggggctctgaccctcctgaggtcccagttctcatggcactgggccaggcctgaggggtgactggggagagccaccctgtggtgatgtttgagtgggacccaaatgggtgtgtagggttggaaacctagaaatttttattagtgctgactttgatttgaaccttgcttcaccccctcagctgtgtaagctgggaatgccaaatggtgttgggaaggctcagtctctcgatggtgagatgcttgcggtgctgtcgtctgtccagtccaagccaggaaccctggtgaggggcaccgtctctttatgtgctatcaggaaagggctatgctccagctaaactctcttgccagtgttcataagaggcatcttgacttcagaggggttacactgtgaaaaagggttcgtcttgaaattgatgaaatatggtaatcttcatacatatggagtcaaaaactaagtatttagcacaaagtgggtactcaaagagtgctagctccctttccaactctctcccacaaatctacctccatatcctgttttcaggtccctgtctggagatccctttcttggtgttctggaatttcctattgaatgaaagcatgtcacctactgatgaaggggccggtgtccctgtttgcctgggacagccctgccttgtgcctcagatccctgtgttccgctacggcactgacactcactcccaaaggtctctgttgaacataaattataccatggcccaactgacagagtgcagggcactcacaaaccaaagccctggcgagtctgtgcggtggagaaattggggcaagaggaggatcgtcgaaagaacaggccatggggatcagccagggttgagtggggtggggtttcacaccaaccttcaagtgggaagcttgaggaagggaatcagagcacccagtgccaagctctgaggtgagtcggtcaagtccatgatgctgcctcaggttggccctggtggtcacagctccacacgccaagtaaggccatcacagggtgttaatggcgtgagacagactcaagggccctgctgcacctgctcctgtgttgtggcctgcacggggttgtggatgaactgttttgaccaaattagattggcaaacatttaacctcaaatggatgaattcccctcattcccaaatcaccctcaagtttaactgtcttgactcattcaggtgatttttttttttttggtagcacaaaactggaatgttagggtcaaatgtcatcctaatatgctaataaccatccagcccagcagttgccaacatcttgctgatgaattagcctggggggtggggtccagcttccacatctctacatcgcccccagtgatcctctgtgcgtgtggggcggaccccagtctggcctagtgtttctgtagacgtgggtgtgtggagcatctgggagctccagcccaggtcggtgggaccaggaccagaactcaacactaccccacccagctgtccccatggtgtgccagtgggaacgggggtcccacacagagggaggtcactgcgaggtggtcgtgccctcaacagcctcttacagatgaagactaagatctattgggaataatctttattaaaaaaaatactgcttgaacttgaacagggcaaataacatgtaattaggacttaatgactgggtgcagtggctcatacctataaatcccagcactttgggaggccaaggccaggagtttgagaccagcctgagcaacatagggagaactcgtctgtccaaaaataaaacaaaacaaaaggatttaatgatagaaattaagtttgagaaatgtagcaaccccggccattggactggaaagatgaacgagttagccctgttctggcatctcccgggtggactagcaccgaggtgctgtgacaggaagccaaggggacctcactgagaagcggcatcgtctgccctggggatggggtgagggcatgaccacagatctcccccctgcagacttctctcccaggcccgaactgtggcctgtttccactcaaggctgcctggccattatggaaattctttatgtgtggaacacattctcagagaacgtgtgaagtaattacatccaagctgatgggctggttagcaactgaactgatgtgtgtaacacgtatctatgtgattacttttaagaactgggtcttaacctcagacatggtgcttaacaagaaataataaaaccaaaccaattcttagttattttagtcctgggactcagggctgctttcaataaattgtagattgctccaaaaccttgtttctgccattagttccagtattgtccaccttattttttccaggcaacaaagttgtcagttttctgcttctggtcttaaacacccccagcccgctattctacagcgtgcacacaggaaggaaaggatgccgcagaagggagggactgtctctgactgcaggtccacctgaggccaggagactgcccggctcagcctgcaggcttgcatctgacttgcaccgtggctgtcagagctgagagtgtgcgtctgctgagcacgtctgtgctgggcgctgcgctggctgagtgtctgccgtgtggacttgcttctctgcatgctgccttgcgaggtggcctcatcaccccatttaaagacaggaaaaccccgttcatagataggacagtatcaatgacctgccagcatcccatggctaagggcatgttcctcaccatttcagggctcaaagactaccttgctcaaggttatccaaatagtggggaatggaaccaagaatgccacagtctgtgggttgatatgaccctctagtccatgccatatatggtcctcatttgtaaattccttctggggtgaggctgagattattcctgactggttcactttgaacctccccatgtctgtaataggaacaggtgtcacgaacccttcctatgcttgtcactgaaaacccttcccaccggactcttccagcttgtccacaggtgttcctcaagtacctgccatgtgcaggctgcacctgaccccgggtgtgtaggtaccaataaaaggcctggggtctgacttcaggaagctgtagtcttaacattgatgaaaataatctgtgtattaaatagtgtaaaaactaagcacccttggtctgctgtcctggatcagggtgtcctctaataatgagagacctgctggtgaccgagtttgacaattctattcctctgtgtatctgaacatatgcattaaagtcaacaccaaggaacaggaaacgggaaggggaataacgctcccgctgggggaataacgctcccgctggtggaataacactcctgctgaagtgtggccattcacattcggatctcatcctgctggcagcggcgtgttttcatcgaccaggaaacacacaaatatttgtaatcgtttatgctaatacgcaaacattttaaaagcactttgcttctccttaaatttcaaagaaaaatagaagactctggatttttcaaattagaaaatgacccactttcttcttcactgaaactgtttcataaaatactttcacatcctgtgtttcccgccagagtagggactgcgccgcttgtgtgcacccgccgggcactgaggcctcttcagcaggagggaaagtgagagggtgggacacagagtggctcttccagagcctcccacacaccccgggtccaggtgtggccgccgggtctccacacaccccgggtcccggtgcggccgccgccgggtctcctgggctcactgtgactcaggaagcctctttcccactggaactcatcctccataaacctgacagaggctcatgttcgggctcccataagtagacacatgtgtttagtgccttagaatatgagtgccgaatttactaagtgccttcgagtgtgagtgctgaaaggcagtcacctgaaaatttcattttacaaatcaggaaactgaagaatagagaaactaaataacaaagccaagattacaccgttattaaatggatgctttaatgctgagacaggtctcttgggcactagaccactttcctgccctctttttaaaattgttgttgttttaatcgactttttataattttttttttttttgagacagagtctgtctctgtcatccaggctggagtgcagtggcacaatctcaactcactgcaacctccacctcccgggttcaagcaattctcctgcctcagccttccatgtagctgggattacaggtgtgtaccaccatgcccagctaatttttttgattttcagtagagatgggtcttcaccctgttggccaggctggtctcgaactcctggcctcaagtgatccacctgccacagcctcccgacgtgctgggattacaggcatgagctaccacgcctgaccttataataattcttaatatctatattgtgtgccattgtgaaatttttggaaaaaatcaaaagaggaaagaaaaatatttcttcataatctctctaataaactataactactgtgaatattttggcatatttccttcaagagtgttacagatacatattttaatataattgagaatttcacttccatggttttggtttttgcttgttttttgttttgttttggttttgttttgtttttgtttttgagacggagtctcgctctgtcacccaggctggagtgcagtggcatgttcttggctcactgcaacctccccgtcctgtgttcaagtgattctcctgcctcagcctccagagtagctgggattacaggcgcccatcaccatgcctggctgatttttgtatttttagtagagacggggttttgctgtgttggccaggctggtctcgaacttctgacctcaggtgatccacccgcctcagcctcccagagtgctgggattacaggcgtaagccaccatgcctgaccatgtttttttgtttttgtttttgtttttcatttatcattgtatcataaaaatatcttggtcttttcaacatttgtaatatcattttaacggatgaataatttttcatccatgaaaatatatttacttagctatttccctattcttagagcttttatttctatatctaatgtttactgcacattttttaaatggaaagaattaaagatgtatttttaaaattgaaattagatggttaaaatgtatctatattttatctgttcttgacatgtgccacccaactcctttttcagaaaggttttattgatttacagtttaaaacagcacctgattatgattcttcccatgcttcttttgcaatgatgtttttgttatggtaaaatatacataaagtaaaatttaccattttaactattttcacctgtacaattcagtggcattaagtacattcacagtgtcatgcaaccatctccaccatccatctccaaaacttgttcattttctcaaactgaaactctgtattcactaaacaagaactcctcaacccctcccccggcccctggtacccaccgttccactttctgtctttatggatctgatgaccctagggacctcagagaagtgggatcataatatttgtcctcttatatatacaactcatttcccttaacataatatcctcaaggtttacccgtgttgtagcttggatgaatgtccttcacttttagggctgaataataccccgccgtgtatagaccacatgttttttatctgttcttcccctgatgggcactcagcttgcttccaccttctggctgttgggaatagtgctgctatacatgtcagtgtagaaatatccattcaagttcctgcttttgcattacttgagtgtttacctcacgtggaattgtggggtcaaatggtaattctatgtttaattttttgaggaattctcaagctatttcccagtgtggctgaaccattttacattcccactaggagtacacacgagtttcagtctctttacaccctcatgagcccttgttttctggttttctgaggatggccgtcctgaggagtgtgaagtggcatctcatggctcctgtttgcttttgcctaatggctggtgatgttgaacagctcaccatgggctcactctccatctgcacgtcgtctttggagaaatgtctattccaatccttgcttctttgttgttgggtgtaggagtcttacatatgttctagatactcctaatcagatatgtaattttcaaatgttttctctcattctttgggttactttttaactgtttagataatgttttttaatacacagaaggttttaattttgataaagtgcaataaagtgcaatttgtttatttttctttgttgcctgtgcctttagtgtcatactgagaaatcagtgccaaatccagtgtcatgaagcttccccctaagtcttcctagagctttatagtttcatcttgtaaattcagatatttgatcagttttaagttttgtatatgatgtaagttacaggtccagctttattcttttgcaagttgtctgagaaccatttgttgaaaagcctattcttttcctcattgaatggtcttggcacaattgtcaaaaagcatttgtacacaaaagggtttacttctgggctccgttttatagtccattggtctatatgtctgcctttctgccaggaccatgctgttttgattactatagctttgttgtaagtttaaatcagcaagtcttccagttttctttaagactgctttggttgtttgggttcccatgagattccatataaatttttggatgggttgttctatctctgaaaaaatatcaatatttttggtagagattatgttgaatctgtagatcactttgggtagtattaaaagctaacaataatgagccttataatacgtgaagatgggatgtctttccacttatttgtgtcttctttcatttaacaacactttgtagttttcagtgtacatgtccttcacctccttagttaagcctaccctaaatattttattctttcgatgctattgtacatggaattgctttttaaatgtccttttggcattgtttattttagtgtatagaagtacaaatgatttctgtatattgattttataccctgcaactttactaaatttgttaataaattctattaagttctaacagatctcttgtgtaaaatctttatgattttctacctataggatcatatcataagtgaacagaaacaattttatgtcttcttttctcatttagatgccttttacttatttttcttgcctaattcctgtggctggcacctccaatactgtcttgaataacagtggtgaaagcaggcctcctcatattgttcctagtcttaaaggaaaagtcttccatcttttaccctggagtgttacattagctgcagatttttcatatatggcctttattatgttgaggtgattttctgttactcctagtttgttgagcgtttttatcatgaaagagggttgaattttgtcagatgctttttctggatcagttgagatgatgatatgggtcctttccttcattctgttagtggggtgtattgcgtttattattttttatgtgttgaaccattcttgcattctaggaatacatcccacttggtcatggtacagcaatcgttttaatatgcttctgaacttccgaattttgtctactagtattttgtcgaagattttttgcatcagtatttataagggatactggttcttagttttgtttgcttgtagtgtctgtctggctttcgtgtcagagtaatgctggactcacaggattagttagaaattgtttcctcttcaatattttggaaaagtttgaggaggagtggtgctaatccttctttaaatgtttggtaaaatttatccatcaaaccagtgactgcaggattttctttgggaggtttttgactacggtttcagtctccttactcactcctggtggggtcggttttctagttcttcatgactcagtctcagtaggttgcgtatttctaggaattttcccatttcttgtgttatcctgtttgtaggtgtgcaaatgctcatcacactcacttataatccttttcactttgtaccatcaaataataattattaatagtaatagataaataaaaagaatacaataatactatttaaaagtattaattgatgatttattttgaatcttgtatctgttgtgtgtaccatcagtgtttttcttagggattatttggccataatgctctgatcgcattttgattccatggatatgcttctctttaaacatctcatcctcttactgtacccctccttaatttatggaattcacccccccagggattaatacttaagtcctagatgccaaaaatacgtgtctcctaagctcacagttaggatgcactgttgctgtggagaggggatgggggttggtacagggtgctgcagattctgggaagtgcacatcagatgaatttgtggggacttatagtcaccttgggtgactcttgtcccctgctctagagtaacagtgggctctcaggtgcaagtgcttgagctgtttattaacccttctgaacctctctgagccatggaggtcaaatgtatttccatttcccaagtggccattcgctcatgtggttctgatgttgggtaggacctttccttcccttttccttcttactctctaggtgtccaccattcaaaacagaatgggctcagatgcaggttttcatagtggcatgagccaggcattctagcaaggttgcagatttaaatgaaccctttacttggtggcaattgaaacaacttctttttgtaaattccaaacatgaattagtcacacaaatgaattccaactcacaggctaagaaaccaaaagcagtcaggccttctgtgtaacagtttatcctctgggaaagtgaggttcccaccatgacccctgaaacttgattcctctgtgggcccttgattctggtggccatgcatggattggacattccctagggaggagggcagccctgtcttggcatcactctgtcagtccttcccctggggagcactggcagctctgaaccagctgcttttgttcactgtgtgcaggctgatgcccacgcaagaaatagcaactggtagacccaaagagggctagggatagccagtcaattgttgagtgcacattgagtcgaacagattcatttgtgtctgaggatttttcagcatttcttcagccagggacccagcctcttctggtagagtcacagactgggactggctcgcagccttgtttagtctaacttaggtaaaaccctctcggtagacacctgtgtccacacaccaaatgaacccagatgtggaccggagcgatcacggctacagcagcagcccagcctccccctccagatgtgctccacgtctcttgctgtctccaacacgtcagggagccaaccctgtgtcttctgctccctcacagccctgggcatgcagataacacactgtgaatgttcttaccttaaaccagccgtccctaggcttttctcatcaaacagccataaacaacagtgtactaaatgccagcacgtaggaagaataaaatctcatccaaacacaagagaaacacatcctagtttcagcagcacacgaatggcctggggcagtgtcccagcagctgacatcctgatgagaaaacgcacctgtcagaatgtgcgggtttctcccttggtctcctgggttccttccaacctctgactctctttagaaatatgcaaaggctacgtattattggaaatcgcaccaatttgggggttttctcagatgcactatttgagactctcctgacctccacgtatgaagacccagagctgggtgcaaactgttccacacccctgggctaatgaagggatgggaatgcagagcccaggcaaaccccgcagggtgtccgccctagcaccctgcggggctgagctgcggtgccgccttgccctccttgtctttctcttctgagctgtgccctgccacttaaaaccacaatggttgggagttgtctgaagaagagagttgatcctggagagcatttcttcaaatgcttggataaccctcctgctgtgtgctgtctggaagcagacgcaggtgcagaattgaggagttgcttctctcaggggatctgtgatgggcctgcggtgctttcccaggttttgccttcagagaagttgaaatggcttaaaaattactggtaagccctcccctggctgctgatgagacctagaaatagctcccacccagggggatgtgagcccggctcagcattctagataggtctcccagctgcaaggaattccatgcatcacaaacatgatggtaccctcccctgtgttccttggaattgcttttctccaccaaattacctgtgatccagcacaaatatagagtatgtttggcaaaaagaggtagcttaatcagcagtgaagagatgtgcctggatagaaaattcgcagctacaccaagctgctttttagtgtgaggcacaaatccagcattcgtgtgtgctgctcctggtacctgggatggccggtggatccgtctttctggactgcatctccagggggctccttggggacggtgagaggcacactggcccagcaccctccaccccacccgcttcactcccacactacccagaaacaaactaggaagtggcattttgtaaaaacaaaaagattgccagcaatttctaaatttttaaattttaagtctagtatttcggtttattattcttttaatttatcttaaaaaataattttgcaggagtaaatagaaatgatgaccaaaaaacatatgagatacttaaacacctcacctgatttggttctaaagataccagaaagaacttctgtgctttccctcccaggacactcaactgcatgggagaggccacccccacttccacccctgaaaagggggtttctggggctcggcagggaggcggggcctcgctctggggtctggagctgtactgcaggccttaatatcaccccggctgagaccactcctctcacacaggcaccacaacccacaccacacacacacaccacacacagtacacaggcaccacccacatagacacacatgcagagactacacacaccacacagcacacgtgcaccacacacacacaccacacacagtacacaggcaccacccacatagacacacatgcagagactacacacaccacacagcacacgtgcaccacacacacaccacacagcacacacagtacacaggcaccacccacatagacacacatgcagagactacacacaccacacagcacacgtgcaccacacacaccacacagcacacacacagtacacgggtaccacccacatagacacacatgcagagattacacacaccacacagcacacacagtacacaggcaccacccacatggacacacatgcagagactacacacaccacacagcacacatgtaccacacacaccacacagcacacacagtacacaggcaccacccacatggacacacatacagagactacacacaccacacagcacacgtgcaccacacacaccacagatctaggaatgcttctggaactttcactttttagtcaggaaactggaagtggctctgcctgttgcagcctcagatacgaacctgaacacctgaagctcttggaacggcctttccagagagttctgtggaagagactctaacacacatgcatcttcaagcgtttgtgcattccatggtgagggaaaggagagaatatttaaaccagcgatttctgcttcgaaatgcggatttgcttacatttctccagcaccgctcttatgccctcattcctttctcggtcgccctcaccctcaggagggatcctttggccatgtattccactcttaaccccagcttccaccagctgccccgggtctgagtcctcagacttggccctcctgtcccccaactgctctgatgatgcagctctgaaaaaatgagatgtctgtgaggggtgaggtgtctcctgtccagagagtgtccaagcagggcagtgtcaggatgtcatagaagtctttagggacaccggacctccagccatgtggatccaggttgcagggcagcacagacagcagccggcagcaaaggcacccgtgccagcagcctcatggtgtgaagaaggtgggcaggtggtgacgggcactccgctgtatcctgggaggacactctccatgccacccaggccgttccctctgtgcccggggagtgccgccagcccctgctcctgagttcccactgtgctcggggagtgctgccagcccctgctcccacgtctccatccatctgcctcgtgcactccagagacacaggccctaggaaggaggcttctcacacccggctctcctgtccttcccgaaagctcatcacatattgaacacggagccctccccagagctgctggggactctgtgcaagctgcacacgggtacagtcaacatggtgcatgcacaggacccccagatgtcgctgaggacttctcgagccagagggctcaccccgtgggtccggtggttcctggcactggacggctcaccctgtggtcaggtggttcctggcactggacagctcaccctgtggtcaggtggctcctggaactggatagctcaccctgtgggccaatggaggccgtccccttcactgtgtgcatggctttctcccacctgccgtgctgacgtctcggtgatggacatcttcacgtcctggagagggaagtctctgtgatatgaagtctgctgtacccagggacactgtgaatgtttccacctgaaagcaagcaagtgtgttcagagcattcggtggtctgggtttgagcatcacctttatttcccctggggttcctgtcccctggcaggcaggcctgtgcacacctacccccaagtctgagggaaccaagaggcctgagaaagaggctgacagacccagtttctcagaaggaaacatttactagagatacaggaacagaagccacacctgtgtctccatggcgtgagatgagatgatggctccctcacccctagacccacagctctgcaccacaggggaggggctgctcagggagccagcctatcacctacccacgttccaccacggagtcagcgtctccctccccaccctcgcctgtctccctgtgtcccccaccccgtctcaggcatgcacactacccaccctcgcctgtctccccccgtgtcccccaccccgtctcagggatgcacactacccacccttgcctgtcccaccctcgcctgtctcccttcgtgtcccccaccctgtctcaggcgtgcacactaccccaggttcctcccacccatccctgcaccgggcactcttccactcttcactcctcctaagttgtcctgcggggttcggccccatcgcccgcgtctggcgaggctagctgcacattctgtggggggctctggggggctcccagggcctggactccctgcccagcccgagaggcttcatggtgcagccttgactcttttcttgggtgagcctggcctccccgcagggtgtgcagaaacagacacagaacaaggagagcaggcacctggagctagactgtgagcttgggaggaagatgggcagcgaacgcagtgcggggcgcaggctggagacgtgagggggcatcagagcagcaggatcagccggcagttgtggcaggtgcagcaggagtgagtgggcgcccaggccagacaggcggggccaatgaagagaggggggcagccagccagtccctgccaaccatggctgactcactggcatccactgccggactcaggccccacctgatcagaggacaaacaaatcagatggagcagggccatggtcagggaagatggtgggaggtggatcctgagacggtgttgcagtccggcaggagggacgcacagcagctaatgtcactggcagtgcctgaggcctgaagactgcggaagcggagggacgttagcccgtgattctgatcacgggaacatcgtttagtaaggcgtttcccttttcacccggtgttgagatgttgatgcagtgcacctgtccactttgctgcagtggaaggggggtcccagagaccgtgatggagccccatgggaccctcctgttgacagactgtgaaggccttagtcccttcctatgagcatcagcagcgcctccggggactgaaggtgccaatagggaagatggaaaggggtgtgtgcaccgggcgctgttcccaggacacagcctgtccagttctcttcgctgttcttacacatccccagtcatatgttaattgttgtgagtgtcctttttttttaaccaaataatctttgcaaggagtaaaattcaaattttctgaaggttttgattaaaagagcttttgcagtaaaagtttcagataacagatcatccttctctgaaccgtattagagtggatattcatatgcgtttcatccttgtctctgagagtgaggctggttggtcaggggacggcacctggggcatgggagggtttcctgggttggggtcctgccaggagtacgtgctctcaagagtagggtgtgggcagcaggtaagataaagctgtgttggatgaaatcaaactaaaacaaatgaaggtcaaccagctgggaatattgctagtgaagaactagcaaactcaatggaaaccttctttaatttttattttgttaataatagaggagccactctcttatagggaatggccacccgccatcaccatagctcatctgcccaacacatctgcacctgacttccgcgtctgcacctcactttcctggttcagtacacagtacttcatgcaaagagccgtttgccaacatcacagcttccagcatccgatatggaaagaaggcgctttcactccacgcagaccttgcttgtcttttctgtagaatagttgtagaggataagcctgctccatgggtgaggcggctgcacagcaatggcagattttgttgtcaccaccagaagcagaaatcacaaataacaaaggaatctagagacgtcagagaaatgggaggtcatagagcaaaaataccacccaaataccgacaaaaataacccattacatatctgaacattttagagcaggacaagaccagcagtgagcatttgacccacccaaataccaacaaaaataacccattacatatctgaacattttagagcaggacaggaccagcagtgagcattcgacccacccaaataccaacaaaaataacccattatgcatctgaacattttagagcaggacgggaccagcagtgagcatttgacctggcacaacctccgttcactcagaaacgcctgcgggtttgtatttcccaccaggcgtttgctaggtttggaattttcaaggtgagacaattggaccctttcccttacagagctttatgatctcacaggaagattaacatgcacacagatactgaacacacaagaacagtgtttccattgagatatacacaccatgtggcattaaatgtttaatctgtcataacacaaactttaaagttttattttaaatttttttaccaagatattttttacaagttggtgatgcacaagctaaataaaaagcatctcaacccaagatctcaggactgtgattcaagtacaacctttataactttcctgccaacttcaacttaatgagtcagatagttgcaagctggaggcttaaagaagcctgaattgtttgaggagaccctgaggagcctcggaacttgcccggccccaggaagtgaatcatcagtgcctgggaaacatctggaaatggaaccctgttcggccctctccagtcacagtgcttaatcattcatttattgatttcaaataaatttactgtttgtggagctatagagcaggagacttttatcaagtaggagagtcccgtctagatagtaaacaattaccacttgttcctaagggtcttggaatatgggcctgtattagtccattcgtatactgctatgaagaaatacctgagactgagatggcctgggcaggctgtcctgcagcaagcatggcattgactcagccgccagtgtctgagcccctcaatgatgttcaactccatgcttagtgatgccttcagtaaatatttattattccaggcactgtgctgggtagcacaaagaggaataaactcctgtccatgttctcaacaattttataatctagagaggcaaataaatagggaatagatgaatgaaacaaaactaaattgagggagtctttttaaaaaattgagataaaattaacatagcataaaattaaccacttaaaaatgaacaattcagtggcacttggtacattcacaacattgtgcaactgccacctgtatgtaacattttcaccatcccaaaatgcatcattttactttcaactttggatcctacgtgagtccctaaccgacagcatatatcccttatcttacatacaaagtataccttatcttaaatgcttgggacagaggtatttcagattttggatcttttcaaattttggaacatttgtggtcatctcatatatgcagatgattggttctaagacacccgccccctgcaatgtgtaccaaaattcacgcatactcaagtctcaaagttggccctgcagaacccacatttataaaagtcagctctccgtatacatgggttttgaatcccacgagtactatattttcaattcacatttggttgaaaaaaatctgcatataagtggacctgcatgattcaaacacatcttgttttaaggccaaccggactcaccagttgagcttccataatccaaaaatatgaaatccaaaatacttcaatgggcatttattttgaacatcatgtaggcactcaaaaattttcagattttggagcattttagattttggacttttggattagggatattcaacccgtagttggtcatacttttaaaaatgtattctgtcagtctctcttttaattggtgagtttgatcccttttcatttacagtaatttctgttaaggaaggatttacttctgccactttgctgctggtttctgtatgtcttacaccttttttcctcctcagttcctcaaatattgcctttttttgtttctttgatttaatttttagtgtactgttttgattcccttctcattttcttttcctgcacatttctttttgttattttcttagtggttaccatgggaattacaattaacaccccacatttatcacaatgtagtttgaatttataccaacttagcttcaaaagcacacaaaaactgcttctgaatagcttccttcccagctttatgttgttattgtcacaaattatctcttcctacattgtatgctgttaacatagatttataattattgttttatgcatttgtcttttaaatcatatagaagacaaaaggaggagatacaaaccaaagctacaatactgggttttatatttacctatgtagttaattttactgaagttctttattttcttgtatggcttctggttactgtttagaatttcagcctcaatgacctgcatttcagcctgtcacctttagcatttcttacagagcttgtctactagtgacaaactccctcagcttttgcttctaaggggatgtcttaattttggcttcattttcaaaggatagttttgcctgatacagaattattggttgacagttatttttctttcagcacattaaatacatcatcccactgccttcaggcctccatggtttctggtgaaaaactgctgttgatcttattgacgatctcaagtacaagatgaattgcctctctcttgctgctttcaaatttctgtctttggcttttgatggtttgatgataatatgtcagcatggatctctttgaatcaattctacttggagttagttgagcttcttggatatgtatattcatgtctttcatcaaatttgggatagtattggtcagtataactctatacatgatttcgtcagcttcctcctggaaagccagtctcgcccaaaggtgctaaaacagggttcctctttgcactggtttctcaaggaaccaccagacagctcaaaacacacagccacagttttttgaaaacaagatccatactgccccctggtaccaccacatctcaccaggaacttaggccaccaatcctgtagctgctgttgaactggggaatggggaataataggtgggcaagcaaaaaccacagaatgtcttttaaccaaaatttagcattctctttctcaatttagcaccccctggttactgctgatttttaaaattagactacagaatcccagaacagtcacttctgtccatttttgtcagcttacttgttacttcagtggagggacagatccttggagccacctgctctgtgatttccatgtcactactcgacctgatggagtctttggcccacttggaagaagtacccctttgacagaccttttcgcatcctgcccacatcccagttgcccaccctgtgcctcccttcagctctgcagggcagctcccatctatgctgatggctccagccttaagcacctgccttggtctgtctgagctaagcagcacactagcccacacccagggcaggccagggctgctcaggagttcacctcttcagagagcaagggatgggagtcaatggatagagacccctgattctttgaccctcagacgattcaaggcacatcccacatgcctctcagagggtctccggcagtgtcgggccccggccgtccacactggtggtttgtgcatgtacttcatggcttccgcccttctcaggcttactgtcccgttctctcacttggcttctgggatcatcctccaaataaattacttgtacccacatccttactgcaggatgtgattttgtggacaaaagtaacctctgccttaattcttcaaagtgttgaatcccacagtggtgacaccatccctgtggctgctggcctaactgatgtaaatggctcagtccacagggcccttacacagatggcccaggcagccggtggaggatcatcctgttcctgcaagcttacgtgccctcaggagctgctgtgggccttcacatctgggctgcatgctgataacaaagcctctcacttgtttccagatgcatcaacatggtgacatgcagagtctttattttgggacaaaaataggcatccatgaaatggtgtgaacaaataactattcttggcctcagtgatttcattcagtgcataaacagtatttttcctgctgaatttccaggattgaggaaactcttgtctctcaggaccagctggattttacttttttttttttagtgtcttctcaaacgcagaaagagctacaaaactcccatgaggcatgggccagctgaagaggcttcagacagttgctttggttgtttcacaagactagaaaagtgtggttgcttcttgcctccagaccgtattatcctgcctcaccatcagctgtttctgccacctcaagacaagaggcaaagtgggaaagagaagtttgaaaccaggagcttctaagtttgcctgagtcttcaagggccagattaggaatctttagccaccaggctcacactgtcggaactgagaggtgggacagctgaacagaaaggcagaatcttccagaacctggactgggcccagcaagcagggtagggatgtccaggaagggggaaggcacccagcttggctcctgagaatgccccagctgttggtgacccgtcgtctgatgggacaactgaagccaggaagtggtgtggctggacttgctctttaggaagcagactttgtggaggtgggaaggcggcattgtccaagctggaggcggcattgtccaagctggaggtggcattgtccaagctggaggtggcatcatccaagttggaggtgacatcgtccaagctggaggcggcatcgtccaagctggaggcggcatcgtctgacttggaggcggcatcgtccaagctggaggcgccattgtctgaggtggaggcgacattgtccaagttggaggtggcattgttcgagttggaggcgccattgtccgagttggagacggctttgtctgagttgggaacggcaggttcaggggccaggtcactgagcgggagaagagtgaatgggttggagaaacatccacggggaaagatacattgatttgtcagacgccaggatggaggagcagtaggatggaagggccttcagaggcaggcggggggtcttcgggacacacggggtcagtgtgcccatgggggttggccgggagcagctagcaggcggaggctgtgagtctggaaggagaacccagtgcaggtggggatgtggctgctgcgaatgggtggggttgaaaccatgagggctcatgaggtcactctggcaggaggtgcctggggagggaggagtcagccctgaacacccagcactggggcctccgcatccctgcacggatccctgctctgtctctgacctctcaccgtgttcctcccacactaaacacatctccatctcacacaggggctggtccgaggcctgactcggtgagagcaggaaaatgggtagagaggcagagtgctccagctggagcagatgagcgatcatggtggggtcacagcactgggagctgcacaggctccattcggcacggtgtttatttcagagtctctgtttactgtataaatactaggcaggattcaggagttgtggactgtggactgtgtagtctgtgttgtagacaatgcctgccccccaagaagcatgctgcttcccagctgatgagcaagggcagagctggccaggtgcggctgcctgtcccaacagccccttggcttagagaagagaggggcacagctctcatccatgcacgtggacctgctggacagtggtcactggcctggtgactaaaaacaactcccttctcaggacttttgcctctattttggtgttccagcctctgtggacatagtttgaccctcttaagactatttctaatcaacatgtctagggatgcttctgatttaaatgttatgctttcaaacaattattatatttgcagcagtgcggatgcttgcaggaagctttttccatgaaacttttttaaaaagaagaattttccaatagatccttttctcacaaacttaggtttctctcgataaacacatatttgtgccacttaacacattaattcaaatgaattgctctaccctgcattgtattgattccaaggttcagtcagtggtgggagtggtaccgcccccgcttgggtggtgggctccactgaccgagactgctgggccgtgtgttggttaagctggacatgaccgtgggggcaggctggcgttcgcgacgaaccatgctcaatctttgtcaaatgccgttagaatccttttctgtggcaaggaaagagagttccgccttccttccctgtgaaggtgtttgctgcatgaaggccgggcatctggagcctgtcctgggctcggagtgtctgtaattgaagtgatagcagcttttgatacttactggaaatgtcaaatgaagcccagtgctcccttagaaacattggtttaaaacccttacaacgtggagaaaagtggcagaggaagaacaagattgtctgaatggatttagttaaaaacacataaaaagatgaactaccagaaaaataatagggagtcaaaacagatacaaaaacactaaaaggggatggtgtagtgatcaacttgacccttagacacctgcggcctctgtgaacttccatcttcctgaaaggagacaggagcttgacccagggaggctgagccgggccttccatggaatggcacttcctcagcagaggaggcgggggcttcggtgtcctagaggggccttggcgtcagggtagggagcgcttggcctctgggagctttggcatctggggaggacttcagtatcctgggggtggggggcttccttggcatcttgggagggggtttcagcatttgtggaggactcagtctggggatcctccatgttgagggagtctgggcatctggggtgggtgtcttggtgtccagggcctcctcggaaccaacaggtccaggagcagggatggggcggaggtgggggctgaagctggtgctgtgctgagccagcagatgcttcctgtggagacattgttggatttcaagggcaggaagtgattctgttggctgtcactgaatttaaagggtgtagcctttgtctaagtcggccattcagaaaggaccgtctggggcatgggagggggcatgggaagtccctgagaccctctgggggtccgcagagtaagacattttcctagcaaagccccaaagttctttgcctgtttatcctctggtgagattctgcatcgcttccccaggctgtgagatgtgcgaggatgcggcttcgaggctagtggaatgtgtgttgtgtgttcttgggtctcgagaactcctcctttgaattttggagcagtgaatagtggtagctacagttatgaatgcaaaggcttcctggggccaaatttttaagcctgaagatgctgggagcaccaggcccggccctcctgctgtgcacacctgctgcccatcacagagctcggctcttgcagatcctcgtcaagtgagggcatggaaatgccagggatgggagacggtgtgtttgactttgggagtgaagcatggagacccagggcccagttaggccacagtgattcaggctacgcagatgaaggtggctggggtggcaccagtgggaatgaaaaggaaggacaaggttgagcccctgccactgcctgtcatcagagatggcaggaggatgactgataaccaagccctccttcctagaaaaggtgggggcagttctccgtgagcacagggttgtgggggtgtgatctggggaaagacagtgagggactgggaggggatacacatcatttttagacacttgcgatgtacaggtgaacgcggagaagttggggtctggagctggtggagtcatattccaccagctcccagtctcaatgagaggattctctgatcatcgctcctgcttgacatctgaaaaagaactcatttgcatacttcccaagagtattaccccagcagcattttgtgtctgtaaagatataaacattctgtgggagcattttcaggacattcgctgaggctgcctgactccccacaccaacacctgctgtgcagtcagaagtcacagtgaggtgacacgcagccctcagatgcgggagcaaaactagggtgaaggctgaggaccccaccgtgggctctgagctgggagcggccaggggccaggtgctgcttttgtggtgcctcaagatcacctcctctggaaaggcgtgccgaggactcccgtgtgtggagggtgggccgaggacccctgtgtgtggagggtgggccgaggacccctgtgtgtggagggtgggccgaggacccctgtgcgtgtggaaggcatgctgaggaccctcgtgtgtggagggtaggccaaggactcccatgagtgaaggtgcactgcagacccccatgtgtggagggtgggccgaggacccccgtgtgcgaaggtgtgctaaggacccccatatttgaaggtgtgctggggacccccgtgtgtggagggtgtgccgtggacccctgtgtgttgctgcaggggaccaaccacttagcaaaagtcctgcagagagcgctgtgtcctgtgaggagatgggcactcagcctggccacacagtgaggcttgagcatggagattaggtggtgaaggtgggcagaggcctctgggagggctattgggagggagaccttggcagcagctggccacatgctgaccccactccatgcagagcccagcatagggagtgtggctggctctgggagacctgcactttcaggatggtcctagccctgataaaaattacagagatcttttatacacatgcatggacgtatgtccctgcacagatggccaggagcccctctctgctaactcttacacagtggcttgctgtggctgctctggtttcaagtacccagagacctgggtctactgaagaatcgcttgcagtgtcatgggggagggagttagatttgcagtgtcacggaggggggagggggttatatttgcagtgtcatggtggggaggatgttagatttgcagtgtcatgggggagggtgttagatttgcagtgtcatgattgagagggtgttagatttgcagtgtcacaggggagggtgtcagatttgcagtgtcgtggtggggagggtgttagatttgcagtgtcacaggggagagtgttagatttgcagtgtcgtggtggggagggtgttagatttgcagtgtcatggtggggagggtgttagatttgcagtgtcatgggggagagtgttagatttgcagtgtcgtggtggggagggtgttagatttgcagtgtcgtggtggggagggtgttagatttgcagtgtcacgggggagggtgttagatttgcagtgtcacgggggagggtgttagatttgcagtgtcacgggggagagtgttagatttgcagtgtcgtggtggggagggtgttagatttgcagtgtcacgggggagagtgttagatttgcagtgtcacgggggagagtgttagatttgcagtgtcgtggtggggagggtgttagatttgcagtgtcacgggggggtgttagatttgcagtgtcatgggggggcgttagatttgcagtgttgtgggggagagtgttagatttgcagtgtcactgtggggagggcattagatttgcagtgtcatgggggagggtgtttgatttgcagtgtcatggtggggagggtgtcagatttgcagtgtcatggggcagggcgttagatttgcagtgtcacgggggggcgttagatttgcagtgtcttcggggagagtgttagatttgcagtgtcacggtggggagggtgttagatttgcagtgtcacaggtgagggtgatagatttgcagtgtcactggggagggtgttagatttgcagtgtcacaggggagggcgttagatttgcagtgtcacaggggagggtatgagatttgcagtgtcaagggggagggtgttagatttgcagtgtcacaggagagggcattagatttgcagtgtcacaggggagggcattagatttctgtaacagtgagaatttctaggcttcttcatttcttaatttcagtatttcaatgtcacagagtcaactgtttataactttgcctcttgatggcacaaaaaagagtttgctttgaaagtaaggagcacagaccttataaaatttaataataacactaggaaggggagagaaaagaatctgcactgaggcttcagaaaggagccggggctgagttataaccaagttctgaacaccaccatcgctgacagaccactagatgggaactctgaggatgatgcccagaaggaaatgtgcagagaacatgtccctcaggacctggactggaactcttgacaggggctcatggtcataccaacgggggcctctctgctctcaactgcccatgcagcgacgccttcctccactcaggtcctccctgctctctgctgcccatgcggcgacaccttccaggacctgggtactccctgctcttccccgcctgtgcagtgataccttcctggacctgcttagttcattcaggaagcattgcctccactctgctctgtgctgaggtctcacaggccagagacctgtggcatttgtagacacatacgtagcaaccttctccttctcgggtgcccagtacccagccaaatgcacctatccaagggcctagcaaaaccaactgctaggcaaacacatcttaaaagccctggtattaacacaggttgtaagatatgccagagggaagctggactgaggagttctgaggccaactctgtctgtctggtgctgagtttcagtagacactggacgatggggttgaggcctcagggcctcacctttgctaacccaacattatgggttttggcaaattaggttcatatgcagatgatggccccactggggatgtggctgtgtccacagggtgaatcctggcacttggtgagctccacccacaacacacagcactgagagtgacctggtctgcagatggctgtccagctctcctctcctgcagccagaggcctggtctctagagcagctctgttctagcactttctgtggcaacagaatggcccacatgtgtgctgtcctgcaggacagccaccagcccctgtggccgctcagtgatggaaaccttgctagtgagacaggagacctgcgtgctttattttatcttattgtaattcagaatttggatactggaaacctcgctattgaggtggggacctgcgtgctttacttaactttatctgactgtaattcagaatttgcgtgctggaaaccttgctattgaggtggggacctgcgtgctttgctttactgtatctgactgtaattcggaatttgggtgctggaaaccttgctgttgaggtggggacctgcatgctttactttactttatctgactgtaattcggaatttgggtgtgagttgatgtggctgccaccatgcacaaggcactgcaggggctcgtagcccgtgtggatcatggacaagaagtttgctctgatgctcccaaagagccccactccttacttcagcactgatatgagcatcttgacaccggcaggttgttttctgtgggccactccggtagatttaaaaccctcccttttactgccagggttggatcatcctacataagcaccaacaccccaaagggtggttctttttactcaaaaacaatcatgcttagtgtactacaaggacaatgtatctttgatattaaagagaatttttggaaaagagcttcctcaaatctcatcagtttaatgcaacttaaacacgtcacatttaatttgtctatgtggtaagactaatagtaaaaattgaggtcttcagtgcaaagcagatctgggttcacatcttgcctttgggtgttgttgtgtgaccctgagcagacaggcagcctccctgggcctctccttcccatctgcagagggtgggcagtggtctgcacgtggcatggctgggcctgcaggtctgcttatagtgtctacccctcacatccggccctctcctgtgtccctgctgagcagcagctcaagaacctttcagcaggatccccagggcagaagcaggtgcctctgagagctggcagggatgacactgcaggcatgtgcagctgtcccatggctgacgctcctgtgcgatgtctcccctgcatctccactgcagttcagatgtaatttccaaccagtgggtgctgcagtttttctgagacagccaactattcaaagcaaaggaaacctttcataaagtgtaatctgtgcgtgcatttggcagcaccatgcggggggcccacttcgaggtgacctcctctcaccagagcactgtgccctgcagtgggtggctcttagctttgaacagccggggttcacattgtgcagaaaaacatacttagatggccccaccatgcactctgcttcagatctgagtggctccgcatgccacattgcttctaatttccagcttgacattgtcaaaggaaaataaaacaacagagagagagatggggaacatgtcacatagtcacgaagattcccatcacaggggttgcaaatggtgctactgaacagactgtcctggggctcacgtcactaggcacaaggggatgggtgacgagcagattgcagatacgcaggactgttcagacagactctgtggtgtctttgtaaatatgaatccattcatccttttctagctctttaggccaacaggcagttggcctttccaggccccggctcaagccaaaactcagagaggccgcacccgctctcagcagctggtgagagtccggggcagaacctttgcactgaagagcccctgcctggctttttaagcggcttctcctgggtgggaaaggtggagcggccgcactcgggagcgctattgtgagagacatgaagccacaccgcacacggctttattctctcatccgatgctgagtgtcttctctgtgcctgacaacagcggcttagtagtagctgatgcgatctgctccagacatcaagggcttgcctattcccgcacctttcatttcttcagtgaattgctccagtccccacgtgctcagttagacggaaattctgtatccaccttcaaaaccttcctcttcctttccccagcacagcttactttgggtaaataagcaaaagctgtttttctaggtggtccagccccgtgtggacctttactcacctatgtgtgccagctgcaagttcacgtggtcactcgggctaaggacccaccacagccatgctcacggcaagttccaggtgcccagatgcagaaggagcataaagatattgtcagacccacggtgttcaggggtccggagggcttcccagagaaggtggcccaggccaagtctgggagatgaagagaaattgccccagtgaagggggttgacatgcgggtgagaggggcaggcagaaagacattctacaagagaaaaaatactttttacagaatattgcagaaagaatactttttacagatgagaaagaggctatgtttaggaaaattcccatgactggccatggcggaaagacaggggagaggtgggaaaatggcatgaatgaccgaaaggatggcctcatacactccctgcgaacttgaaaattctccagagggcatgaggagcctctgaagagctttgcacagggctgcacatgtgttcagacctgcactgtagaaccccaccctggcttccgagtggaggagacacgggaggtgtcagacctgcactgtagacccccaccctggcttccgagtggaagagacacgggaggtgtcagacctgcactgtagaaccccaccctggcttccgagtggaggagacacgggaggtgtccgacctgcactgtagacccccaccctggcttccgagtggaggagacactagaagtgagattgagtggtgctcgggagaacagggagaggtggtgggaatccaggagacagaggtgcctccgtggaagagaaacaggtggggtggccagagagctacagggaggatgctcgcggggcctggtggagtgagggacacaggcagaggggaggaatgagcccagtagagtctggtttgggatgtcgtgtgaacgtgacaggggcacagagcccataatcgatagcatctcgtcacctcaagaaagcagagagcttcggctcagtcagtctcagtcttctctaactagttgaggcaaaatcaattcagacctccagtggcagcagtgaagctcagtgagaaaaaattcaagcatcttgtactagagaaccatggcagggagggaaagtggggagaatgtgtctgcatttgctgtagtcatacacctacgatcggttcactttcggattgcgaagcacacaggacagaatggcgttgctgcaccatgaggatggctagacccccctgagggagcgacacagatgctgaagatgtctaaaccccccctgagggagcgacacagatgctgaggatggctagacacccctgagggagcgacacagatgctgaggatggctagacccccctgagggagcgacacagatgctgaggatggctagacccccctgagggagcgacacagatgctgaggatggctagacccccctgagggagtgacacagatgctgaggatggctagacccccctgagggagtgacacagatgccgatgcctcccagggagctccaattttaaaagcaaggagtggactgtcaccaggttcctgtgatgtacccgccaatgttcatcttgcagtccaaaattgctaaacatgttaagaaacaggacattaggacccataaagaagagaaaagaaagtcccaatgatacagacactgaaatcaaccagacaaggacttaacaacaattccagatctgttcaagaacgtaaagggaaagacggagaagaggggacacgtgggaacctcagcagaaagatggaggccgtgcagaagaaccacgtgtagattttagaaaggagagcttgtaagatgggaaattcactgcatgggctttacagcggatcagagactgcagaagaatgaattggcaaacttggaacagatgcacagaaatgatcgcatctgaaggacagagaaaaatgccagaaacaaaaaagagcccaggtggcctctaggacaaagtcaagtggtctgacccacgtgacagttccagaagatgagccaagaaaggtgggacacaaaaaaagaagaattaatattcaaaaccagcaaccctacccaccctccacctggtgaaaaagaagaagctcagagaaccccaagcaagttaagtgcaaagaaaattaacataagcacatttgtagtcaaattgctaaaataccaaagatagaaaatcttaacagctgggaggagagacgttacattcccaggagcaatgatatgcatgaggactgacttcattcttcactagaaacagcagaaaccaggagacaatttgacaactctttaaggttctgcaagggagaaaacaaaagcccagagttctatctccagcaaaaacatgtttcagcataagggtgaaagaaacctgctttcgtgccagcccatcccgagagaatctgccatgttagacctgcactgtacaaaatgctgcggacctcttctgactgatgggaaatcacagcagttggagacccaggtccacaggaaggatgaagaacccaagaaatggcagcagactgagagcttctggaggaagtgagacagccctgcaggctctgggaagcaggaggtccaaggccggatgctttgctcatcatcgccaagtgaagagtccctgtggcagagcaaagatcaggtcagagtggaaattaaacaaatgtgattcttttaaacaagtaaaaattgaagtggagtgttctatactatagtgggaaaaaattctacaagccagaggcttccagtcaaatgtgcaaatgctatcgaggtgagccgatgtgccagttgactcatactggttcagattttctttccctctctctgctcccatggctttgttgaaggcgcataaaagataagttgcccacacttggcatctgtagccatgaatactgaaatcttctcacattggaaattctttatgttaaagtcaaatcaattcttagtactacttgattcagataagaatcattgatgctaaaatgagcggccgatattctggagaaccacagaatagctctcaccacaagataggatcagaagaaaacagcattcacggtgcagaaaccaggcaggcagcgcttaacaagtgataccagtgaacgtcaccagcggcaagatggatccgcacacgtgcccttgagctgatgcacaaagaacacaaaagatgatgtccctggtgttctcgacaaagagcaaaacccagtctattcctgaggcagccacggtataccagccaaggagcatggtgcaaagtgactcacccctactttaaaaatgcaaatcagtgactcacccctgctctaaaaatgtcatttagagtgactcacccctcctctaaaactgtcaatcagggtgactcatccctccactaaaactgtcaatcagagtgactcatccttcctctaaaactgtcaatcagagtgactcacccttcctctaaagctgtcaatcagagtgactcacccctcctctaaaactgtcaatcagagtgactcacccctcctctaaaactgtcaatcagggtgactcatccctccactaaaactgtcaatcagagtgactcacccctcctctaaaagtgtcaatcagagtgactcacccctcctctaaaactgtcaatcagggtgactcatccctccactaaaactgtcaatcagagtgactcacccctcctctaaaactgtcagtcagagtgactcacccttcctctaaaactgtcagagtgactcacccttcctctaaagctgtcaatcagagtgactcacccctcctctaaaactgtcaatcagagtgactcacccctcctctaaaactgtcaatcagagtgactcacccttcctctaaaactgtcagtcagagtgactcacccttcctctaaagctgtcaatcagagtgactcacccctcctctaaaactgtcaatcagaatgactcacccttcctctaaaactgtcaatcagagtgactcacccctcctctaaaactgtcaatgagtgactcacccctcctctaaaactgtcaatcagagtgactcacccttcctctaaaactgtcaatcagagtgactcacccttcctctaaaactgtcaatcagagtgactcacccctcctctaaaactgtcaatgagtgactcacccctcctctaaaactgtcagtcagagtgactcatccctcctctaaaaatgccagtcagactgactcaccccgccactaaaactgtcaatcaggatgactcacccctcctctaaaactgtcagtcagagtgactcacccctcctctaaaactgtcaatgagtgactcacccctcctctaaaactgtcaatcagagcgactcaccccttctctaaaactgtcaatcggagtgattcacccctcctctaaaactgtcaatcagaatgactcacccttactctataaatgtcagtcaaagtgagtcacttctctaaagctgtccatcggagtgactcatccctcttctaaaactgtgagtgactcacccctcctctaaaactgtccgagtgactcacccctcctcttaaactgtcaatcagaatgacactcctcctctaaagatgtcaatcagagtgactcaccccactctcaaactgtcagaatgacccaaccctactgtaaaactgtcagagtgactcaccctactctaaaaatgtccaagtgactcacccctactctaaaactgtcaatcagactgactcacccctcctctaaaactgtcaattcaagtgagtcacccctactctaaaaatgtcaaagtaagtcacctctaatctgaaactgtcaatcaaagtgactcaccccattctaaagttgtcactatcacaaagaccaagaaagactgaactgaaggattttctaaattgaaggaggctagagagacatgacgtcggtatgcagggcctcatgtgggcatttattttgttctagaaatgttcttgggagaagtagacaaatcgtgtaagttctgttgattagatattagtaccatatcagtgtgaatttttggttttcataactgtactctcattatgtaggagaatgcctttgtttttaggaaataagcactgaagtatttagaactaagggaaaatcatgtccataagtttctctcaaatagttcagaataataaagcacaaatatcagtgtaaatataaatatagagagagattttgcaggtgagagtaaagcctaaaatgttaccatttggagaatcgggtgacgagtgtctgagattcttgtatgatagtcttacaacttttctataaatctgacgtatgttaaaataacatatttttaaaggggggaggggaagcaacttagagtaacaatagaaagccatgaccaacctaaaataatttctcctggcggtggtagaatcccaattttgtgcacatgctcatgctcaggagaagctctgccatgttgccccgccctgcacggcagccgtaattcctactgaagcccagaccgcagtctatgctaagctctagtcatttattcaatttagcttaccaaagctacacctctaactgtctcggtaactcactgaaaatgtcccctcgtcatgtaagagccagagcttacctgcatttttctgatgcatttgtgactcactgagatgcctctgaagcccccagaggcttgtgaaacagttttagagttaatgctctagccccacacgaaggcatgtgcctcctgagaacagggttagattaagaattgagctcacatttcagtcacttttctttcagtgcctactcagcgtgtgatcggaagtagactgggttccgtgcctctgttgtgctgacggctctgctcaggcctgattgggcctgccctttcccgggccaaacgcctcctcactggacctgcctggaagcagcagtgcccactggggccctcacccctaccccaagaatcctgcatgagtcacaattaattcttattagcaagcgacagaaacctggcctaggcagcaaatgtgcttatgaaaatgtattagttaactcgtggaattgctgggacagccagggaaccagctcagagcagcctgggagatgccagccaccctatccgtgcgtgggtgcccttctgcacaatgccaggcaccgcagctcatgctgcagtgctggagccatggcttctagaaacctcgtctggctgcagctcctgcagcggcagaaggagttcttgactcagagtctgtgggagcctctgatccacaggaggcctgtgcactggaggtgagacaggggagagggctgcccttcagtgcagcctcttagctgctacagcgggaagctggttctgcctcttgcgaaaaacaaaaaaaaacgaaaaaaaattatcaaaatgtagggaaggcaatatacataatttaggcagccaaaaataatttttaacatttccataaaaatatacatttcatccccaagcagcagtgcctgtgagcagcctgggaagtgtggcacgcccactcccatgttggctcacctgtggggctggtgccccaggaagctgcccgcttacctgccccagacccagctttgcccaaggaggctctcaggaacagggatggtattggcagggatttcaggcaccacctcagggccaggggcagcaggagaagcaaagaaaagaaagccccccttggcaccctccggtgctccaggcagggctgatggtgctcacgacggtcacgtgtgtgtgcttacaaccccctgagcttcacacaggaaatggaaaacacttcagctggtgccagtgcagaaacctgactccagcatcctgggaaatgattgcaccccacaaaggagctaaaagcagcagctgagagaccctgaacagagaccccctctcaggaggctgcgaatcacgaggggcaccaggaatgttttattatgcaacgtttgtgataaaataagagtgaaccagactttcattgccatcacttaacacgctgtatgctattaatattttagaattgtggtcaagtgaacctgggggaggagaagcgtgggacttctagtttatagctcccaccctggaacctgccaggtgccccaagacacccctctgtgggcctcgtgctatctctgcaggaaggttccggaaaacatcttgaggcaaactataaattgcatttgtgatgtgattcaacaggctccgaaaaacagtgtgcacgatggcatgattattacagtctgcgtcacccaggctgagcgacgggtgatggcccagagctgagcgtctgagctgggacgggtgtctaggtccaggcttggacccgctgatgtggactgaattcgcttcatgcctggccccaaggcagccagcgcgttggtgggggctgccttcagattcattacaataagcgtgccgacctccagtgcctggtgtcccgggaacaccaccagtgggcactgggaaaggttctgcattacagggcacttggaaagactcccttctggcaccattcatctcaacagcagcacagagctcctcacccctgtgaggatgccgcccccacccgagggacagggaagtcttacagtagagacagaggaggctggtgaatggagatcagaggattgggaataaatttgatttaatgagggggaagactgcctggaccctgaaaggaagatgggaccagaggtggcaaatgtggtaaaaggaggggaattccagggcaaaaactatgaccagcctctgttgggctgccaggctgcggcggaggctgtgctgggtgggcgtctgagcttaagcatgggaaacgatccggtggcttcctcctaaaaggaacaaaccgaggactgaagccctcaggagtcgcgccagggtctcccggtgctgcaggaacccacagaggagttgacatttgtgtctcctgaatgcctgtccagcatccccaccgtaaggcagggttgctgaaggtagtcagaggagcagagagcggatggcaggctgccacggcgtactggggaagaggggctgtgggttatggggagggggtcatgccagggacgaccctgccttcagcatttgctaacgcagcatgtgttgaccagctggctgacacatatgccagggaaacacaagggtggaaggaatggtctcaccgtttcactgatccttatttcacaaccttcagcaagacacctggcaccccgggaccccactctcctgcctctaaagtgggcatgtgaggttaaaccatctccatgtcccctcctgccctgacgttctggacgtggggtggctgcattctgagcatcatctgcagcctgtcctgccttgtgtgctgccttctgtcccagccctctgcctggccttctgtgctgccctccctcctgccccctgtcccacccccccatcctatcctctgcactgccctctctcccaccctctgccctgccctttctcctgccctctatccctgtgccctgccatctgccccgctctctctcccatccctatctcccaccctctcatcttccaccctctgcccccctccccaccccacccctatcccgccctctgtgctgccctctcttcatagtcggaacttgcactcccagccctggtgcttcaaactcaggtggtctcagattgatcagcttgtgagagcctggtagtgacgctgagacacggggagtgtcctgggtggcttcgcaatctcttttaccaaatgtgttcaggcagccagttcctttgggtacagtggacctgggggagccagttgaggctttcctgaatagcaggtccatcccaccatcacaagaagagtgttcagggcctaccatttttctctttggccccagccccctaaacccagggaaaggaaccagaccagttctatctttctcagggaggctgggtgcatcctgctggctgtgggatctccaggcgaccaagagcagagaggcctgatgccgcccgctctactaaggaccacccaagccaggcagttagtcccgggggcagcatggctgagtgtgggctctgggtcgggtcctgtatctgcctatggccctgccctggttttacggtcttgggtgggcctcagagtcctcatctgcaccttccttctggattgtggtgagagttaaacgtgtgaattcacataaagtgctgcaacagtgcatgttcccagtaagtgctctataaatgccacctgtcatgttcccagtaagtgctctataaatgccacctgtcacgtgtccattgcccacagagctccacagtccctctaagcgtcgggcagctctcctgaccccagccctagtttgcaaaatggaggtagtgatgtgcacctctcttcttcatgaattgcccacaagcgtgaattgtagaccctcagctgtgaagggtgtgcgtaagaactcgtaaacatcccagtctgctcagcctgacctggtcacaaaccccagagggttcacagcagaactccatggaaaatgctgactcctgcttggaggtaaagcacctgtgctttaataaaacctcgcttccctcctgcttcccacacaccacacatgcccgtgtgcactgagtgatcccagcagacatgaggcctctgctctcagacgggtccctggggcttcctgtcttcggggtcccagcagacatgaggtctctgctctcagacgggtccctggggcttcctgtcttggggtcccagaagacgtgaggcctctgctgtcagacgggtccctggggcttcctgtcttcggggtcccagcagatgtgaggtctctgttctcagaagggtccctggggcttcctgtcttggggtcccagaagatgtgaggcctctgctctcagacgggtccctggggcttcctgtcttcagggtcccagcacacgtgaggtctctgctctcagacgggtccctggggcttcctgtcttggggtcccagaagacatgaggtctctgctctcagacgggtccctggggcttcctatctttggggtcccagaagacgcgaggcctctgctctcagacgggtccctggggcttcctgtctttggggtcccagaagacgcgaggcctctgctctcagacgggtccctggggcttcctgtcttcggggtcccagaagatgcgaggcctctgttctcagacgggtccctggggcttcctgtcttcggggtcccagaagatgcgaggcctctgctctcagacgggtccctggggcttcctgtctttggggtcccagaagacgcgaggcctctgctctcagacgggtccctggggcttcctgtgttcagggccccagcagacgtgaggtctctgctctcagacgggtccctggggcttcctgtcttcagggctttgcttgcagacagtgagccggtgtcaggatccctgcagccacacgtccagatgcagggggaggcgactcttacccaacagcagtgggggccatggagtgtccagcaagatcagggtgaaggatctccagggctgcagggagagaggctacttctcaggtctaagcaggaagcaaaggagcagcattttacagggtctgtgggtgtttgtgagtgaatgcagctacagagtgtttagaggaaggggcactggagggtgcgtaggaggcctgggatgcagggagtcccgcccagttactcaggaacacacagctgtgggcaaggccctccctgcctccacttctcatttaggtaatattaaaataaattagatgatctccagaatcccttcttgctctttaaattgtttttaatttggcaattattatctcacatggactcagaatttgatgagatgcatttgaaacttctaatacagaactggcacatagtagatgctctgagaaaggggattttcatcctcagcttcctgtggctgtggtttagtggtggacagacagagggacgtgacgcatggaccctcagtgtactgtggctgtggtttagtggtggatagatggaaggatgtaatgcgtggaccctcagcatactgtggctctggtttagtggtagatagatagagggaggtaatgcatggaccctcagcttcctgtggctgtggtttatcagtggacagatagagggaggtaacgcgtggaccctcagcttcctgtggctgtggtttagtggtagatagacagagggaggtaatgcatggataaaaattaaattcatccattcgcctcacatgtagactcaaaagcttaataaagtctaaactaattttccataattacagtgcaaatactgaaaatgataacaaaaccataaaatatattttgcagggaactagtttccttatctctgggagaagggttttagaacgacacagaagaagaggtgtctgtggaagtgttttctgaggcaccgcgctttgaagagtggcccgtgttttcctctgtttaccatcacgtcactggttcctgattgtctcggtggctggtgattcagcgtcgtttctctgtgacgcgtctctaggactgaccctgacccacagctctgggttcacctgcaagctggcttgaacagctggaccttctgcatcagggtctgcattttaacagggtccccagcggctcctgggtgtgctgcccatctgaggcccatcactctgtggccccatgcggtttccacgtggcctgaccgagtccactgctgaccacctcagaacaggcagtgtttgcctgcagccaaaggaagctggagggagaggggccaggccaggttgggacccgggaccacgaggaaggtgaacccatgaagggctattgtgacagccgtgatttggacgtagcaaatgtgggcatttagattttggggattctggaagattctggaggggatttaacctactaaagcaacgtgctaaatgcaggtgcctgcatcctgactacatatcaataactgcatttgcctgacgtgctaaacgcaggtgcctgcatcctgactacatttcaataactgcatttgcctgacgtgctaaatgcaggtgcctgcatcctgactacatttcaataactgcatttgcctgacgtgctaaatgcaggtgcctgcatcctgactacatttcaataactgcatttgcctgacgtgctaaatgcaggtgcatcctgactacacttcaataactgcatttgcttgacgtgctaaatgcaggtgcctgcatcctgactacatttcaataactgcatttgcctgacgtgctaaatgcaggtgcctgcatcctgactacatttcaataactgcatttgcctgatgtgctaaatgcaggtgcctgcatcctgactacatttcaataactgcatttgcctgacgtgctaaatgcaggtgcctgcatcctgactacatttcaataactgcatttgcctgacgtgctaaatgcaggtgcctgcatcctgactacatttcaataactgcatttgcctgtttgagcttcagtggaggtgttttcatcacctaaagctggtgagaactgtgcatctcagtcatgggagttgggtgagcagagggtaccgtgccaagtggcataggcagtggcctcctggctgactcggcaagtctttaatccacctgcagcggacttcttaccctgtgtacctgaaataaagcgaggtgtcctccccgtgcatcctgtagattccacatgacctgttttccagctcaagaatgggaattgctatccctggcagaggtcaggaaccagctctgactctgggtggcacctgggccagtggtgagcagggccctgtggatggggcctttggaggcgtccagggtagggagattccatgactcagaaccagtgtcgggaggagcagctgagctctggcaacagggctggtggcctcggttctcctccaggggctgtgcacctcgccagctgcaggtcagagggggcgtcctcagctttgagcccagggccgccctttctgatgttccaatggacagtgtttccttacaggtggaggagaaaaggagaacgagtgtggcttcaatggagccagccccaggaagccacatagacctcctctgccacccctctacctgcctgtggccgcgccccctcatcctgtccaagtgaagaggccatggatgtgatggccccaccctgccttctgaaacactcaggaccgggccccctcctccagctccccagcgtgacacacaaccttgccatcccccattgtcccatccctgccgtctgctatgggtgcccatggggtctcccaaacagcggtatccagaatggaacacagtgctgagatacggtccaacccaaacagcacaccaaagccagcctcctctaattcaggacaggttgcttttttaaattctgctcaggaacaggtagatatgttagcaaccattttgcaaattcaactaaaatctccctgagtttagcaaaagaaccatctcgggtgtgaccgctaacatcctacactaacactgtcgattcctgaaaacacatttcttatctaaaggcagagatttctctttatctcaggaaaatttcctcttgttggtttctgggatcagagtttcttcctggaccatttgcagcagtgacagcctctctgagtttctggggttttatccgtcagttgagggaatgggatggaagccatcaatggtctgacatttggacgtttgcccccaaataatttgagcaaagtcttccaaaggaggtctcgggcctgtctttgaaggaactgacacaggtggaaagacggggatgatgttctttggatttttccaactcaatgtgatgtagtgacatgtgctctgcctcgcgaggggaaagagctcccctccacaggccagcgcgcaggtggcgtttcccgaggctcaggcaggtggagcatggttggatggtcccagggggctggctgccttcttgccctgccagaacacacccacctgttgttttctcagtcacaagcatcataacttatggctagctgctcccacctcacctgcactgactggctcataggaaaagcttctggtgacttaagtgatttttataggtcagggttaagaataaaaaggcccagtggaacggcgtctctaaaagcatgcagtgtagggtgttgggataaagataaaaaacccagagtgatgttttatttatagacctttattgacacacacagcctaggctaaattttacattaaacactggttacaaataaatgtgttcacctgagtaaacagcctctggggtctttattaaaatggctttaaggagaaggagggatgtttttagctgccagtggtaggagacagtggaaggatggctggtcccagagcaggcttgccactggtggcatcatttgtaatatatattttcattttgctctgaagcacagcaaataggtttttgtaagcgagtgacctcaggattagctgtgttatttgtgacttagaaagcagtcagttgaaatattgaaagtattttcccaactcaggctggtttcagcggtgccgcagcgtgccgtgacatcgagcttgctaatgaataataaagacgattgccgctggtgatgtggaaggaaaagaaccaaccttactgcagatgccctttttccttcccagcaaaaggagcttatattgagaaacccatgggaacaaagtcattcttgctagtttgtgtccaactaaagagaacatttatcttgtttaaatcagcacttagcagtggtaagtttgctcttgttttccatccataattttcaatgcaattccaattctgcataattttcaattcaattccaatttcagtgcaattccagctttgccgcaggtgtggtctcacccactgtaggactgcaggactgcaggactgagacccagacccccatttccctttccacgcactctgttccaagtcaggatgcagtgctggccccatcgcccaggaaagacttccttctgcaagtcaccactccttggccccgtcacccagtatttaaaaaccaaaaatcccgtatgaagatgttgaacagaatcctggtcagtagagtcagaaaataatcatctctcttcaaaattctcctgaaagtttcactgcagtaataatctttgtacacatggagaatgccctttacctacagtttttaaggtatttgaacatctaaccagggacatctgcacttcaaataaaaacaagcaacttttaacctttgtttgtgacttgtgtttagtagattttatgtttagtgcagttttacatttacagaaaaatagagcagacagtccagagggttcccacgtgccctgccttccactccacgccccgtctctccattgctcccatctgtattaggatggtctgtttgtcacagttgatgagcccacattcattccatggtttacatcagggttcactcctgctgttctcttaggtggatttttgttgctataataaaattcctgagacagggtagtttataagaaaagaagtttatttagctcacagttgtggaggctgggaagtccgagggcatggcagcagctctgacaagggctttcttactgcgccatgccctggaagaagggccaatgagcatgtataatgagacgacaagcatgaggggctgggctcgccttacagcagccctccctgcctgcggcagcccactcccacaagaattatcacactcctgcaagaaaccatcagtccctcttaatgacctaatcacctcttaaaggccccacctccaacactgccacaatggtaatcaaatttcagcatgagtttcagatggtataaaccatatttgagccacagcaggatggtacattctgtgggtttgggcaagtgtatgatgacacgtatccatcatcatagcatcaaacagagtggtttccctgtcatgaaagcctctgtgctctgctggtacctctctcttcccccaactcctcattacctccaccacaacttacactgtctccatcctttgttcttttccagaacgtcttagcgttggaatcatgcagtgtgtagcctttccaggatggcttctttcacttagcaagaggcatttaaggttcctgcaagccctgtgtcatggtttgacggctcattccgttttagccctgaatgatatcctattatatggatacaccacggttgatccattcatctactgaaggacatcatggttgcttccaagtttgggcaattatgaactaagctgcaataaacatccatgtgcatatttttgtatggacataagttttcaactctatttagcaaataccaaagggcatgactgctgggtcatatactaataatatattcagtttttaattttcatgaagtcctgcctatcagttgtttttttcatgaactgtgcttttggtgttgtatctctaaaaagtcatcaccaaacccaaggtcacctagattttctttgtatcttctagaagttgtatagtttggcattttacatctaactttgcattaatttctgtggagggtatagggttgatgtctggattcactttttgcatgtgagtatcccattggtccagcaccatctgctgaaaagctggtcccttccccattgagttcccttgctgctttgccaaggattgggcagctctgtttgtgcggctgactcttaacttttggcttataaaatgtattgataaaacacaagtggtttgggaagtctcaaacatctcagcatttgtcctcgctggctagaacttcatgttcaaaagaagaagcaggcaggacgttcagacaacatggggggccttggtgtaggctcagagcctttgctgtatcctcagacccaccaatggattgccaagcgtgtccttgtaaactgtgaactgcgcttggtgctggcgctcctgggaggtgctgacttgagaatcttttattcctcaaagttttgagagaactttccagtcacacttagggccttgtgcttttctggaaggaagtttctttgaaaaacgttttgtattttcatattcatctattaatatttctttcttcattcttagccaggttagtaatttttattttctttgttcatagttcaatttcttggagttccaaattcttagacagcgatgcgttgcttaatgacgaggctgccttcagataaatgtttcatctggcaatttcgtcgttgtgcgagcatcacagggtgcacttacaaaacctgtagatgctacagcctcctacacacccaggttgtatgggacagcgctgctaggctacaaacctgcacaacatgttactatactaatactgtaggcaggtgtaacacagcggtaggcatttgtgtatcatttgcacatagaaaaggtaatgctttgcactgtggctttacgatggctgtgacgtcgcaaggtgacaggaatttgtcagctccgtcatactcttatgggaccaccacttgtgggtgtatgtggttcatcactgaccaaaacgttagtacgtggtgcatgactataaatagatatataaatggtcttaagggcttataagtcttaaatttccactgcatctgtgattatgtgtcctcctaattattaatttttgataattttagaatttgaggtgttttacttttcttgattacctctaagagtttatgattttttcccctaaaatcaagctcttgggtttattcaccaatcctgtattcccttttatagtttaatttatatttttattacttaatttcttccctcaagttttttgttacctatttactttgacgtcataaatggagtgcctactttgtttactgtccttctctcttatcatcatggaagctctcagtattcgaaacccacctccggggaatcatttcggtatctcccacagcctttattattctctaactattttgtaatttagtttccatttccttcttaacctaagaattattgaaaataatatttttaatacccaaatgatgagagagttttgttttctgtgtttattaatttctaatttattagattttgcttagagaatgcaacatttatgatttttatgatttaaaaaacatgaagtccttttttgaggcttaatatctgatcggttccattctggtttctagaccatagagcttgatcagtcgctattgaattctctttgtcatgttctcgggcccgctgtaggacccttgtgggagctagggagacttgtttctaataaggctctgtgttttactagccctgtgactttaggtaagttgcttaaccccctggaaaactcagtcctctttatcaataagatgggggcatttaaagtccgcacctcaggtggctgttgtgggggttagtgccgggtgcagttaaagtgccaagcgcagccccggaacgtggctggtggaggatggccgccgtcaggcccttccgtccctcaggctgcgagtggcatctctttgtactgtgatcacttcttccttattaatttcgatgtttatttcttggcacacaccagttcattaaccctatatcgttgtctggaattttataatctaatctaacattagtctatttattccactttaatcaataacttttaaacaaattgcacattttcttggtgtcgacgccatgacgccttctctccttccattcgtatgtctgatagattttcccggccgcgtcagtttgtaatctttctggacggcgttgttttcgatatgttgcttgtagataatgagtagtttgatgcgagtgaaggcacctgtcctaggaagatgacttcccctgctcccacgcgtcgtcctcactgtgtgtgtttctcgttaatcacaccggcccacgccttccagctcctcagcttccctcctgttccttcgatggtttacctgttgccatgtggatgatgttatagtttggttttatgttgttcccaggtaatttgttttaagttcttcacacttttcaaaagcagtaaggatcttcagatttctcattatcaacttcaagaacaatactaatttccttgtcttagaagaacacttcaggatacctcatttctcccacattttataaacggggaggtgaaggcctggttcagctttacatttaccatttcagaaggcacgtctttaccagcatccgtgctaatgtctgaagaaaaggacaaactaagaaaacgcagaacctaaggctatttgtggcagtgcgtccaggaagaatcttttaggggtaggtttgagggctgtgactgaaaattctcagaaaatgtgtagatgggggaatgtggccatttattcagatgccttttaatacaaaaaaatcttagtcaaatttcactgaaatttgcgttgggaaagccaattacatcgtgaaatgggtggaaaatcttattatcccagccccagccccagctcggcctgctgactctgatgtctagagatgaacaataaggagacaatttccatttttcctcgtcgccacgcaggacctggggccgtcccttccttgtcacttttattgaacatagcagtttgtccaggaccacgcgttgaaaattgctgaagataaacattgtattttaaattactccaggcaaccaggcagactgaaaaaaaatcatttgaacaattgaaaactgaaatgttgatatcagatattaaattaatgtaagtgagattgaaacaatatctaattaaaataatttgaaaaatgacttggaaattggagctgacattagcttttcccagcctgccgctattattactgcgcagccatgctccctttccaccgaagccccgccccccggcagaatccacaggagacccgcagatgagagtctcatttatttaccctgttatggctggaaaacaagggctgaagaacctttcttggaaccctgaggagtggagtttgacaaattgacctttcagtttccaaggagaaaatgcctttcaaatgctccacgccaatgtgcacttctgcgttgcaggctggagtgtgttcagtgccttcgcttcatacaggacattttaaaatgagagagagcggtttgcaacagcaaagaaggggaaccagaagctccccagctgcggcagcctgtcctggagtggccggggtgcgtggccagcccctgccgtggtggggaccttcagccagggaggaggacgtgtgttggacgtgtcctggagtggccggggtgcatggccagcccctgccatggtggggaccttcagctggggagggggacgtgtattggacgtgtcccggagtggccggggtgcgtggccagcccctgccatggtggggaccttcagctggggagggggacgtgtgttggacgtgtcccggagtggccggggtgcgtggccagcccctgccatggtggggaccttcagctggggagggagatgtgtgttggacgtgtcctggagtggccggggtgcgtggccagcccctgccatggtggggaccttcagctggggagggggacgtgtgttggacgtgtcccggagtggccggggtgcgtggccagcccctgccatggtggggaccttcagccggggaggggacgtgcactggcctgggggctcctaagcatctcctcgaggccacgcttatgacatcagaagcagtgcttgtggtgcaggtggctggagcaaggagctgcgtgctctgcagtgaagcaccaggcacctcttagaccacacacaggacaggcaaatgatgcgtcttggtgcttctcgaactcacctgctcccagaactgtcctcacactgtcttatggattacaggtaattagaggagagcagtttgttgtgttaaaacatgcaccccttcacagtccatgaggagccacctcaagctcgagagacctggctctccttcccagagcccccattttgaactgagtagccctgggccaacacctcccagaggctccagccgcccatctgggaccataaccaccaggccctgcacaggagcctgggaccatttggggtgagaccctctgacccagcactgctgccaggagggttagagatgaagaacctggggaaagcgtggactggggccgaggagagaccagcgtccacacgcagcaccacacaaagaaaaggtgtcgttgccatttctagttcacagtcccagcaagagtcacggcagattccataaaacactgaataattagcaattttatatacacatctgtgtttagttatatttagcataatataaaatcattagattatttcatatttagcctcccctgaggttttgcccaaacctgaattaaaatgagttttacttcataagcacaaagcagctggggcggggcagagatttcttaggagatgtgggagttcccatttctgctggtacgctggaagaaacaaatattgggactcaccctcattccaaaaacaaaactacgagaatatgaggacatagagataattttaacacatcagacatctggcaataattaaattattggagatcccaagccaagtgagagcaggaacccggggacatcagtggatgactgatgttggcctttattctgagaatcttctccacaccgggtaaacctgaacttcagcattcatgatcttgtggtctatagagggcaggaggcactaggaaatcctgatatggtaaggctaatagaagacatgccacatggagctgggacccccaagaaccatgactgcagggtaatggtgaccgatgatagagtgtcttctcagctctccattgggctggaggatggtaaactgcttgcgttcagcgctgttcctggatgtgtgtgtgtgtggcggggaaggcgggggtgggggggtggcattttcccttaggacattaaccacagccaagcttcacagggatgtacaatcccactgcatgctgcctggacagccacaacatctcaagcagggaattcagcttcaaacgctcccaggtgcacgggcctccagatgcctggcagagggaaaggcagatcctctctggaggaatcctttctttccccttctactcataaagaatacctgcaagtaaaattccaagaaatttgagtccacaataaaaaattttaaaacataccaggtaacaggacaaaagttaattgaaagaatggacaacaaaagaaagcctcagatattgtaactattggacatagatcataaatttaaatattttaatatgattaaaggaacataggaggaagctaaatataacctacagatcaatagtcttaaaagagaccacaatttttgaagaaatatattttaatgaaagatataataatagaaattctaaactaagggtatgagtttaatagcagattagatatagttgaagagagaattagagaagtaaagtatagaactaagaaattttctaaaacgcagcccacagagacaaataaattgaaaatatgaaagtaagggtaggagccatagagggcagagtaggagaatcttacctacaatgcataagtcttgcagtagagtaggaggatcttaaatgcagttcataagcattttagcagattaggcaactcttacacacgattcataagtgttccagcagagtagaagactcttacacacggttcataagcattccagaagcctatggagttcctaaggaaatactaatttaaaaaaaaaaaaggtagctacattgagagccaactttattgggaaagccattgccggggaagaggcacactctatcaccatcgaggatcatcttacacatcttacacatgatccatgagtgttccagcagagttagaatattacctacgattcataagtattctggcagagttggaatcttacatatggttcataagcattccagcagagcactccagaagtaatatttgaagatacagtggcagaaaaatttccaccactgatgtaagacaccagtactcagattccagaagcctatggagtgaaaaaggctctacacctcgattcctgacagtgaagttggagaatctcaaagacagagaatctctctgtttgtttaaaaagcaaaattttttgtctttttaaaaaaagcttacaaaattgagaaacctcctttgtcataagtgattttaaaaaagagaggagggaatcataaacaatattgagaattaaaattggaatgctaatatagatgctttggcatataaaagaataacaaggggtcatcatgaacaatttatggccatatatttgaaatgttagataacatgaccaaaataccagaatgaaaaactccaatagccctgtagccaaggaagaacttgagttaatagttaaaagtcttcccacaaagaaaatatcaggcccacatattttataagcaagttattccatacatccaaacacatgcactcatacacaaaacatcccagactacacagctcatgaggttagcataaacttgataccaaaactcagtaattacagtacagggaatgacaattagagagaaatttcctcaaaaacataggtgtaaaagccaaataatagcaaattaaaatccagcaatttatttttaaaaaatgtcatgagcaattaaagctgtaattaatgtagtctatcacattaatgaaaagagaaaaaaattattatctcaatagatacaggtaaaaacatttgctaaatattaacattcattcataataaaaatgttgaataaagtaagactagtttgttcttattttgattttttaaagaccctacagaaacatcatgcttcccagcaaaacactggaaatattctcttgaacaccagaaataagacagggatgtgggctctcacccttacaagcatttgtaggaggatccgttcagcaggcagtgaagcaggaaggagagataaagggtgcacttaggagagaaggagcaagcctgtcattattcacagacggcctcattatttactcagaagagacagaagaagatccaggtaaactaatggaattagatagtttaggaagggtgctgtatatgaaatcatgcaaaagtcagctgtatttgtatatttaggaaaaaaagttagaaaatgctgtttaaaaatgatactcatttaaaatagcatcaaaatttaaagtcccgggaatatatacatatgttaaatatataagacttttatggggaaaaatataaaacttaaaagatgttgaagacaataaatggagagatttacatgttcacagattgggaataatgatgctattaataacaatcaaacttctagattcaataaaattttaacaaaaatccaaaaactattcatttacaaacgtgacaagctgattccaaaatgtataagtacaaagagccaacacctgccttcgtgtgtagacagcataaactacttacactaaagtaagaaagatcacatggatctgtgcacggagagacacctgggccaggaacagagggaacccaggagtagacccttaaatagaactgattgataacagggttgacattacagatcagtgggaaggatggcctttacaagaaactttgatggggaaatggggtattcaatgagaaaaaaatgaaatgacctctaccttgaatcacatacaaaaatcagttcttcaatatcagacttacatgtgaaggacaaaaatcttttaggaaaaaaacagagttgtatctttatatagatatctttatatagatatctttagatcttgagctaaaggagaattttttaaacaagatgccagaaatgcaaaccttaaagaaaatgataaattagactgtattaaaaccaggaactttaagaagccaagccacaaactgagatatgatagttgcagcccacataactgacaaagttttggtatccagaatgtttgaagaacttctacaaagcagtaagaaaaagacaaataacccagtagaaaaatgggcaaaacaaaaatttcatgtaagaggaagcatgaatgatgaataaacatacacgaagatgcacaaactgatgaattatcaaagacatgcacattggaagcccaaggagatacaacgtaaatctaccaaatcggcaaagtgtttaaagcttaaaccaatgagcacacggagcactaggaactctgtgtgttggtgacaggagtgtaaattgatagaatccctttgggacatctatgtcttagtgattgtactggagaaaattctctacatgggcctggagacacgtgtgagaaggttcatggctatactgtttcagatatggagggaaaaataagaacccagtttcccaccggactgggtaagtgattggaaaaataaagcgtgatgctccatgtgtatagaatgcagtcacacagcaatgaaaatgcatgagccaccatgacatgcaaaaccgaatctgagtctcagaacacagggttagcagaagacggaaggcacatcacagaacgtgtatgttattatgtcatcttatgcagtattttgtttagggatacacacataggtgaaaaaaaaagtctacatacagaaactatgcacccagaattcatgaaagttattagctttgataggaccgagaagagctcacagagagtatcaaagataattttaatgttttatctcttttcagagtgtcaggtatcctggatgtttgctgtcttattattctttggaaccaacacatattttataatattctttggtatcttcctaatatttaatggaatataaatataaaatattaatatttttgaattacaaattaaccccaaaacttctaactttcaagagaaagtcatctgagttggtgagaggaatcatttccaggagcccgtgatatatacatgtttaataaaacactgaacgttatacacatgtcagtaggtgcacatctagtttatctccctaaacgtctttgctatttctatactaagcaggatgggaccctggctgttcaggtagaaatgagcgtctttgcatcgtggtaaatctctaagggggcatcttttcatcctggagatcaccgcattgcaagcccagtcaccatgcagacgtttctccatggggtgggtcttgtgggcacagcatcttgcctcctctcttccttcgggtggtcaggcatcagcccccgttcacgatagcacggagaccgatcttcatggatagcctcttcttggcttgctgtgccacagtgcctttggcctcaccgccaaagaagaaaagagagatgatgaacagcccacttccagcacaggcacaggcaagggcaccccccttctcttctccctctctgggaattaagctttaaatggcatctctggttttagtaaataattgtcaggaaagcagttatgttccagggttattttaattccttctgacagttagcaaaattaaacatccaaacattggggcaacatgctactttcagatgacttgatgtaaaatgattaacatcaaaacattttcttgtgttttgtgttgttgccgcgcagtggatcacaacacgttacaggaacgtgctctgtctgctgggctgatcgcaggggcgcacgcgcgctcgcacacacacacacacacacgtgccctgccgcatggcatctttctggctgtgttttgacacagtcagctgtgcatgggtttgctttgcatacaaacgatcaggttacaccacaccatgtgggaaagaggaagcgtccgccagctgtgcagaacggtgtacgtgtgtgattctgcgcccgttcctacggcgtacgtgcgtgatcctggacccgttcccacggcgtacatgcgtgatcctggacccgtccccacggcgtacgtgcgtgatccggcgtacgtgcctgatcctggacccgttcccacggcgtacgtgcgtgatcctggacccgtccccacggcgtacgtgcgtgatccggcgtacgtgcctgatcctggacccgttcccacggcgtacgtgcgtgatcctggacccgtccccacggcgtacgtgcgtgatccggcgtacgtgcgtggtcctgcacccgttcccacggtgtacgtgcgtgatcctgcgcccgttcccacggtgtacgtgcgtgatcctgcacgcattcccacggcgtacatgcgtgatcctgcacccgtgctcatggctggcagccggtattggaagagaatcatgagactgcaaatcaggaatcctcagatatccttttatcgttggctctttagttcaaaactagaactgtgggtgtggaaggtataggaaactccctccctgcaccactagtgagtgccaccactggtcttagtaatagaggtaacagtggtggcatgatcatcctagagatagtaatgctttaacgctgccactagggagttaatttgctcatgcttcctataagtcacttattcattccctcaacagataatcgttgaggtcctctaatgtgctggacagtgttctaagcactagggcaaatcctcgctttgtggaactgatattctagagaaaaaatagataataaccaagcatgcatcatgtcagagggtgataaatgttttgggaaagaatgaagctggatgagggcacagacaggtgatgggatgagggcccgatgttgggtgagaacaggaggaccatgcagatggctgcaggcaggcatttgagggtcaggaacaaacagcaggtacaaaggccctgaggcaggagctggccggggcgtcccgcgctgaaggggctgagcaggggcgagggggctgttggaggtgatgtcagggcagcagccaagggccaggttctgaagggccttgtgtctgtggcctggactgtagacctcactgtgggtgagatgcgccagcgcagggctttgaggagaggcttgagtgtgtgttgagtggccagcatcctcccccccccagtgtatagagtcagcccctgtccagctgtcgaggggcccaaggccagagggcaagtggcattccatgctgggcttctggacatttaaaagtctatgtgaagctcattagccgctaaaaaaatgcttcatactttgaaaaatatatgttcatagtgaaaaaaattattcaaatgtgcataaagctattgtttttatttctgaaaattaatccaatgaaaaagacagtggattggattataatcctgtgagtagtgatgttctctcgatgggctggtaaggtttggctgagtaataaattaatgacatacataattttgtaaattattgtatatttatttgtaaatgcattttattccccttgtttcatgaagtcactaattagattgtttaatgacgatcttcataaagttggggtgttttagacagaaatgattcaactgtaattgcacacagggtacaagatgtagaagtattttcattaaaaataaaaatgcacttaaaattgtaaactaaaactatgcttcaaaagctatttttcttcaaaaagatttaatgtgaattattaaaattctaaagccaaatataattcacaaaatatcaaaattttcaatcaaaagtatttaaatagagctgtattttaaattgtattttgtgacaatttaatcaaattgtagtccatatttttgtaagaataagacatttgcaattctggctctgagatccctgcagttgctgatgtcatgagctggttgcgtgagtcatgcatgtcctgtctcgacagacgtggaaaagtgaaagggattgtggggtgctgcggggcgcctccacatttgtccgtgagtacttctagagctgtgagccgacgtgcaaagaaacgcaagagtgggcacctggcactgccaggaacggatacttctttatgcagaaatcattggcttttctgtaacctgaacagcaggatttgacacgttcattaatttgtcttttctcctgcctaagtgcttctgctcttcaaacctccctctcccaggcatgaaaggcctcacgcaacacgtggcttccacagaatgcaggctgcaggggtggaggccctttcaaggctcgcatggcagaagtgctgggcgcaggggacatcatgctgcggctcggcctgtgcagcccctcccaggccgggcccggcaccatggatggaagagccaggcagcgcagttggggtctctgcaagatccagagcagagaatgagatgctggacgcacctggccacgcggagacgccggccggtcccatgtgcaccctgaggccagaacctgcagcctcaccaggcgcgctgtgctgtgtccgaggagaataaaggcggctctgcggctgtgggcctgagctcctggcaggctggggtcacgggggacagacaggcttggggaagtcggtgaggtcaggaatttgggtggagacaccattggacgtcctagtggaagtggcaagaagacaggtgggatatcagatccacagaaaggatggggctggaggaaagaaaatggctctgatcagtgaacagatgccagtcagggcctgaggactgaacacagcacatgggggcagaagagggtggaaaagagaagcctgaggcccagcccgggacaccccacacgcagcggacagggagatactgccacccaggacaccccacacgcaagggacagggagatactgccacccccaggacaccccacacgcaggggacagggagatactgccacccccaggacaccccacatgcaggggacagggagatactgccacccgggacacctcacacacaggagacagggagatactgccacccaggacaccccacacgcaagggacagggagatactgccacccaggacaccccacacgcaggggacagggagatactgccacccgggacaccccacacgcagaggacaaggagatactgccacccgggacaccccacatgcaggggacagggagatactgccacccgggacaccccacacgcaggggacagggagacaccaccgcccgggacaccccacacacgggacaaggagatactgccacgcaggacacaccacacacaggggtaaatgttcccgtggtgcccagctggccagtggccgcacagagctgtggcctggtcctctccgagcccacgttctcaccctcgggccacactgctcggtcacggggtaccccagatgccaccacacccaccttgaaggtggttttatgcttcatcttcccgcccccttggctgtccaaagtgtgacatcagcacagatctgagcataaaacactggtgacagcttccatggctgcttccaaacctttccaacaggtgtcagggtgtcaggatctcgggatctcaggatttgctgagtgagagtctttggttctgaaatgaagactgaagtgtcactgcacgtgtttgatgttaagacatgttagaggtcccagaaccaaagaagcttagagcagggccttctccaggaagcttcagaccctggcgagcccccagtctagaggggctcaggacacgtgggtccttcctaccctgcccctccctaaggtctccctcagcccctagcccatcctccacaccgcccgtggtcctgggagaacagcgtgtgccccagcgcccagagggtgagtgaaaggctcacagtgcacagtagtgagtgagaagctttaagaaggtttgcaatgtttaaacctttttttttttaggagttttaggtttggcctgagtgactggcaggctatttcttaaccttgtatgaataaagaccccattttttcatagaatacctattaccactgggagagcccagtccgggattgtccactccgagggaaggtggggcccctcatgggcctcacgtatggccctgctagagttcttttcagaaaacgacatggggaaagagaatgggctgaaataggaaagtatggacattgctaatttttaaaagattcctttacaggaattgtgatcagccctgcgaccaggtgggcctcatgttagtcggcgacacggcagctcgcctgggcccaggaggcctctgcactcccagtggctctgtggccaccctgggatgcccaaaaaggaaaggaggtgccggttgggaccagagctccaatcactgaatcaacttccttcaaagctctttccccttcctcttcccaggaatgacttccgctttaaggaaagccctcggctgggcaccttgctgacatgcacggggaatcctgaccagtggcttccagtttcaggaaggctgacctcagggcaggggcagagtccacagaggtccccaaattacccggagatgctgaccccctgcacgggggccctgggtggaaagtggcagcgttgaggcagcttgtttacggtggctgtgaggcacaggatgcaggtcttaccctaggggacgtcgtttcagctcggccagaaaccaggctccaccccataagggaggaggatccttcctaaggaagccagtggtgccgtccagaaagctggccaggctccaggtgacagcttcaccccgggcctgggtgctctccctcccctcccaccttctaatggagcaaagccattaagtgatccccattgtaatttagattacagaagagacttctgcacattctttcaggttaaaataacgaggataaagagagtaggcaaaattattccactgtagctgcctgcttaattatatggaatgctgcataaattgtcaagtgcaaagaattagtctgataaattaaaatactaattaaataggctattgcagaattttgagaacattatagggttccgcttcttcaggtaatttgcatatccttcatctagtgaatttaattttaaaggacttcttttttgtgtttggaaaccctttttgtctcccatgaagataaaaacgggctttctctgttattctgtgcctttattaaggcagcttctccaactgtctccacgccctggcctgacagacttgggaggcccagagcttggctcaaaacataactcagacctggcatttgatggacatctggctgaagcaggctttttcttcttttcctccttcaacatgttcagcagagacttaaaaattggcagtattgtcatggagttcataaaaaggaacaaaaggacactgagaatcagcaggtatttactttagacttaaaaggagtaggtgtgagtcctcagttacacaggtgtgggcaaaagtcccgcgagaggacggcgggctccccagtgcagacgtgtcaggatcagagctcagcacctgtcacaattccaccaacagtgtggaaaagggaatccacgcggccatttagagaaatccggcggagcatcaagggtgcaggaataatgtcgggaggtgtcgggggtgccctgagacccacaggatgccggggaccacgaggcattgtttttccttttaggcatatttgaggttaaaaaaaaatctgaagcaacaaaccgcagggctgtgctgcggaggctgcccttgtgccctggaggctgcccttgtgcagcgttcgcgatgcaggaggagggaggtgcgggcctctctgtgtttcgattctctctgccagtgagaaatctcaaagccagaaagtgaactagcaaggacaggcatcgctgaaagcggccggaacacagggccgcgtgaagtcagctgacgccccacagacactggctcgttccacagcgccaagggaacgcgtagacgcccccgaaaagcactcagcaatctccaaagagatttccctggcaagaagctggactctggggactccgggacccggattctgtgctttgtgagactccccggcacctgctcagggcactgtcgggctttccagaggatggtggagtttcttgacgtgagctggcaggttggatgtcagtgcccagcacagtgctggagggcatcactcagcagaccctgtgcagggccacgggaggggagcagtgacaccgggagcatatgggctctgagaagcggcctgcggagcccctgactcctcctgtgaaggaaccggcctgtgggggaaggaagagaccctatcttgggaaacaagaaatcaggagaatcctggtgacctttatcctattgctgtgggtgctgttagtggggcacacagcaattccactgtgggaggaagaccttgatagctgagtcacccagagcaaagtcgttgagcgatgcttcagctgatgtttgatgttcaaaacacaagcagaagcactgatcggcgagttaatagcataagagaccagagcacactggagtctcagacacgcagcagatacagcactttctccttaggaagtgacagtggcccggccatgagacatgcagcaaaacagccgctgtcacgagggcacatggattagtcgcttgctgtgtgctgagacctgggccatgctggctcagaggctcccacgtggtcctcacagctgcttgtgaagcgtgcatggaaatccacagcctggatggggagacggattgaagtgtgggaagcgcttgcgccggcacttggtgtgtggcaggaatgtagccactgccagcttcattacttttcaattattttactctgtgacttcgattttgacttacactgcagtctcagattagctcgagaatgaaactgtcccttgtactctcttaaaaccttttagtataaaaaaaaaaaaggaaaaagaaaaaaccaaacactaattcaggttgtttgcttcaatcgctgatttaaaccgactgaactacattttaaaaggtccagtcagtttcgagaggcagcaccgtggggcatgtgggagggttgtcggtggcacatctgttcacttatccgtatttttaattttcagcttttattttagaatctgggagtacatgtgcaggcttgtgacctgggtatactggtggtgctgaggtttggggtacacttgtgacctgggcatactggtgatgctgaggtttggggtaccgtcttgcttgctcccgtcttgcaggtagtgagcacgtcccccagagggagtttcagcccttttctcccacctccctctcacattccctctcacattccctcttacgtgtctgttgttcccatctctatggctgtaagtacccgatgtctggtccccacttccatgtgagcgcatgtggttctctgatgagtgtagttcccacttccgtgcgagagtgtgtggcagcgtgtggctctctgatgatgtctggttcctgcttccgtgtgagagtgtgtggcagcgtgtggctttctgcttttgcgttaatttgcttaggatggtggccccaaattgtgtcctttgcagcaacgtggatgtatttgttgaagaaagaacacaggcccctaagcatcaaagtgcagtcatagaccctgaagaaccttgcctgtcctggagaggctcacaatcagcttgggaggcagctctgctaggagctcaccacgatgcctgtttcactgacttggaagccatttctcagctcaggtccactgaagagcagagacggtgccgttgaaccacagcacgtgctttggaatcacctcagatgatcttgtatttattgaacaaactctctcagactcgtttatcagcctcactctcgcatcggcatctaaaaggagttttagtgatcaatgggttaaagaatcctgacgcgcgtcacactcggaacccctccactgagtgcctccacagcacaatgctggtccccacgtgctcttgaggccacggtgaggttgatttccacgtactctccagaccaccgcggggctggtccccacgtgctctccaggccaccacggggctggtccccacgtgctcttgaggccacggtgaggttgatttccacgtactctccaggccaccgcggggctggtccccacgtgctctccaggccaccgcggggctggtccccacgtgctcttgaggccacggtgaggttgatttccacgtactctccaggccaccgcggggctggtccccacgtgctctccaggccactgcagggttggcggcaccacacttctcatgagtgttccactgcagccaacaagatcatcctctgagtcactattggccgcagctgacgccctttccggaagttctgctgcagcgcgttcctggcctcacaggaggcccagtggaaagtgcttaagtacaaacaaggactcattccctccccaaggcctccaaggatgcaccttgctgcactgccaattcagggtggcgggagttgcctagtcactaccgtgctggcccgtgctgcgaccccacttcagctgggggaagtgtgcactccagaaccaaggaaacacggacaggaaggtcccacttcagaaccaaggaaacacggacgggaaggccccgcctcaggacccaggaaacacggacgggaaggccccgcctcaggacccaggaaacacggacgggaaggccccgcctcaggacccaggaaacacggacgggaaggtcccacttcagaaccaaggaaacacggacggggaggccccgcctcaggacccaggaaacacggacgggaaggccccgcctcaggacccaggaaacacggacgggaaggccccacctcaggacccaggaaacacggacgggaaggccccacttcgggtgtaaacaaagcactgtgccagcacaggggacagtttgcatccactcagtagaactaattttactttctcaggaattttgtgagcccattattcagtacagccattgtgaaacattgaatgataaaaacatgcacttaaataaactatgttaagagcagaggcgatccatactaaagctcaccattttataactggttttctacattttactgtcatcggcacccttgagattatttctgtcctccacgtctgcatggtgggaactcttccccgcacgcctgcaactctgtatctggttggttcggccccgccatgcctcatgttgaaattcggtccccatgtgtgactctgcatctggttggttcggccccgccatgcctcatgttgaaatttggtccccatgttggaggtgcagcctggtgggagggctttggatgtgggggagggacagatggggcggggcagatccctcgtgaatggattcatgccctcccagggtggaggtgagcgacttctcgctctcttaactcctgtgagagctgattgttaacaagagcctggccctccctccgccctctcctgcttcctctctccccatgtgagctctgcacactgcatggctcccttcaccttccactgcaagtggaagcagcctggggcatcctcagatgcagacacctgtgccatgcttcttgtgcagcctgcaggactgtgagccaaataaacctcttttccttgtaaattgcccagctttgggtgttcctttacagcaacacaaatggactaagacagtatctctccccattccctttagtagtgtcacatgagcactaaagtcaactgtgatgggagcatttacacagagcagaaattacccagtgccataatttacaattctgttatgcaggggacaggcagcctgcacaccatgaactgtgagacacagagggccgtgctgaggatgttgagggagggggtgcccctgagcacatgtagggcctgagcttcctgggaggaggactgcgttttcgtcagactgaggagctcagagcatcctggcaggggacggagaatgcctgaaatgtgctgaaaagcccaatatctgggcaaggagtgccacctggacctcagggccagcaaggcaagttctccatgcctgcaggggacaccattgaaaggctttgaagggccaccgaagtgtctggatttggagccagaggtctggatgttgaggtcaaggatggacagacacccttagactcactgctcgtgacaccctgggcacagtgtggagaatggactagagccagacaacctcttggcaaccacagtctgcaggtcaagtcaggcccactgtctgctgttgtaaataaaggtttgttggaacacagccatgaccatccacttaggcgtggtctgcagctacctccacgctgcaaggcagggctgagtagctgcgacagagccgtgggcctgccgagcctgacccagttgttacctgcccttcacaggaaaagggcgctccccggcagattggatttttctcattactatgggctggggctgccgttttcattcctgaccctgacgtcggtgaccgttctgcagcagtgaccagggtggttctaaggttgcatttgtactcactttctgttcctcagcctgcttaaaagagtccactattaccctcctgagagaagcttgccaatctgtcagatgtctcctctgtttgcgggaggacagcagcaccgatggccttatagctctcttgccacccaaggcttacatttgtgtcctcccctcccctggggctctaccccatcataaagtattaaaggagttttgctttagcccagactgttttctgtctgtcttgttctttcagcgcagtaggtaattagttatatgtagaaaatagtatgcatttgctcaaagggaaaaactttccataagacaatggagaggccccaacagcagggagggcaggctgtaacaagatctcatcgcgtccctctccgaaaggaataatttcattaccccagattaacacaggggcgttacaataaggggtgagagtaattgatattttcctgctatctcatcctgtattaatcacaattgcaaggcactcttcattcatagggtttgcagtgaaattccatttttttctggttttcatctccaaagtgacaagggctttatgcaaacgcatatttccacagagtcgtaagccaaggtcaattgccttgtgacacccgtcctctctgtgaagtggggcaggtgggtttgctgtgttggtgctaggattactggggtttcatttccatctgctaattgtttccagagctcatttcccttggtttgccatcgagtgcaattcattctctgaaagtcttcctcattctacatcaggagaaaaccagggtgaggcttttattggagcgaaattattataggatgttcctgtcagggcatgaacaagaggctgcaaaatagctggcggtgctgatggcagaaatacacacattcagctttgccttctacggagtcttttatcaacacctaatgctggttaatgaaacatatttcccagtaattatacagctagaaacgattacgtaattttaaaataagacgttgcagtttgcagaatgtctctacatatttctcatcagtgattcatagcagtcctggggacccgggtgggacacccctttctagatgaaaccaaaagcgcacagttgtgccggcccgaggtggacgcacactgggtcagtgggaaaatggggcctcgtgcaggttctaattctgtgcctgttcatgacccttccattaaggtaggcgggtcaagcagtcatgtaattgaaattttcaatggaggaaaatactcagaggtgcccggagactgaggacctctccaacctgactcttgtgctttctgatttttcctaacagttgacaacaaagacaaactggaggaaacctctggactgaaaattcttcaaaccggagtcgggtcggtgagtaacagaaggggtgccgtctgctctgcgatctgcagtgctgtctgggtgctggcgaacaccgtgagaacagaggctggacctgcaggttaattcagccaaggtcctgttttcctgggaggaccagtgggctgcagcaggagcatcctctgcgggtgggaaacggtggcgaaacgtgcctggcgagttcaatgatgtcttagggcctttgaagtcctgatttagtatccccacaagaaaaagcattcatggctaagaagaacggagaagccttcagaaaataggtgcttccttccttcttcagctgttttgtagttgccaagtgtgtgaaaatgaatatgggctagagggattactctttcctcctgggactcagtgggacatacttgtatcttcaatatcgaaggacgcacatttgggagaggcaatataaaacaggaaatgcttccataatatcactgaaaatctatcaagcccctgtgtgtgcaaaccttaccatgctggtatcagagaggcaatgcttccataatatcgctgaaaatctgtcaagcccctgtgtgtccaaaccttaccatgctggtatcagagaggcgctcggccagcctcctccagcagctggagccgcaggcgcctccccgcaccgcgccgatggccgctgtcccctgacatgacaacttaatgaactgcacacagagcgcggacgcgcctcctctgaggaatggcgtgtggccactcgtcagtcagtgtggaccgaagccaatctgcgctcccgcgttcgagatttcgggtttcacagcgctcgccattagagataattaactgtgaaggagcgcttatttatgagtgtgctcgctgcacagcagagccgccctctgcggagccacttaaagacaagctgcttctgtggggaaatctcgtcctcaccaggccccagactcgggctcttgaaataagaagctgcttaattggccgctcttcccaaacagaggttcttgcgcttcccatgcagagcctgcttaagaatagcctgaagggctttgaaaatggctgcgtctgggttaaatgacgggcagggtgtgggagaggagagcagccggcgactgatggaaactggcgtgcacgtcccggacaggtgctcctgttcttggtgtttctcgatgccttcctggctcgtgccggatgaatgaggtgttgggcagctggtgatgccctggtctttcccgggagcttgctgtctctttagcacccagtgaagggtgagaaagaagccaagagtcttgggggctgccgagagccacctgcatcccacggaaggtgcagtgaccgatgcggaggggccaagtagttgcaaggtggagtcagccgggggtggctgtgaccgggccgtgagtctcctgcatgtggaagatgtgatgtcggaggtgcgtctcctgcgtgtacaaggagctgtggtgtcctcctgtctttcctctcccttccgagctcatcacgtggggtggtggttggtgctaagtcattcctagagggataatggtgtccaggaatttgggacaaatctagatggactcaggttagagccatctctgtaacctggtcagagaacgcgtcgaggctgggaccctctgctgtactgtggaatatttaggccccgtgagaagcggctgtggtgggtggggaggtgggtcctgtggacatgagggaggctctgccctgagagggctggaggggcaagggtgggggacggggaatgggagactctggggttcatctgggaggtgacaagtgtggtgcctggtgtccagacacaccttcctcattgaaacctggactccggccactccagaaaagaggcaggacatggtgacaggtggagccactgactgggcagctccagcccaagtggcttctgccatgtgccttgccacaggttgcctcttaagcatggaaggtcagatgctgttgtctacgcacacgtgagcctgggggacagcacctccccggctgcccactcacaacggagctccttcccacgcacacgtgagcctgggggacagcacctccccggctgcccactcacaacggagctccttcccacgcacacgtgagcatgggggacagcacctccccggctgcccactcacaacggagctccttcccacgcgcacctgagcctggaggacagcacctccctggctccccactcacaacggagctccttcccacacgcacctgagcctggaggacagcacctccatggccaccctttcaggacagagctgctcttcccacgctggaggagccacagggcctggtcgctgtggcttcagcctcccagctcctcctgtcctctgctgggcacttgtaatgtccaggcactccctgcttggatcaggggatctgggtttcatcttcccagctcctcctgtcctctgctgggcacctgtgatgtccaggcactccctgcttggattgggggatctgggtttcatcttcccagctcctcctgtcctccgctgggcacctgtgatgtccaggcactccctgcttggattgggggatctgggtttcatcttcccagctcctcccgtcctcccctgggcacctgtgatgtccaggcactccctgcttggatcggggggtctgggttttgtgctatacttggtgctccctttcactcaggccccttcttgactctgcagagctacccctcgccatctctttcacgcgggcctcctgcagtctctgtgctcaccctgtgactctgcttcctgtgttgtcaaatgggggtcatcccaggacccgcaccactgggtcgtgtgcaggtttctggggtggcagagtgcggatgagtgggcacgcgtaaacattcactctcattcccatcacggtcctgacgcctccacagcatttgattaggcagggttggaccttcttgttccatccaccctgtctcagcaccctctgtcgcgccttcacctctccctccctcgatgctacacgacagattatttcctgaaattgtctcccacgttccttcctcctctgtctaatctgctgtaaaactcaaatgctgggtacttttctcttggttactgtatttttcacttagaaaaaaatttttatttagtaatttatcaaatctgttattttgccttctactttgattatgtgtttgatatcttcttttatcttttcaatcattttaaacctacttattttatggtctcgtccagatcctctggcttattttatggtctcgtccagatcctctggcttattttatggtctcgttcagaccctctggcttattttattgactcgttcagaccctctggcttattttatggtctcgtccagatcctctggcttattttatggtctcgtccagatcctctggcttattttatggtctcgtccagaccctctggcttattttatggtttcgtccagatcctctggcttattttatggtctcgtccagatcctctggcttattttatggtcttgttcagaccctctggcttattttatggtctcgttcagaccctctggccgtttcctagtcttcgctttctacagctcctgctcatcacatctgctgaccccctcctgtgggggaggggtcctcttttgtggttgatgaagtctttttttagaattgtgagcttaccctcagcagggattggtgatactgaagtgtgaatttctatgtgagagtttctggataagaagttctgccctcagtgtcccagccgatccactttcctgtcaattgcccacctgggagtttctgcttcattcaataaagtgtggaccgtgctctggcacatgcacagatctggggttcagccccctccccacttccccagctggtaggtggtctgttcctgggcttcaatcttgagggaggcaggtcctcaaggtcctgggcttcatgtggagtccccatctccatccaccccaaggccacatgggctgtcctcgtgtgactataggaactcacaccccagctctcagcttccacaggaactcacaccccagctctcagcttccacaggaactcacaccccagctctcagcttccacaggaactcacaccccagctctcagcttccacaggaactcacaccccagctctcagcttccacaggaactcacaccccagctctcagcgtccacaggaactcacaccccagctctcagcgtccacaggaactcacaccccagctctcagcttccacaggaactcacaccccagctctcagcttccacaggaactcacaccccagctctcagcttccacaggaactcacaccccagctctcagcttccacacacttggatccacagaaagatgccaaacgtccaggagccacttcagcagcagctcccagtcacgcccggttttgattgctcctctcagttttggagtctggagatccactttcttcctgtgctctcggctttgtgcccctcagagttgatgccatgcgtcatgcgggatttcgatgtgcgtgtgcgagggtccctgctcagcctcagtttagtgagctgttcgttcattcattcctaggtatttatatgcgtcaggcaggttttaagaactgaaactacagcagtgactaaaacagacaaacccttccatcacgagctcccattccaggtgaagctggaggtgtatcgaggaataaggcccattgtttcctctgaaggcagaacccagccgtcccctgcattgctttctgctctcactgggcgcgacggccatctctgttcccttcaagtcgaccagctcctcctccgtgagttctacagattggactctccagggcctggctccctcctcctttctgccggtgctgtctcctgtggggaactcacctgggccctggctttttatgttatctgttcgatgatgatcccaagcctacgtctccagccctgacccattcaccgagcaacaggtgtgtatggccacaggtgtcctccttttctctcctgggagatctgtagaggagcctcacacttaaagtgggccacgcagggctcttgatcttcctgccgcagcctgtttctcccgtcaggttttcttatctcttaatggaaatggcatcactgctccttgtgaagctctgtctaggaagtagattgattcaatgcatggaaatctgaattgctgctcagattatctgtgaagtggactatttaactctggaaagaattggcctctgcccactcctgatgcccacccatctcatatgtgggaaggaaggttctccctagactgcgggggaccgtgggggctgagggcagaggcaggagctcacctgcacagcaccacacctctgcttccatccacatccaacctgtgtcctctctggcccctgagcgagcagaggatggaccttgccattcccaggggcagaggctccgtcatccctgggacagaaaattaccaaacgctagagtgtttatttcacccactggttacgatctggccacaaggagctcattcaccctgacctgcctgtcttcctggccttctccagacatttctttgttctcgttccaccaaatgctggagaccagctcctggagcattatccttctccacgtggccattttacatttcaaaagatggttcttctcgagctcttgaccccacggacatcgtgcccagagggccctcaagcccagcatctgtgtctcctgttgccccaagtgagtgcagaaagcaatgcaggtgacggctgggttctgccttcagaggaaacaatgggccttattcctggatgcatctccagcttcacctggaatgggagctctgtgatggaagggtttgtctgttttattcactgctgtagtttcgggaggtttatatatttggagtagatttgcagtggtgaaaatgggagaaaggggtacaagttgataaattatttaacagctaatgatttttttttctaattttaattgccttattcagtattaagcctgaatttgacgattctgatttttaatgtatttaaaattcttctaatccctgactctggaatataaagcagagtttgattacagaaatctaatagcatttactaaatctctcccctgcgcttgcgtttaatgcaagtgatgacagatagtggaattaaaaccttttaagccaaatggaaatatctcaaaacaaaatttaaaggaaatgaacagattacagtgcagatacacacccctcatagatgggtggcattttgatgtatttcaaaatctaatttctgatatcttgaaaagtatttgcattttattcaaattaataaagccatgtttttttccaaaggaaagtgataatcaccaaaaagcaaaactcaaaagtttggaagaaaaataatttggataaaggcagatccatggctccaaccttctcagttgtgtccagagttaggggtgcgttctagcttcttagcatcatgatagagcagagaggtcccctgcccagcgttctagcttctaagcatcgtgatagacacagaggtcccctgcccagcgttctagcttctaagcgtcgtgatagacacagaggtcccctgcccagcgttctagcttctaagcgtcgtgatagacacagaggtgccctgcccagcatgtcagtgagaagtggccgaccctgagtctcagcagagcccctgcaggctcaggagcgtgaacaagaggaatctgagaagaagctgaggggaagagctgctcagactgggggctgtctgggtggcaaagagccccccatctctgctgagggagccttctctctgtccagtgtgggatgaggtcagaggtcttcagatggttattcaaggagccctgggggctccaaggcagttgggtgtgaatccctgctcagctcacgctaccctcacactccggctcagcaaggtccaggcttctgttgcctgctgctcactgggcttctgggtgagactttgttccaagaaaggattctgtagccaagaatatgtggatcccaaaagtcccttaaaagtctatgaacctatggtcatgcatccaccccatgaaaaatgtgaatttgccatgatatgtgttacctgggatggggggtgggggtgtgagaatccaccccatgaataatgtgaatttgccgtgtgatgtgtgtgttacctgggatggggggtggggggctgtgggaatccgccccatgaataatgtgaatttgctgtgtgatgtttgttacctggggtggggggcggggggtgtggggatgctcagcacttgtcacagggagcaagcagtgggcagaactgagatgggtgacggatgtgttcgaaaccagcttcatttccccctgacttccaccctgtcatttcctgtctgtgcaaagaggtttgctactgtacacagctcctacccggttgcttggggattaccaagaggagcctggacattgaatgcagactttggccaaatcaatagcaggaacatatcagctgtgatggctcgacatggccatgcaccttctccctggggtcttgtcaagatgcagatttcctgcccgcctcaccagatgcctggttctgcacacccaggtgtgacccaggagaggacgggacagaggggggcctttgcccacaggtgaagagagccggagtaaggaggtggggaggtggggaggtggggaggagctgcccctgcttgtcagggtgacagctgttgttgctctgcggtgcccagcagcaggaccgtgcctttgtcaggcacattaaatgtttcaggtggatccaggtggatggatgaggctcttggctggaagaaatgctatttgggaaatgccaacaggtgaggtggagagctggcaagcagaccacttgcaaagggctctccagccaaaatgatttgtgtgagaccggaggccctgtggtgctgggggcaggtgaaatgtcagagctacagtggggtgagaaatccgtagatgttccaatcacatcctaagtctaaagtcctattattttgttgttgttgtttgagacacagtctcgctctgtcgcccaggctggagtgcagtggcgcaatctcagctcactgcaagctctgcctcccaggttcacgccattctcctgcctcagcctcccgagtagctgggactacaggcctctgccaccatgttcagctaatttttctgtatttttagtagagacggggtttcaccgtgttagccaggatggttttgatgtcctgacctcatgatccgcctgccttggcctcccaaagtgctgggattacaagcctgagccaccgtgcccagcctgaagtcttatttttaagattagtactgaaggttgcttgagaacaacagttttggttttataaataaagaccaaatgtgataaaactcatatacgtacactccatggtaggcagggtgaatgagtctaactctttagaaggcaggacagcagtggtcatctgcaaaccaacaaacaaaaactcttcccctttggctcagtaatcaaactccgagaaatgtatcctaagaagacactccatcgagcaaggaaatcagaaaaacaaaaccttcaccaaaaaaaaaaaactgacttaaaatataaaactatagcaaggtaactcatcattaacaatcaaataaatcaaattctgtgatttcatttaaaattttgagaactctaaacttaaaggcagctgtgtaaacatgtgtgtgcacagagatgttagaagcccatgtacgtaacaggtgaataagagagcagctcttatggggttgatggtggcagcagaagaatgacgaggctcgtaattgggaaaggagagctttattccttataaagagctgcatcctgcaggacagccaacctgaccagctgggaagcgtagcctccggccagaagccagaaacaggcacttctagtgagaggcaaagggaacaggaatttatgctgagtgggtggctaagtatacatattcagcaggttatgggaggagccgtgaatatttgtgaaggggagacacgggcatgcatggtcagctaatgtttgcaaaatgcatcccatgttcactggggcatggagacttaacatgtaaacagattacagttaggcattctgcatcaaaaggtgaagctgaggacatgaaggccctccctgtgcagcctccacagactagccagaggcactccgtgaatggggtctcttatgaggagggaatgctgattggttgttgggtcgaaaccataaaaggaagagcagtttcaggcacttggtggatatcaggaatggagtcttttaaaagggctggtttctgttcagccctcagagaaggaagcctggtggtgattagttgagaggggggcggtaaccaggcgggtctgaacccagggaaggaagcctggtgatgattaatgatgggggcgggtaaccaggcgggtctgaccttcatcctgtcacggtcccaactcagttttaaggtttctctggggtcctcttggtcaagagtaggtcattccgtcagttggggctttggactttatttttctcagtggaattgcaagtgagttttttcctttgtccaaaagtttttatattatttctgacttcttattttgaaaccattatagattcacagggaattgcaaagttataacaaagaagtctcatgtatcccttacccagtgaggttttcccctggtggttacgtctgggtaattataaaagccaattatggcaaaaccaggagattgatattggaacaatgtgtgtgtctagttctatctcattttacctttagtaccattttttacaacctaaataaagagaaaatatgtaaccaaaggaaaggcgtttacacacacattagcaaatgtggggacctgaggggagcagccaccatctgggacatggcggcccccgtcacccattgaccgtggttgctgtgggaaacgctcacagtaacgaaagtcatcagacatccgtgaagattctgcgtggcatggtgctgcgcgtaggccagtacatgacaaaggtttaaaatcactgctggcctttagatgagggcctgtgtttggggattcaagagaaggggcattggatgttggggggtgggggggcgcaggatgggctggtggggcagagagcacggccacacgttcctgacggggcccctggagcaggagcttggaggagcagctcccaggaggaagagaagctcacgtggtcagaggtaggtttgtcagaatggagcgaaagcggtgggttcagcagtatctgaaggaagagatcacagctcctgaggctctggacagtggatctaaaaagcctgaggtgtcagagttcacggggttccttgggtaaggtgactgagctgagcttgcgaaggtaacagtgcgtttgatggtaatgctgggtcacaccaaggatagaagcctggggggaccactgaaccctacatctcatgctacggcttgtccctagtgccggctcagcctaaagaaccaggctgcagtgactggggtgtaacactccagcaatctcagaccgtccgtgagcccaagaaaaaccagggtctgtctctccagaaacattcactcacaccccccaagacagcgtgcgtttcagggagcctgtggcatctcaccccagaagcccaagagcacatgggaagctctgccaagggtgggaggcagggggcggtggtgcctgtgtgggctcttgcccactcagtgcatgtggtgggctctggcagtactggggggagtgggtatggtggagagcaggtactggggggagcaaatactgggtggagcaggtattggggaagcgggtactgggtgaagcgggtactgggggagtgggtacttggggaagcgagtactgggggagcaggtactgggggagcaggcactgggggagtgggtatggtggggagtgggtactggggggagtaggtaatggagcagttactgggggagcgggtactgggggaagtgggtactgggggagtgggtactggggagtgggtatgggggttgggtactgggggaagcatgtactgggagagtgggtaatggagtgggcactgggggaccatgtactgggagcaggtactgggggagcgggtactgggggaagcgggtactggggggagtgggtactgacgagtgggtactggcagcagcaggtaatggggggagcgggtactggaggaagtgggtactgggggagtgggtactgggggaagtgggtactggggggagtgggcatcttttgtcatttcctgcactgtcactctattttattctaatatgcattagttgacagatggttttctcctaaatgcaaaagtgcctcagtcctaagaaaagcctgtttactggtaaatattcctaatttgcgtctgaaagggaaatctgcatgaaattgcattaaaatatttgcatcagcccagcccaggcagctctgcattcagcccatctgaggaccccagataagcctttggttggtgggaggtcagaggtcaggagcagccccttctctggtttggctctgtggtgaggacctcaaatgccccaggacaggcctgtcatgggtgggctcagctgatgaggacttcgatggccccaggacaggcccgctgtgggcttggctgtgtgacaaggacctcgaaggccccaggacaggcccgtcatgggtgggctcagctgacgaggacctcgatggccccaggactggcccactgtgggtttggatctgtgacaaggacctcgatggcccagacagccccaccgtggtgggcttggctctgtgacgaagacctcgatggccccaggatagacccgctgtgggtttgtctctgtgacaaggacttcagtggccctggggcagccccactgtggtgggctcagctgcaccccatcagcctgcttgctgcttactgctcttctcactctttttctatttctcaaaagtgaagaaaaacacaaaaatgtattttcgatataattaactgcacttgacgtattgacaaataggagttcatcatgaaacaacatcttttcctcctggaattgtgaatggcacacaggtttccacgttgcgctggctcacggatgccttctcaatactttcctgtgacttaaaggcaggagaggtgctgtgtgatgtggctgttgctatagcaacacattcaatttttattcaatatcagagtaaatagtcacataagatgaaataagtcatgtctgcctgtggcaacggcagtccctgcttctcgacatgcttccctccctccctgtgcccttttctaacattttcagctgcatttttataaaaatatgcataatatagatttcagtcgcagggacacggcttattgtctgaggtggggacttggtgatgtctcccgctgaagaaacggaggcccgccttgtgcctgggtcttagtggaaggcaagattgtccctgcaggttccctagggagcctggctcacgtggcaccaaagttcatttttatttaaacaactgaactctagggatgttcataaggtccctcagtgtgtaataatccagaaacccctttcagtgggtcaacccatcagacttggagttgcttaaagagatgaagaaaattaacaggatcctgcaccctgaaagctcctgctgcagctttttcagaacggcagcagcacagtggcagcaacagttgtgatgctcgccccctcccggggtgtgttccacacttcacatgcatgtcatctcccttgtccccaggaggcaacatttcacagaggggagactgaggcaggagaagtgacatggcagaaccggcagccggtgccagcaccaggcagcctgactcaggccaggtcgcactccctacactgagccccacatcaaattaagttccttttctcatggagattcctgaaagctgaaatgtccttagctacatctatagcacattcgcacctggtatactccatgaatatgaaacttttacctggcagagttcatgagatacaggtgggaaaccctaattttcaaccctggaattgtccagctagggacatggacgctgatgagcagagcccagaggtgtgtctgtcaggggaaactctcctgttggggccagcaggaggaacttggcttgtttccagcgtcaggcgggtgcatctgcatccccttcagggaccctccttctgaaagccccatgcccttctgctcaggtgcctttctctgcccaggtgggcatcaggtgccctggagaggctaggcctgggtggctgccaggatgcattgtgtccaatgcccccagcccaggcccacctgggcactgtggagtggaggaacgtgctgcaggtgtaagggcagccttgctcccgagacagtgaacatggagccaagcccaccctggtgggggctgtcgttccagccttgagaccgccctggcatcacattttccataatcacttatcagggcagccactgagcatccaggccaactcaggtaccccttttgcttgagccagtggcctcaagctactactctgtgtggggaagaaaaagtagtgtctctgttcttctgagttcctacgaggggtggactcctgtaacaaaaaaccgattcacaagagataaacaagccgaagtggattcacatgtgcacctcctgcatccatgagccatacccagagaaacgggtcaatcacaaagaggtgtgtagactcaggcttcagcaccatcatctgctgagacagagcaggaggagcaatgaggaggtgatagggtttggctgtgtccccacccaaatctcatcttgaattgtcactcccacaattgccacatgtcgtgagagggaactggtgggaggtcattgaatcatgggggctggtctttcccatgctgttctcgtgacagtcaatgagtctcatgagatctgatggtttataaagggcagtttccctgcacatgctctctcttgtctgccaccctgtgagatgtgcctctgaccttgtgaggccttgtgattgtgaggcctccccaaaaccacgtggaactgtgagtccattaaacctctttctttcataaattgcccagtctcccgtatgtatttatcagcagcatgagaacagattaacacaggaggggaccagagaagccggtcagcaagggcaaggcctgtcatgcaccctcagtcgagccctctgcattgatggggtttccagtgacgagagccgtcctcttccaggtgcagagaggagccacccttacaaatggaggactcctttataaacatagatctctcttatagaagagaatcaacttgttttcagagcttctcctatatcttcagtttctcaaaataatccttatgccaaaaaggcatacatttattaggatggtgtgttctggtctctgacagtcattttggggtgctatgttctggtctctgacagtcatttttggatggtatgttctggtctctgacagtcattttggggtggtatgttctgttctctgacagtcattttggggtggcatgttctggtctctgacaggcattttggggtggtatgttctggtctctgacaggcattttggggtggtatgttctggttttcgacagtcattttggggtagtgtgttctgatctccaacagtcatttttggggtgatgtgttctggtttctgacagtcattttggggtggcgtgttctggtctccaacagtcactttggggtggtgttttctgatctccaacagtcattttggggtggtgtgttctagtttctgacagtcgtttttggggtgatgtgttctgatctctgacagtcatttttggggtggtgtgttctagtctctgacagtcattttttgggtggtgcgttccgatctctgacagtcatttttggggtggtgtgttccaatctccgacagtcttttctggggtggtgtgttctggtctctgacagtcatttttggggtgttgtgttctggtttctgacagtcattttggggtggcatgttctggtctccaacagtcattttggggtggtgtgttctggtctccaacagtcattttggggtggtgtgttctgttctctgacagtcggttttagggtgacgtgttctgatctccaacagtcatttttggggtggtgtgttctggtctctgacagtcatttttggggtggtgcattccgatctccaacagtcatttttggggtggtgtgttctgatctccgacaatcattttttgggtggtgtgttctcttctccaacagtcatttttggggtgttgtgttctggtttccaacagtcattttggggtggtgtgttctgatctccaacaatcattttggggtggtgtgttctgttctctgacagtcattttcgggtggtgtgttctggtctctgacagtcatttttggggtgatgtgttctgatctccaacagtcatttttggggtgatgtgttttgatctccgacagtcatttttggggtggtgtgttctgatccctgacagtcattttggggtggtgtcctgacagtcattttggggtggtgtgttctggtctccaacaacagtcattttgaggtggtgtgttttgatctccaacagtcatttttgtggtgtcatgttctgttctctgacagtcatttttggggtggcatgttctgttctccaacagtcgttttggggtggtgtgttctgttctccaacagtcaattttggggtggtatgttctgatctccaacaatcatttttggggtggtgtgttctgatctccaacagccattttgggggtggcatgtttttatctccgacagtcattttggggggtggtgtgttctggtctctgatagtcatttttggggtggtgtgttctgttctccgacagtcattttggggtggtgtgttctgttcttcaacagttttttggggtggtgtattctgttctccgacagtcatttttggggtggtgtgttcttttctctgacagtctttttggggtggtgtgttctggtctctgacagtcattttgcggtggtgtgttctggtcttcgacagtcatttttggggtgaggtgttctgttctccaacagtcatttttggggtggcatgttctggtctttgacagtcatttttagggtggtatgttctgatctccgacagtcattttgggggtggtgtgttctgttctccgacagtcatttttggggtgatgtgttctgttctctgacagtcatttcagggtggtgtattctggtctctgatagtcaagtttgggatggcatgttctgttctccaacagtcatttttggggtggtgtgttctgatctctgatagtcatttttggggtggtgtgttctgatctctgacagtcatttttggggtggcgtgttctgttctccaacagtcattttggggtggtgtatctggtctctgatagtcatttttggagtggtgttttctagcctttgacagtcatttttggggtggcatgttctgttcttcgacagtcatttttggggtggcatgtgctgatgtatgacagtcatttttggggtggtgtgttctgttcttcaacagtagtttgtggggtggcatgtgctgatgtatgacagtcatttttggggcagcatgttctgttcttcgacagttgtttttggggtggcatgttctgatgtatgacagtcatttttggggtgatgtgttctcatctcctacattagaaactgatggatggtggagggccctagacactgggccctagtagctctttagtagtttacaggcacaaactttaccttcactttcattcctgtgaaacaaaggatctattaaaagtctaattagggttgtgtgtgtgcaaacccttttactgaagtgccaatctatttttttttttttaatgagatcataaagcaaaaagaacattcttaagaagtaactttcttctgttgacaagcacttggacttaacgttccacgaaaacaggaaatcctctcctttctcgtaggcagagacgcatccctgcagtcacaggggcttggcctcagatgtctagggtgtactgagggggtgttgccatgttgaccatgtgcgtcctctctggctgccacaacagaatactgcagagtggggggcttcagtcacaaacctttattgctcacaatcctggtggctgaagtccaagatcaaggtgtgggcagggctggtctctcccaaggcctctctcctgggcttcagatgccgtctctgcatcctcaagtcctcacccctctgtgtgcacctgtgtctgcatctccttcctacaaggatgccagtcacatgggatcaggctcaccctgatgaccacattttactgtaatgactcctgtaaacacccccatctccacataccatcatgacctcattttaccataatgactactgtaaacacccccatctccacataccctcatgacctcattttaccgtaatgattcctgtaaacacctccatctccacataccctcatgacttcattttatcataatgactactgtaaacacccccatctccacatatcctcatgacctcattttaccgtaatgactcctatagacaactccatctccacatacagtcacattcggaagttctgggattagagcttcccataggcactttggagagactcaattcagctctaaactctgaccctgttagtgtctcatttaactcagagtgcctttttatcatttgttccaaaagatagcattgggtcaagctagcttcagaggaatacatctatgccattttcctgcaccatatcaaacaataaattaaaaagtgaaaaattctaccaaggcaatcagggagagtgaattaatgaataaatacatgaataaaatttagcgcgatttttagaaggataataggatagttttgtccaaaaacccttcagatccacggttcagtctgagccatccagccatagcaataaagtaaaaattaccacatggtacaaatgtgtcaccgtcaacgatgctcagcgtggagatggcctgcctgccctcagagctggagaaggacgtggctgcatctgcctatgggccgggtcccttgggtgattttgcagggaggatgtacagggtcctccttctgccaacgccacatgatgaccaagactcacacctcccaggagctgccggtgccccctctagcacggggaccctaaaaaattcttgatgttgaagcaatataacttgtgttgcaattttacttctttggcagtgttgtcttttcctttgcgatgtatttcctgatagaagccttttcattttggtgtgcggcgggtagagtaatgaatttattttagaaatgtcagtggcattttatgatgctaccttcagcagcaacatcacagggcctgattgtgaagctgctaatttacagatcgtctctaagtgaacgcaaacaaattctggtcctcagagccctgctaatatacaatgttcaatttttaatttccagtccgtcttagattacggggatgaaaaacaatatttaatccctcgttaacacatgaataagcggaagctgtcattttcaaccagacaataacgggattatctcaaggactgtcagtttatgtgaaaacattatgttgcccaaattttcataaaaattagcagtggataatactcaagatcagagcaatggaaagagaaaaatatgcattcatggtaataaatattcatatttgtctgctcaggagatgaaaatctaatcaaggggctattgaagctctggctttttttttttttttttttaacaaagacgtttcatctaaattgggtttgatatggaaattagtctcactcaaagtcctccaggccacgagtaagccgggctcacgtggggtgaggtggccactctatcagatgtcgcttctggcatgggcctcttagacaacagccaccaatgctggggttcacactgtctctcttggttcagcatcctcagagtttaatgcaagggagtgcttggagccccctccctttttaaaggaaaaaaaaaatatgatttcatgccggttaactcccagctactgcagggttaaaattgtctgtgtttttgcttttgttgacaattaccataaatcagaagacactctgcatggagcttaatgaaatatgtatgattttaaaaagaaaagatgggagctgcaggacgttgctctgtgtgtgtgtgcgtgcacgtgtgcgtgcacgagtgtgtgtgtgtgcacatgcacgtgcatgcgtgtgtgtttgggtgtgcgtgttggggggtgtgttcctgctgttctcatggaggctgtgcttttcctacacatgggcaggcttgaaaacacagaatccaagagctcctcggtgagtaagtgtgggtgcacggtatcacactgacccttccagccccacggaatccgagagctcctcggtgagtaagtgtgggtgcacggtatcacactgacccgtccagccccacggaatccgagagctcctcggtgagtaagtgtgggtgcacggtatcacactgacccttccagccccatggaatctgagagagctcctcggtgagtaattgtgggtgcacggtatcacactgacccttccagccccatggaatctgagagagctcctcagtgagtaagcgtgggtgcatggtatcacactgacccgtcaagccccacggaatccgagagctcctcggtgagtaagtgtgggtgcatggtatcacactgacccttccagccccacggaatccgagagctcctcggtgagtaagtgtgggtgcacggtatcacactgacccttccagccccacggaatccgagagctcctcggtgagtaagtgtgggtgcacggtatcacactgacccgtccagccccatggaatccgagagctcctcagtgagtaagtgtgggtgcatggtatcacactgacccttccagccccatggaatctgagagagctcctcagtgagtaagcgtgggtgcatggtatcacactgacccttccagccccatggaatctgagagagctcctcagtgagtaagtgtgggtgcacggtatcacactgacccgtcaagccccacggaatccgagagctcctcggtgagtaagcgtgggtgcacggtatcacactgacccttccagccccacggaatccgagagctcctcggtgagtaagcgtgggtgcacggtatcacactgacccttccagccccacggaatccgagagcttctcggtgagtaagtgtgggtgcatggtatcacactgacccttccagccccacggaatccgagagctcctcggtgagtaagtgtgggtgcacggtatcacactgacccttccagcccctttaaggagcctcagggtccgtgctcttgagcactggccggcccagcacggggatccctggtgcatgaggtctcccgtggaccacaggccaccaagagggtatcttttggggaactgaatctttgctctcttacacttataaattcctagacagcaaagctgagatgggcttgtctgagcctcaggaaggaacacgggcaggcccttcagagtcagagagccggaacaccgccaagtagccttcgctccgcatcaagaacgcttcctactgacatacgcgggattttccttggggcgctgttaattatgttacagagctgaatgtttatattcacacacattttaaaatctcacccctgacatatttcctgttcctcttctccccggtcaagcagagctgatcgtgggatgttttgatgattttggcgaagggcttggggaatgtggtttctgaagaagacgtctctgagcagactccctcctctcctgtccctgctgctcccagctgtgcagtgcctgttcctgagacctggctctgaggcccacagggagggttggctgttccccagcccactgttaggaacaccttctgcaccacccaccaagacccgggctttgatgctgggtccagagacatcaccttcctctttgtgacgtgggcggggtgcacggaggggaggagagaggaccccgaggaaaccctgggtagggcactcggacctgggatccccgaggaaaccctgaccatggcacttggacccggggccccgaggaaaccctggcgctgcactcagatctggggtccccaaggaaaccctgaccatggcacttggacccaaggtccctgaggaaaccctggcgctgcactcagatctcgggtccccgagaaaactctagtgtggcactcggacccggggtccccgagaaaaccctggtgctgcactcggacccggggtccccaaggaaaccctggtgctgcactcagatctggggtccccgaggaaactctagtgtggcactcggacccggggtccccgagaaaaccctggtgctgcactcggacccggggtccccgaggaaaccctggtgctgcactcagatctggggtccctgaggaaaccctgaccatggcactcggagccggggtccccgaggaaaccctgaccatggcacttgcacccggggtccccgaggaaaccctggtgctgcactcagatatggggtccccgaggaaaccctggtgccacactcaggcctggggttcctccagggactgccacatcctgcaccttcccctgtgggtaaaggctagcgaggccgtccagggcatcaaggcccatttcagaacgtcgtcctcctggagggccggcgagctgcgtgtccctagtgcctcctgcggctcccagaggctcccccggcatgcccccgtgctggcactgtccccaggtggctgctggcacccacacagcagctgccccgaccttccctcttagaaagttctccgccctggggtgcaggggccatgtgaagccccatagagcaccattcccgctgcccccgacccatcctcactcttggggtgcagtgcggcctctcccagccccacgtgggggcgctggtcttcccaaggccaccctggtggacgtggaagctgctgattgccgccgtctgcctgccttggccgtctgtgcatcttcctgggagaaacgtcttctagggccgtttactcatgagaggacctgccaaggaactagattatttgtggtggtgtcagcatccaacagtacttttttctaaggaaagggataacttgccacaggaaaagaaaatgctgtggctttagacacagccacccatcctgtctccaggctctggtgacagactctgtcctggggccgctgctggttaattcaggcttctccatgctgggaattcgcttccagaagagtggcccccaggatgctttgccttcagggtcagccctgtccgccttacctcaggcccagcagaaatagcaggggatgggtcacaacaggagaccaacacaaaaacagggcttggatgagcccactcgggcacccagtccatggtccagggcactgaggtctcgtggagaggagggagggtgagcgtggactgcattgtttgcaaggagtcgtgaattctgacactgtccaaggagctgcaggtgctgccccagatggagacagccaggaacacctctaggccactgcagtggtgatggccaaggcatacctgccctgctgaccctctgcagccccgtgcctgccctggggatgcctggcctgggggctcggcccctcctgaccctctgcagcccggtgcccaccctggggatgcctggccttggggctcggcccctcctgaccctctgcagccccgtgcctgccctggggacgcctggcctgggggctcggcccctcctgaccctctgcagcccggtgcccaccctggggatgcctggcctgggggctcggcccctcctgaccctctgcagccccgtgcccccctggggatgcctgacctggggactcagcccctcctgacccccgaggcccaaggtgctgctgctgctgcagccaccaggggtcacacttgctcgcctcctgcacaggccatggccccacaatcagggctgcaagaagagatggagaaagagacaccttggaagtggctggaacgatctccctttggagtcaccctgtctgctggaattaagacttctgggactgcacagtgaagttcccggcaatgactcattttctgatattggtgcctgaattgcagcttccgtggctgccacttcaggaagataacgtgtgacccggagcaaggttatcagaaactgccgatagaggtttgccacctcccaccatgaatacggacgctgataggaggaagccctcacgcgctccctcggctctcacggaacgcctggaaactccccagctttctcttgtttgaagaaggagcccccaggagacttccaggacagcacggtctggaccgtttccaagccctttaggaaaactttgcagcaaaattcagcatttcgaaaatagtgaagtcaaggtgaccccgacacagcctgggctcctcctgggacatacttcctgtacggctgtcagaccacaagtctacccaagggcatctgtttgcctgtgagtgagcgtgtgtgtgtgtgtgtctgtgtgtgcgcgtgtgtgtgtctgcgtgtgtctgtgtgtctgtgtgcatgcacgtttgcgtctgcctgtgtgtgcctgtgtctctgtgtatgtgcacaagtgtgtctccgtgcacaagtgtttctctgtgtatgtgcatgagtgtgtgtgtatgtgcacgagtgtgtctccgtgtgtgtatgtgcacgagtgtgtctccgtgtgtatatgtgcatgagtgtgtctctgtgtgtgtccatgagtgtgtctctgtgtgtatatgtgtatgagtgtgttcgtgtgtgtgtgcatgagtgtgtgtctgtgtatgtgcatgagtgtgtctctgtgtgtgtgtgcatgagtgtgtgtctgcttgggttactttgctacctgcaagcaaacccctgccttgtgctgctgggtggcacggccttctctgcccccctccgcttctccccggaccccgggagctgtctgtggagcgagtaggaaatccccctactcacgagaggccgtgcaggtgaccccgaagcttcactgaaataaaagctcgagttaagggggacatgaacttccttgtgaacatggttggctggcaggaaggcactgtggctggggccatgtggacagaagcagaggcaggatcggggcagggcaggagagaggggacaggagggggcagaaagcaggagctgggtcaggtccacttcacctgcgtgtgtcacgttgaaaatgggctgagaggtgggcgaggccaagtggagcactgcagtccaggcttaggggctgtgatctgatttgcaggccatggggagccatggagtgttggggtgaagggagcagcctgcccagttgtggagggggaaacagagggaggccagaggcagactgagggccgcttcagcaccttccgcaggacaaggctggagctaggcagagcagcagagaggccagagaatcgttgcagaaggcctggtctgaagatgtgtgatgtgacgtgccaccactgagctgtgccaggcctgggccacctcactcccccgaggtcccgagagctcttcccgaggctgctcagggtcctgggactttgccggagttgtggcagacctagagccgtcaaagtcagtgggacaggaaacaactttccccggacggccctcctgccgtgccctgaagcccctcttgtgcccagctggtcgtccatccctcctcctccgctttccacctcctcttctctcccaggtgccccctgctgacctgtgcccccagtgtgatgccgagtgctgcgctctcctcagtacctgaaagcagggccctctgcccatcccagagaccagcgcaggaaattctgcttgaggacagtacgttctcctcccggcccccacgacgagacagaccttgaggacagtacgttctcctcccggcccccacgacgagacagaccttgaggacagtacgttctcctcccggcccccacgacgagacagaccttgaggacagtacgttctcctcccggcccccacgacgagacagaccttgaggacagtacgttctcctcccggcccccacggcgagacggaccttgaggacggtacgttctcctcccggcccccacggcgagacggaccttgcagacgctcccagcacatgtccttggcacacgtcggagcaaagcctcggggcgcggccctccgggggtttctccagggaagcgagcaaactgggaagcgtatcccatccagagcctcagacgaggtcaggccaggcggctgctttctttcctggtgcacattcatttattcaacagatacttgctcagcactcgctggtggcggaaacattggtggataaaggagagacagtcggagcctccccctcccacaagcagcgaggaagcaggacttcagggcaggcaagaggcccggtcagagggaatgaggcagaggtctcagtgcaaaatggaagcgagagcctaggagacagggctcgggtgagggacatacacggccaggggcagttcccctgttccgtggccagttcccactttccatggccaggaagctttgtggcttcctctgtcaagttctagtgcagacagaaaagtgtcccaggaagaggacaagcaccacctgggaaatgagtgctcccagcaaggggaggtggcctgcggacatgggtggcccttgaaggggagctgtggagaggcagcagcagacagggcccacacagaaagcacccgtcacccctctaccccgccaggaagctgaggaaactctcaggagccctgacagggcggggaggggacactccaaggaggggcatgtggactgagggcctcagggactctgcaccctccttctacctcctgcaagatggagcctgccccagttggacaggcggcctgggcgcaagagcgcctctcagtgcttagttataccgggaaaccaaggaggccaccaagtgtcaggacacagttacatgggcattgggtaggggaaacagctgtgaggacatagcgtgggaaggcactgggtatccatgtgtgcggaggcactggatatgcgtgtgtggggaggacactggatatgcgtgtgtggggaggacactggatatgcgtgtgtggggaggacactgggtatgtgtgtgtgggaaagacactgggtatgtgtgtggggggaggacactgggtatgtgtgtggggggaggacactgggtatgtgtgtggggggaggacactgggtatgggtgtgtggggaggacactgggtatgcgtgtgtggggaggacactgggtatgtgtgtgtggggaggacactggatatgtgtgtgtggggaggacactgggtatgtgtgtatgcggaggacactgggtatgggtgtgtggggaggcgctgggtatgtgtgtgtggggaggcgctgtgtatgtgtgtgtggggaggacactgggtgtgtgtggggaggcgctgggtatgtgtgtgtggagaagcgctgtgtatgtgtgtgtggggaggacactgggtgtgtgtggggaggcgctgggtatgtgtgtgtggggaggacactgggtatgtgtgtgtggggaggacactgggtatgtgtgtgtggggaagcgctgggtatgtgtgtgggaaagtgctgggtatgcaggtatgggaaggacgctgggtatttgtgtgtggggaggtgctgggtatgcgtggccacatcctgtgttctggagctgagtgcacatgtgtagacatgggtgtgtgtgcatttttgtgggtgtgtgggtgtgtaggtatttaggggtctgtgtgtgtgtgtgtatgtgtgcatatgtgtgggaaggcatatgtgtatgtatgtgtatatgtgtgttagggaaatgttaaccctaagacattactagtttataataggaaaaaatccctccaaaaataatactgtacctcaagcctttgtattacaaaaaaaaataaaaggaggagggtgaagttgtgccagtgagtcccggttgctcttcaggggccctggggtggtgtcggccaatagagacaaatgccattggcaaacacctagggtgcctcctacatcacagctgccgatgaacgcgaccttgagtccaatttagaggaagcttttggactctcacatcttacaagttctctcagaggtcacgcctgccctttcccataagcagaacaacccaaatcccccaggcccacagttctcatatgtcagcctgcatcagaatcacctgcagggcttgtaaacacacaggttgctggttcaccccagaacctctgactcagggggtccgaggcagggcccaaggatctgtgtttctaacaagctccctgggtgctgccagtctggggaccccactttgagaaccacagctttgagcaactgggcctccccagctgagaaaagaggaaagattggtgcctagttcagaaccgtcaactttggaagctctgggagccagcttcttcgtaaggaagtccaggcagccctgaggcccctaccccagctgtgcagctcatggcctagcgcccccagcaccagcactgcaagagccttcaggtcggggacatttcaacatctctgagccaggccatccaatccccaacatcgaacgcccaataaacccaaagctatctccacttccagagtctcacagaaagatcaacatcaaagtactttaagaaacagatgactgtggtgtgcagccccttacgcaacccaggtgctctgggggatcaaggtgggggtgcaggtgcgggaggctggcacgaggccatgcagctcctggccccagagcaggattcctggcggctcacaggcattactctgagttcagccagcaccccaagcagccatcaggcttgttatggaagagattctgaagaaggtccatggaaaatgtggatcatggaaaactatgcatggatttcaaaaatctttctgcaccaaaataaactcatactaacttgttgtaacatgtctgaacaggatctagtttaaggctaggaagagaatatatcagtttgaaaagagcccctatcagagcaacatgaattctgctaaaattgaaggaagaacaaacatcaaaattgtggtgaaacatgggtggaacaatgatgaagtcattgatgctttatgaaaagtttatagggacaacaccccaaagaaatcagcagctttcaaatggagaactcattttaagaaagaatgagatgatattgaagatgaatcctatagtggcagaccccctcatcaatttgcaaggaaaaaattaaccttgtttatatcctaattggagagaaccaacaattaacagcagaaacagcagccaacaccatagacatctcggctggttcagcttacataattctggctggaaaattaaagttgagcaaactttccactccatgggttccaaaaccattgcacccagatgagctgcagccaagggcagagctttcaatggaaatttttaacagcggaatcaagatcctgaagcatttccttgaagaattgcaacaggagaggaaacatggctttaccagtaccatcctgatgaccaagcacaaccacagcagtggctaccgagaggcggaaggggtcccatcgaagcaacagcagactgatcaagagcaaaggtcatggcagtagatgttgggatgctcaaggcattttgcatgttgactttctggagggccagagaaaaataacatctgcttattatgtgggtgttttgagaaagttataaaaactttagcagaaaaatgcctgggaaagcttcaccagagagcccttctccaccaggacaaggcttcagctcactcctctcatcaaacacgggcaatttagcaagagttccgatgagaactcatgaggcatccccctacagtcctggtttggctccttctcacttctttttgttttccattcttaaaatatatccagagggtacccatttttccttagatagtaatgggaaaaagactgcattgatgtggctaaattcccaaggtcctcagtgccttgggaatggactaaatggtgggtttgatcccttgcaaaagtgtcttggccctggtggagattatgttgagaaataaagtttatatttttatttttaccttttaatccaatttttctgtgaactttttgaagtccccttatatttgtctgctaactcaggaaaaatgtaaactttttctttactttggcattaagtgtaactctgtcatcaaatgaaattatccctaggaattttatatgcatggggataagtgagcggcctggagtccacagacctcccagcaggcctccaaggccctacccagacctcccatgctgggaggctctgcaagtacctaagcacacgcttaggaccctggcaaagttgaggtatcaggaaagatttgtagaaagaccttgatattttaataaagaaaacatcttgtcatccagggaaacatcagaaatttgacttgctcacacgcattttaaaacttagtacttacagatttggaattacacgtgtcagggtgtttcgggacattgggaagtctttatcccactggcctttatgaatcttcatctggttctacatggaactgagtccccaaacgactgtggtggcagaaagatggagggcgcgggaggcctggcctcaccactggtgctaggcaatgctaaatgggttgtgtgaccctcctggccttgagttccccaagactgaggtggcatctcagatgatcaagcagaattttccatgtcgagcatttcccagttaccagccacgcatggcccggagtgcacagcccagagggagctcacaatacaatgaagaacgaccgctgttgagtggatgggcgagtgggcaggtgggtgagggagggagtgagcaagggaaggcatagcccctcatctcgagggctcagagttatttccccggccagtcctcaggctgggaaatgggctgcacctttttctccatgtgtcatactttcttccctttaaaaaatttaaccagttcttggcattggtagttttgctaaattaaaccagggaggacctggaagacagcagcgcagccctgacactcacaaggccagtttcctccaggcatggttttaatccagaggctgggtctgctttcctacagctgggccatgagctgctgccccgcagagatccaatgtcctggtgtcctacgttcatcgtggagatgatggaaacaagctcagacaggaaaactcatcacttggcaaactccaggcctggggctgcctgcagagagccctgttcagatgggcttgccgagtcccagcccaccacctcgatgggaagcagttgtaggtgcaccactgggctgtcggagccatcgggaaaggaacccttcctgtgcctggccttaggataactgtgtctggacccacagcccacaccccactcgtgaactgtttcgggccctttctaaggtgcatgtgggcctcttgcccaggatgcgggctgggttcctagaggactcaggtgatcctacctgcggcagtgagttaatctccagggctcaggaggcctgctgtccagaggaagtctgggcagcttgggctggcgcaggcacggtgcccccagtcctgctcttgtggactctgggggcatgctgggcctgggcacacctccaccacgcctgcggccctttgctcacggactgtggattggatctgagcagtctagggaccagctcctcgggcccatgcagaaaggaagagaaggagtctccctggactggattctgggagggaccctcactctttctgcctgaatgaacattagtgcgtggacttttccagtctttccatctgttctgttttgaagtttattcatgttgatttacgtgaatctagttcactctttttgcctctggtgtcacccttcagtctgggcggggtggtggccgtgtatccagggcgtcagggacagggtggtggccgtgtatccagggcgtcagggacagggtggtggccgtgtatccagagcgtcaggggcggggtggtggccgtgtatccaggtggccgtgtatccagggcgtcagggacagggtggtggccctgtatccagagcgtcaggggcggggtggtggccgtgtatccaggtggccgtgtatccagggcgtcagggacagggtggtggccgtgtatccagggcgtcaggggcggggtggtggccgtgtatccagggtgtcagggacagggtggtggccgtgtatccagggcgtcagggacggggtggtggccgtgtatccagggcgtcagggacggggtggtggccgtgtatccagggcgtcagggacggggtggtggccgtgtatccagggcgtcaggggcggggtggtggccgtgtatccagggcgtcaggggcggggtggtggccgtgtatccagggcgtcagggacggggtggtggccgtgtatccagggcgtcaggggcggggtggtggccgtgtatccagggcgtcaggggcggggtggtggccgtgtatccaggtggccgtgtatccagggcgtcagggacggggtggtggccgtgtatccagggcgtcggggacggggtggtggccgtgtatccagggcgtcgggggcggggtggtggccgtgtatccagggcgtcgggggcggggtggtggccgtgtatccagggcgtcgggggcggggtggtggccgtgtatccagggcgtcgggggggggcggtggtggccatgtatccagggcgtcgggggcggggtagtggccgtgtatccagggcctcaggggcggggtggtggccgtgcatctcggggcacaggcactgcttctgaggagaccccagggtgtgtgtggcaagcactggggcgagcctgggactcgggccagacagcctcggtgcagaccctgagctgggcactcatgctgggtgcctgggagaatgcacaccagcctcagctccacctctatggacgtgtttcctgcagacctcatggttgtcatggcaagggctgagaggcacatgcgctgtttagtaggtcatgagcactgtgtgtatgtgtgtgtgtgtgtacacgagggatatgggtgtgatcgtgcatgttcgtgtgtgtacatatggtcgtgtgtgtgctcatgcatatgtatgtatgtgtgtacatgtggacgtgtgtgtgctcatgtgtatgtgtgtgcttatatatgtatataactctgcatatgcatgtgtgtgtatgtgtatttggatatgcacgtgtgtttgtgtgaatatgcaatgttgtttcctgctcactgactcttaattgatgaaacaaatgcccagcaggccaggatgggatttgagccccggctcatggtggggcctagaaagtgacgactactttccctttgcagaacccgggcctcactcaagtggtgtttgtgtagaaggaaaagaaaccacaaaggtgcatttgactcccattttctcgcatctgctgagagcgtattcatgcacaaaagggaaaggtccttgttctaaagcaggagagtacacgtggctgtcagaggttgcgcggcagcggggaaggaggccggggagcatctgtcagttgccgcaatgcaggggcgaggtcacagaacagagggtgtgctggctgctggggagggtgtggggctctggggccttgaccctgttaaccgtccaccctgccctcccgtctgctcctctgacagcagcttctggaggccgggcactgtggccaggctggcacaagtaacatcaggacctggggctgcagccccaggagggcccattcacctggctgtgacccacaggcaaataccgcacaaaacccgtggcccgtcttgcacacagaggccactggaaacacagataaggctgtgtgaactcatctctccactgtgaagacaacactgggaagacagcagatcctcctggcactcgctgagggtctccactgccctccagatgccgagctcccgccttccttcccccaacccccgacaggctcggcacagtcagaccagctttgcagggtccgtcgtggccccacggtgagggtcctgcttgcgagctgaagctgagatggacgtgtgcatgcatgaggatgagcatctctgtggtttaggtgaggtggggtcacccacctccaggacccctgactaataatagcgctgagattcaaactcaggtagcagatcagttaggatcacccaaacaagtggacatgaaccagtgggatgttcagcagagcagaagccgattcctcgttcatcccctggtgcaggactgcggaatgcgtcagctgggcagtgccaacctgcagcccctcaggggccacccccacagtgcccggctcccgtctcacctagggacctccatttcccggcagcagcacttgggaaggagcctgcgtgggccagacccagggagtgcaccgctcctctccatttcggtggccagagtcaacccccctgcccacccagccacacatgcacacacagccacgtgcccaggaggggagtgcttggatttgggcctatgtggcacagccttgggctggacctcagagacacaggtcctaccacgaccccacacaggtgcctgccagctgtgagcccttgtgcaggttgggggtcagggagggcctgagatggcggcattttatgcgggggcagaaactgcaggttcaggcacagaggaggggctgtcacctgccagaacatgcctccctcgatggtaccaccttggggcccaaacctgggtctcagacaagcactttgtcctgagatactgacgtctatgagcgtttgagggaatacgtgctcaaacctgacctcctgcagagaggatggggcagctggttcctggccgccaggctgcgtttcagcagctcacaggtgcataccacacacagccccgccgtggccagtcaccgtgggccagccccacatggcagcttccagaggcaccacagggtggcggccccagaccttggagaaagtggcacaggcaatgtaaacctttgcgaccccaccatcctctcaatctcatccccaatgcctcccctggccccaacaggacttcctcctgtcggcctggaaaactagagcccgggaggaacatctgcctaatacagcccatccccaggtgtcagcatccggggcccgtccccaggtggagcccgggaggaaacatctgcctgatacagcccgtccccaggtgtcggcatctggggcctctggatggtgcccagtgaacctcgggtgggctggaccctggatggggggacccagtcacagatctggatggtgcccagtgagccttaggccaggctggaccctggatggggggacgcactcacaccctgtgtgtgaacagtcgcttggaaggagcagcgatgccgggactcagcttttctgcatcttcagagcagctttcaaatgcttttggatcaaaaccacgtggccggcagaaatcgcacaattagcttcgacatagccgtggcttcgggcagggtggtcctggccagaatcacacatgcagagagcgtttttggagcctgtactgtctgctcaggctgccgaggcaaagtcccacagacagggcagcttaaatgatggaagtttcttttcacacggctctggaggctggaagtccgaggtcgaggcgtgggcagagcccgtttctcctgaggccactcccccgcctggtagatgccatcttcatcttcaggtgtctccacacgtgcacgtctgtctctgtgtccagatatccctttctgataaggataccggtcctgctgggtcagggtcgccataagagcttgttttaccttcatcgcctctgtaaagcccctgtctccaagacgccacacgctgaggtcctgggggtcaaggctgccacatgaacttgggggcgcattcagcccatcacagggccagtgaaccacgctgcagtttttaaagaattatatttatatctcaaagttttgaattacttttaatttttttcttttgaaaaccagttggtggtataaggtttcttgggcacaagtctggcccagccaggtgttcagcatcaactgtgacttcacaccccgagctagtagcatgggccaggattgaccctggcagaggtctctgagacgcgtcgccgcccaggcaagctgggaaggaggggaagacctcgtctccactctgcactggggcattgggcagcccactggctccgtgagacctgtaaaagcaaaggttttgtggcacagcaggccgagagggtgccgtgtgctaccctcctgcagacgtacatcagccacgtaaggcagaaaaatcctgtccaaaagtctgacagattacagcggaaccttctcaaggctcccagaccacacagcctacttctcctgtaagactgatcagagcgcttggagaatgctggtccatgcaaaactgaatccccaggtgtgtccagggccccagagccggagcacaggaggcactggcttggctgccgtcctttcttgtaactgcccaccaagtgccgcctgacgtgaatcccagcctcctcgcggtgccgtccgagctctgggctttgtgtgtgtcatgtccaagttgacaagtggctgtgctgtgagcgtcactgtcctcctccccctcatctttcaggaaactgctgtgactttaaagccggtcctcgccgcttcccgcacacctcgccgcttcccgcgcacctcgccgcttcccgcacaccaccaggcttgtgcttcccggagctgggtctgtgcacgtggcatccgtgcctctaaaggcgttgcaggccggtaagaggccctgctattttccattcatcccataagcgtttttaaatctcagggactgtgctcagcactggaaataatttctagaacatgattcttgaccagccaagcctgcaccggtggttccactctcaaggcattttaaagcaaggtaacaaatgtatgttgaccagctgggcacccatttctgttctaaaaagagagatgaatatcaatgttaaaaagtcatggatcctgaccccagttagtaaataatctagtggagaaatacaataaatgcacaacaattaaataagccggtggtgtacagcaaattagcacacgtgtgaaataagcaagacattctgtgttcagaagggaatcccctagccgtgggctcaagtctgtcagggaacttcctaacagagggcacatgagctaatgctataggctgaactgtctccgcagaaagatatgttgaagtcctggacctcggcagctcagaatgggaccttccgtggacataggactgttgcagacacagttcgcttggtgaaggaggcaccgtgctgcagtaggtccttgatgcggccatgtccctgcgacaggaaggacaaactccagcacacagagtcctcgaagcagcagtgtccctgtgatggggaggacagactccggcacacagagtcctcgaagcagcagtgtccctgtgatggggaggacagactccggcacacagagtcctcgaagcagcagtgtccctgtgatggggaggacagactccggcacacagagtcctcgaagcagcagtgtccctgtgatggggaggacagactccggcacacagagtcctcgaagcagcagtgtccctgtgatggggaggacagactccggcacacagagtcctcgaagcatccgtgtccctgcgacggagaggacagactccggcatgcagagggaagccgtctgcgtggctcggaggcaggagggaagcgctgtgtctgtgggccgagggctgctggcaacgcagaggctgggagtcaggaagggtcggtgtccccttcaaggccctgcagacacctccaagcaaggtctccaaacccagcctgtgagactgcaggcatccactgtttcaagcccatccgtctggagtcctttgttctggcagccccaaaagcctcacacagctcggctttgagtacagggagcgtgtctgcaggtaaggtggggaggccacacagaggcacagcggctgggccctgcaagactcagggagggcgggccagcatgtccgagggcaggaggcagatgccacagggcatcaccagctgcatgttgcacctcgacggcaaaacacagaagccactgcccaccgcagggagcgcagactgaagggacccgggctccttggccgagctccagccggaggtgcttccggtgcaatccaggcctctcatcctcccacggattccccacagagggcttcggttccattattgtatagacttcacgtatgtaaaaggtacaggaattcagcatttggaccccgtggggcagtgtcaccatggagcacgcacagggtgcctccctgagctggcacatccctggaggcatgcgtgcctctgccgacatcccaaagcgcccgtgctggggtcccacatggtgtccgctgtgccgtggggttcctcttccaacccccacaagaaagagaaggtcaccctgccccccacctctccacagctccctggactgggccacatttctttatcctcttcttggtttttaattaactttgggccagcccatctgtgcctgttctggactccagttttgacagctactgactgaattgcctggtcagttccgtgaaaaactagaaatagaaatgcacccggccagctgctgcctgagctgaccagccccggccgtcagtggccttccctggttggacggaccgtgaatgctgccagttctgtttcattttaactatgtgtatttgtataaatataagaaactgtctgctctctacccacagagtaattgtctagctctatcatctaattatctcaacacgtttagtgagcgagatattaaggcccagattagatattaaaaggcatcgttaaagaacagaaatgagatttgcatggagtggtatctagttccagcgtggaaacgcgttcacacagcactcaattagatatgtggactcagctctgaaacgttcctataggagaacaaagatgaaaattcattactacctccaaatactgccaactccgccatttcttttaaaactgcagtcttgggaagctccaagagtgttcgataataaccaagacgtggatcctgtgtgtgaaaagtggcccagctcctggagaggcgcgaaggctgtgggtggactgtggggtgggctgcttctctggggtcacgtggacatccctagagagagtcttggcttgggcaccaccctcaggtgtgtgtcctcaggtggcctgactgcagtgacctctgaaatccagggtatgcagagatcgcaggctgtgggccctgccaccacaggctggggcctcagggaattgggtctgggtcgttgcaagtctcgaggctcccccagtgggctgctgctccatagcaggctgtccccactctgctccacaggaatcacgaagccgcatgctgtctctggggtctgtgctgcagagctgggggctctccctgcaggagtgtgtacagtggctggggctctccctgcaggagtgtgggtggtggccggggctctccctgcaggagtgtgtacagtggctggggggctctccctgcaggagtgtgggtggtggctgggaggctctccctgcaggagtgtgtacagtggctggggctctccctgcaggagtgtgtacagtagctggggctctccctgcaggagtgtgggtggtggctgggggactctccctgcaggagtgtgggtggtggctggggggctctccctgcaggagtgtgggtggtggccggggctctccctacaggagtgtgggtggtgacggggctctccctgcaggagtgtgggtggtggctgggaggctctccctgcaggagtgtgggtggtgacggggctctccctgcaggagtgtgggtggtggctggggggctctccctgcaggagtgtgggtggtggctgggaggctctccctgcaggagtgtgggtggtggctggggggctctccctgcaggagtgtgggtggtagctggggggctctccctgcaggagtgtgggtggtagctggggggctctccctgcaggagtgtgggtggtggctgggaggctctccctgcaggagtgtgggtggtgacggggctctccctgcaggagtgtgggtggtagctggggggctctccctgcaggagtgtgggtggtggccggggctctccctgcaggagtgtgtacagtggctggggggctctccctgcaggagtgtgggtggtggctgggaggctctccctgcaggagtgtgtacagtggctggggctctccctgcaggagtgtgtacagtagctggggctctccctgcaggagtgtgggtggtggctgggggactctccctgcaggagtgtgggtggtggccggggctctccctacaggagtgtgggtggtgacggggctctccctgcaggagtgtgggtggtggctgggaggctctccctgcaggagtgtgggtggtggctgggaggctctccctgcaggagtgtgggtggtgacggggctctccctgcaggagtgtgggtggtggctgggaggctctccctgcaggagtgtgggtggtgacggggttctccctgcaggagtgtgggtggtagctggggggctctccctgcaggagtgtgggtggtagctggggggctctccctgcaggagtgtgggtggtgacggggctctccctgcaggagtgtgggtggtagctggggggctctccctgcaggagtgtgggtggtggctgggaggctctccctgcaggagtgtgggtggtgacggggctctccctgcaggagtgtgggtggtagctggggggctctccctgcaggagtgtgggtggtagctggggggctctccctgcaggagtgtgggtggtagctggggggctctccctgcaggagtgtgggtggtggctgggaggctctccctgcaggagtgtgggtggtgacggggctctccctgcaggagtgtgggtggtagctggggggctctccctgcaggagtgtgggtggtggccggggctctccctgcaggagtgtgtacagtggctggggggctctccctgcaggagtgtgggtggtggctgggaggctctccctgcaggagtgtgtacagtggctggggctctccctgcaggagtgtgtacagtagctggggctctccctgcaggagtgtgggtggtggctgggggactctccctgcaggagtgtgggtggtggccggggctctccctacaggagtgtgggtggtgacggggctctccctgcaggagtgtgggtggtggctgggaggctctccctgcaggagtgtgggtggtggctgggaggctctccctgcaggagtgtgggtggtgacggggctctccctgcaggagtgtgggtggtggctgggaggctctccctgcaggagtgtgggtggtgacggggttctccctgcaggagtgtgggtggtagctggggggctgactcagagaaccagcaaaggccgtgtttcttttcaggccccccgacaaagggctcccttccctcacaaggctttctcatacccgccgtctttgagtacgtgtctgttcctgatctgagccactggggccaggcctgctgtgtgggcacacgtgctcctggcagacactcctgctttgtgattccacccccaacctcgggatggaggtcaggaccacgcctgctcacatctgtttctcaaacgtctagtgcgggcgcttgcacgaagaggtgctgagacgtgcctcacaggatgtggaggatgaccagttatggacggacacgtggcgcgtcagggaaggctccggaaactttgctgtgtgaacttttctactcagggcacggacctcagagctggatctggttgtcatcccagatgaggaaacaggtcaggcggatgatgcagaaggagctgtgactccccggtggccactggtgggtgtaggagcctcacctggcatgagtaggagcagccacaggctgtggggcgggcaccctctaaacagagccctgcagaaggggctcctccatcacgcgccgagcctgccacacagaggagaggacgctccggagagagaggagcgcagagcctgtgcagatctgccatctcctcctccctaggggatgctcctggcccttgtgtgggtgaacgggtgccgtgatgtggccatgaggcgcacggacctctggactcaacgtggcctctccataggcttgagggaaaacaggaacggtgaaatcaactctccgccccacacgggcccagcttcagtgttgggcacagcagagccccagcttcctcctgcagcatccccctccctccccttccagcgtccccctccctccccatccagcgttcccctccctccccctccagcatccccagctccaccagcaatgccgatggccatgccctcgtgctgtggccccggctgtgactcccactcatggcgcccaagctgatggcactgcagctttgcaaacctggccacctcccttgtcagcaatgcttggaagataaatagaagatgctgctaaaaatttggagaaaaatttgagaataaatcatgagccgtggaagtctgctacacagttgggtgaatgtacaggttgttcaaacctttcttggtgtacactcattgctaagcaatacttaacaggtcaaaaaaagttttaaaaattggaataactatggatgaagtgaccactttgactgacagacatacgaaaaagattctgggtgaggtgagggaaccagcaggtcatatgaaatccaccccacacatcattgcagcacagcaaggacctgaagctcagtgtgcaagaagtgaattttgtatgtttaatgtattttgtcactttatccattttataaaaatgagacctttgcactactgtgagttaacctttgtgatacattttgtaataaagccaggagaaaccagtagaactgtgtgccacacacggcttgctggttgtctgcggcaaactcatgtaagagggttgaaggctgagcctcggaggcaccggcctgtggtgggaacgggacgccccagcaaacactccccagtaaaataaaccttcagtgtaaaatagacatctgagctgtgtgtgagaaaatgtgtgtgcttgaaaagcgaaaacaaaaaacagccagctgtggcacattttgaaaatgaatatttggaaatagtttcattgccgtgtgaaatgtttcagacaactgggtctcctataaagtcatccacagtcacgactctaaaaagcatggaaatgacattttctaacccacttcacatctttccaaatgaaatgtttccatgggttgaacatatactgaaattattatcataaaaatccaagacatcccaccgtgttaaaaatggtgccgagaatcaggcagggaggacaaggcctttgcagagctggtgagcaggaccgggacggagactccacggttaagcagcacagctgacttcctccacccggtccgccgtgtggggcagcttttcagctgcaggagccttaaatcaagtactgagataaccctgcacttccggccaggcctccagtgacctgtagggcaaaatatcaactcagtatcagaaaaaatgatggtgccgtgcagttgggtggctgtccctgaaataatcaccagagtacttttagagagaggaaagttcattaaatcatagagggcgttagtttttagatgttcatttcatcttttcctcatcctctaaaagtgactttgtatcgccgcccccctgggcccaatcagtggctttcctggctccggctctccctcggctcagccacaggcatccctcagctctaacgctcccgccgggatgtgctctatgcagtgagggctattcctgacatccccccttccagggaagccccatcactacatcacagcaggccgcatccagattatcctaattagagaattacttgtatcaagtgaatccccaaaccactgtccagggtcgctgtaggagggaccctgctggccttgagctccccaagaagcggcaccactcagcgtttagcttcaaaaggtccccagaggtttcgtgctccatgggtttgtttgttgtttggaaactgttgttaaaataatcgttattaggtgaccccaggaaacttgttgctcaggtgtttgagtctgtcacttaagaggccgagctcgagaagccggcgcgtgggttggggccgctccctgggcgtccgcagagcacgagagtcagcaagccccgcacacacgcctgcaatggtgcagccatcctccccgatccggccccacacacacccctgcaatggtgcagccatcctccccgatccggccccgcacacacccctgcaaccgtgcagccatcctccccgatccggccccacacacatccctgcaacggcacagccatcctccccgatccagccccacacacacccctgcaacagcaaagccagcctccctgatccagccccacacacacccctgcaatggtgcagccatcctccccgatccagccccacacacacccctacaacggcacagccatcctccccgatccagccccacacacatccctgcaacagcacagccagcctccccgatgcatacctttctcagggcctcagcagcccccaaggccccgagggacatggcagcctgctctgtgaaacgtcctgtctgttctgcattgtcctgggcctcctcccagcccttcccacaacgcccaggccagctccaacagaggggaagttggccttcaccatccagcgaggcagggtcctggggtcgggcatctttgagccaggggctggggcagtcctgacagctccacctgctcatgccatgccttgcagcctccctgcccgtccgatcgcctgagtcaggcgtggtcctggcctctcttgccccatttgttttttcaaaaacctgcaagcggaatgctgctgcttccgtcttcataggcacagagccggatttaagaagaggaactgtcttcattttgctcaaccacaagggcagtgaccttgggttcaaccctgggcctctctgactgctttcctggccacggctgctctttggccccatgaggagccacgtggacgtgggtgtgccgattgcacagctggagagacgtgggcagacaggctgggactgaaggtttgtcccagagctgagggtggggcagaggcagccacggtatccaggcttctgagcccagcccttgccttcatgtcgggggatgacagtctcgccatcagcagcacccaatgtaggccctgtccagggagtcagtgctgcatcgtcagtgatgggagagggaggcggaggcagggaaatgcacagagccagtggccttggctgctgtgacagcatagcagacggggcggcgcaaaccgcagattcatcgcccaccactcacaggctgggagtccagggtcaatgtgtgggcagggctggtttcttctgaggccctcggagaagaatctgtcccagatctctctcctcggcttgtgggtgccgtctccgtcttcacgcggtgttccctgtggctgccccgtgtccgcatctccgcctttgataaggacccccgtcttgttggattagggcccgccctaatgacctcattgaaacttagccagttacctccacaaagaccctattccccgataaggtcacgtccacaggtactgggcttagggcttggcatgcgaatttggggaactcaattcatcccaaaacacggggagtatctccctcagacctacgggcagtggggcgtggagcatctccgcacgtgtggctcggttattctacatgatgcaccagttccgccgtggaggaggctcctcggacagttcccttcctgagcgctcagctcttgtctgctccaaggtcaggccctgagaaagtgccccaagaccgtgggcctgggagaaagggtcacggggcttgtgctggattttgggacttttctcttcagcctgtacacaaaggttacacacaaagaagacggcaaagggaggtgggggggtggggagagggccagacagaggcaaacatggttctccagggtttaaagtgggcacggtgcgggatgcttcctccctggctggagaggatccttacctccagtggctctgcgggccgtgcctgttgagaagaaggctctgaagttaccccatgccacaggcctttccgttgcaggcccggctcggccgtcatcatgtgagcgtgagcctctgggtctccatcttgctcatgcccctcatgactacatgactcctcggaatgcaaggggcagtgtggtgttgccagtgagctgcttcttgtttcctaccaggaatcacacatcgcatccgtgtgagtacaagaaagacccaaatacccatccactgcctgctgatctggaggcggagagaggacggccccagagaccatccaccctccccattcacccatggtccacacagtgatgggaaaccacattccaaaatcaacacttttccaaaacagtgggcagaaaaagctggtggcatggccactccggacgcacatctcagagggtttgctgctggcgcttcagggtccactgtgctagtattttttttttttttttttttgagagacttgctgtgttgccgagctggagtgcagtggtgcgatcttggctcactgcaacctctgcctcctgggttaaagcgattctcctgcctcagcctcccgagtagctgggattacaggcgcccaccaccacacccagctaatttttgtgtttttagtagagacggggtttcaccatgttggccaggatggtctcagcatcttgacctcgtgatccgcccttctcagcctcccaaagtgctgggattacaggcgtgagccaccgcacccggccagtgtattttttaaggaagcaggagaaaacaaaatctgaaaaatataaacacttttattttaaacacacactccttcaccattgaatgtgtttttaagatcaacctatttaaactttcaatttaaaaatggtcgtctgttagagggtaggagacttggcttagaaagcatttgattaaaacatgcagatctccattctcagcttggtcttctgaattttgttaataaaattatttccatggaagtgaacctcattctactttttttagtcaggttatttaatgcttgttttcataattgttttcaacagagatacacaaactgacttttaaaaaaatactgtgccttcaggtgaaagcttatataattgagcagagtttgccaacattttggaacttttttgacaaaataattcccacataaatataactttccttggttctgttggctgagaccctaagtcatttctggcgtattttaaaaatccagactcctcagcgggcaccgctgcaaacagacctgcctctaaggctgataacgtgaaggtgtcgttttcaacacaaaaggctctgcacagaggttttttcttctgagcgggtggttatttgagtaacacgtcctcttgtcaatctttaggaaaacgggtgttgcccgcagcgaggtgggcggaggcacaagtgagctgggcccggaagaggctgttttgttcagtggtagggcaggcgcgggagcgctgaggctttgtgccaaagagaaacagaaaagaaagtttgccatgtgagcgtctcacatcactgtctgccaaattccgcatgtgagagaaggctggaaggaccacactgttacaggagaggctctttgcctccacacggcctgattgctcaggggttttgttagggtttcaaatgtggagagcagaaaacactcaggcacctagagctgggcggtctctgcagagcagggacacaaggtgcccttggcgggtgtgccctggccagtccctccctcgggatatggacaatctccatctcccatactggatccttcaccctttcttacagcggatagggacgctggactgaggcaggttctgtgcccggaacctcagtgatggcaaagtcgctgttccatgcaccaggagatgacagggaggggcctccgtaggttgggtttcagagactttccatcagactatatttgtattaaagaaagcgcatttttattcatgagccatatttgtatgaatgttcaaatgcctgttatgattattttgagaagttaagggataatttagattctctgctgatattcttgttattatttaaacagtgcatttgctgattaagcattaaccgccactctataggaggcaggaacccaaacagcctcgttaagggactgataaaatgcaccctcgttagagaaccctttttgggggttggtaattatcacagatatttattaggcagaaaggcacaggagcggctggaggctgggtgagtccggtgtgcggggccatgggacagaaggcccagcaggctctgcacggtacctccctcgccgccttttgttcgacagcccgcccattccgctgcttttctcttccacccttcaccccagcaagaactcgctttgctttgggtaaaccaagaatagggaagatctgaaaaatcctaatgtgcaaagcatatttcagagatgaccattcgttctcccacatgaagattgtattttacacattgatgtggcacagcattcctgatcctgcatgaatttaaagttggtttctcccgtcaactctaccgtggccgcttgtggtgtgaagaagcttccgcctccatgccccagcctgcacctgccctgcaggactcccaggaacctggaatcccaggctattctacaccttttgtctgtcaaggaattggagggtccaggacccaccccctggcctcaaaacagactcatattgtggggagctgaataagttagtctgtggatggtttgagaaaggagaattctggatttggtggatgtgagatggtgcaggactgtctgtgcttctttctcacagcttccttgtggaatatgtagtctgtggtgcacacaccaggccccgggagacctgggatcccttatgcgagcgtgaggcaccccacgtcggaaattcggatacctgggatcccttacacgagcctgaggcaccccacgtcggaaatggaaattcggagacctgggatcccttacgcgagcctgaggcacccacgtcggaaattcggagacctgggatcccttacgcgagcctgaggcaccccatgtcggaaatttggagacctgggatcccttatgtgagcctgaggctccgcacttcggaaatttggaatctgaccacatcatgtttctccccagttcctcaaaggcctggaaatgctggtgttgggtggagaggggataacctgagctctgtttgttatgaatgttctcttttcctcccataaaagattttcaagcaaattttatctggcaatttatttaaaccaaaagcatatgagtagaaagtggtttaaactgaaataaaaaacgtgtaagatgctccaatccttggaagaccatccctgagggacggggagcctggctatctcatgtcgtccccaggacacggcacacacgggccccagctgccatcagggccagcggtgaagggtctgtgccgtcttcccctcctccatggtgatcgaaccctaagtttagctaaaataacacgtttggcctcccctgtgcttagatgtggtcactgagtgagacctggccatgagctgtggctgtacagtactctgggcagaaaggcttcttgatgggaaatgacggccacctggatagtggatcctaggctgatgtggttcccgtaaatgtccctggccaggatgcgggacccagactgcccatttagatgggttttgtgtgggagggaagaaaagcctcaggtgttcacaccaaccttgtcagaagttttctgttatatgcagctgaatttagtcctaaacagcacatcttgtcagaacccaggggttggcccaggctggtcactctgagtggcgtggggctgcagcagcatctcgggaagggtacaagcagtcagaggaacggtggctcagggacctgggagaccttctgctgagcttccttgctgaggtgtgaccctgagaggacgcacacccacatgagcctcggccccgtagtgtctgacatgaatcgcaacttccggatggccccagctcacacactgggaatgacggtggcctcatgctgcctcctccatcccagcctgggggagaaaggcaccgcgaactccagctttctgcctcttcggtgggaacagtgggtgtcctcttgctgtgttaaatttgatctgagctgagggaaacccgaagaatcagctccatcaccctggagaccagcgtcagcccggccggtgggaactgagaaggacctgggtgtagaggtgctggggtcctggacgccagccacgctgggaccgaggggctccgcagacgtcatcccaagacccgctattggttcagagcttgtggatcaggaccagagccagtcctctcactggggcagtgagagcctgacatatgtccagaaggcagcccctgtgatcctcccagggtggcagcggccaagtgagtggtccagggcacaccgtggtgcacacggggcttccctgggtctgggactgcagaggcgtcggggctgctggctgcaccactatagccgtgggctcactgcagggtgcgggccaccattcaggacaagcgttcctgtggacgacctgccagaggtggcagcctgcggacaggggccccactcacttcagctctggcttacagaaccttcatgggatcccgcggaagccgtcatttctgtcaggtggggccccattcactcctggcaagctctgtggcttcattgactggtgggagcattttgttgcctgtaaagccaggaactgttgcccatctcacagcagtggtgcaaatcaaacggaatgagagagggctccgtaaatatcgggcacacatgacagagtgagagagggctctgtaaacattgggcacgcatgatgcagtgagagagggctctgtaaacatcaggcacacatgatgtaatgagagagggctctgtaaacattgggcacatatgatgtaatgaaagagggctctgtaaacatctgtaaacatactgcacccatgagggagtgagagagggctctgtaaacatcaggcacacacgatgtaatgagagagggctctgtaaacatcaggcacacatgatgtaatgaaagagggctctataaacatctgtaaacatacggcacccatgagggagtgagagagggctctgtaaacatcaggcacacacgatgtaatgagagagggctctgtaaacatcaggcacacatgatgtaatgaaagagggctctgtaaacatctgtaaacatacggcacccatgagggagtgagagagggctctgtaaacatcaggcacacacgatgtaatgagagagggctctgtaaacatcaggcacacatgatgtaatgaaagagggctctgtaaacatcgggcatacatgatggagtgagagagggctctgtagacatcgggcacacatgatgtaatgagagagggctctgtaaacatcgggcacacatgatgtaatgagagagggctctgtagacatcgggcacacatgatggagtgagagagggctctgtagacatcgggcacgcatgatggagtgagagagggctctgtagacatcgggcacgcatgatggagtgagagagggctctgtagacattgggcacacatgatggagtgagagagcgctctgtaaacatctgtaaacatccggcatgcatgacagagtgagagagggctctgtagacattgggcacacatgatggagtgagagagggctctgtagacatcgggcacgcatgatggagtgagagagggctctgtagacatcgggcacgcatgatggagtgagagagggctctgtagacatcgggcacgcatgatggagtgagagagggctctgtagacatcgggcacgcatgatggagtgagagagggctttgtagacatcaggcacacctgatggagtgagagagggctctgtaaacattgggcacacgtgatagagtcagagagggctctgtaaacatcgggcacagaagatgtaatgagagagggctctgtaaacatcggccacacatgatgtagtgagggagggctctgtaaacattggccacatatgaaggagtgagagagggctctgtaaacatcgggcacacatgatggagtcagagagggctctgtaaacatcgggcacacgtgatggagtgagagagggctctgtcgacatcgggcacgcatgatggagtgagagagggctctgtagacatcgggcacacatgatggagtcagagagggctctgtaaacatcgggcacagaagatgtaatgagagagggctctgtaaacatcggccacacatgatgtagtgagggagggctctgtaaacattggccacacatgaaggagtgagagagggctctgtaaacattgggcacacatgaaggagtgagagagggctctgtaaacatcaggcacacatgatggagtcagagagggctctgtaaacatcgggcacacgtgatggagtgagagagggctctgtcgacatcgggcacgcatgatggagtgagagagggctctgtagatatcgggcacgcatgatggagtgagagagggctctgtagacatcgggcacgcatgatggagtgagagagggctctgtagatatcgggcacgcatgatggagtgagagagggctctgtagacatcgggcacgcatgatggagcgagagaggtctctgtaaacatcagacacacctgcagcacagggatgatgatccatgacacgattttctctcagacagcagcaggcagggtgttggggcagcgcactcagggcagtgacaaactggtgcctgttccccctccgttccggccccaaaattgtggggacgccccacagcagcttagtatcacccaggggaggggaaagggtgtttctcggtggttggttcagagctttgcatttttagagcgtcatttcctggaggcctgagagatttcataatgataccgagttctctcaatacgtctctgaaggagaaacggactgttcttaggttcatagaatcaagcagctcttggttttccagatgggtttttttacctctttaatttcctaggatgcaaacgtacatcacaccttggccagttttcagaagacttgttttggtgactcccacccccgcttttcttcctagaatattggcggctcatcttcattgcctggctggacgcagacccagccctttcatctgacagaggtgccgtgaatctcgcttcctggcgggtggctcacccccaccttttcccactttttaatagtgtttcttgaagcacagaagctgcttcacttgatttgatcaaattttaccactcccttcctccgtagtttgtgttgtttgaggaaaggatttgaggaaactgttttctgccctgagttcagagaggctcaaatgttttcttcaaaacatttacaggttttttccccccatttaggctttaatctgcctggggttaatttttgtgttttgtggagagccgggatccacttctgtcttccgtccctccccatggccccacgttgcttgtccttcctctgcccatggccctgctgtgtccttgctgccgtccccgtctctgtgagtcatgagcacagggacctctctggggcctcagctccatgttggtttctttcctgtgcacccacctgccccgcggggaggttctgtgccgcacagtgggttaccgcatctgcaagtggctcctccatgcaatgctccttaacattgcctgggctgttcttggccctgtgtggccgggaacgtggtgagttaggctgcatggttcaccgggatgtggccgggaacatgctgagttaggctgcgtggttcaccagggtgtggtcgggaacatggtgagttaggctgtgtggttcactggggtatggccgggaacatggtgagttaggccagtaacctggtgagttaggctgcgtgattcactgtggcgtggccgggaacatggtgagttaggctgcgtgattcaccagggaaaagagggcggatcactctgtgtatgtcctctgggtggtgcagggaggacagaaaggccatcgagtatctgccatgcatttttttcctacagctggctaagggtgctagtgtattcattacattagcctgtgtatctttttctaggaataaaatagtccatttgaaaaacaacaaaggcagccatccaagttgctctctgcccgtcgtggaccaacgtgaggtcagggctgcgtccctgtgaccttgtgctcacctctccctttgtctatctctacaccaagggcaaaccctggaagataaggcaggtgtcaccaggtggatcccaaccgatctgtagggtttgctggaaaaccagtgtccagggctccagggcatcttcccacaggccagaataagaaaaacgcccctgaaataacaaaacaaaagagacaaaggccgtcacagtgcacggacacgagcacccggaggctcacaggactctgcggtagacagaacaccacagatgctaacatactgctatctcgtcagatgcaggcagcgcccagctcacccctgcggagccgctgacctgcaccagtcctgagaactcagtgccgggtacgttgccgggaacacagagcaacttaggacgtgaacaagcctctcgtactagaagtggaggagtaataatgctttcttcatctccagcagtgtgccctcatcaccaccctggggtcgtgctgtggaaggccttctctttctagagcattgcttcaggaccccaggctggtcacgctgggctcctgtccccgtgtcagcctcaccctctcctcctggccctcacctggcagtttcctcagtggctttgggtcgttcctctgccccagatgtccggtttcttcctcgaatttcagctctagtgttctttcttctccccactgtcctccatctcccacatgccagtggcctcgctagctgtgcccaggccttcagctgcctggagggtgcaggctggggatggggctggggcctggacggcttctacagagaagtgggaatgtagaatctccttcagagagtgtgtggccgtctcaccacccgccaaggccagtccctcctgttccctttcctgcagagacacgtgctgcacaccacctcctgtgtgtggggcttgcacactcctatgttcaaaaggcctgcgttccacacccatgacgtggaggggcctgcattccacacccacgatgtggaggggcctgcgttccacatccacgacgtggaggggcctgcgttccacaccgatgacgtggaggggcctgcgccgccccctcctccgtgcagggggtcagagtctttctctgcacctttcctctccgtggaagagctcccggtgcctgcagtggggtggcactggtgacggcaccacatcgaaaggaccccaatgtggagccctgtttgctccagttgtctggaaggaatgccatgcagccccgacctgttcctcctcccctttctatcagcaaattaacatcccacgcattaagccttggtcctggaataatcagcacagagcagaggtttccttcgaaactgcgagtgtgaatcatagaaccgtaagtatcatgatattgtgtggcacgctggaaagaaagcaagagagttgcgtaggttaatgtgtgttcccaaatttttttccgacacctgcactcaatgagcggctctgggccttctgtgtttttctgcaccagccgtctctccacctgccctcccccagggaatcccgacagtcagtggccagggaagttgggtctggaaggaggggacctcttgacttctccaggggaggctcagaggcacagtcctttgctgaggagctccaggtggaggaaggcagagaacgcacagccaggcagtgggcatggactgaaaccagcccataaacccccacgccggcccccctaccaccacaattaattcattaatgctggaaaccaccattgcattgttttcttgtaattatacacacctcaaatgcttgcttttgaagacattaattgcatgattagttttatgatttctgattaccaattaggttacctttttgtgtatttcatacataccattaggctttatggtacagcttttgtaatttctcacctagcaggggttctcacacatttgaaggctacattatccactcaataaacagagagagtttaattttctgtgtaaagtattggtgtggacttgggaagatgatgtttcagatattatgctatcaagagtgacatttaattttacaggggaaaagtcgtggttttcactgtcataacgatgttcacagagcatgactttagagatgggaggaggccgggtccaatggatctgtgtctgcggtgtggattgggctgtcacatcccttctctgaggaagatattcctaatcactctaccctttactccgacttgttaatatatttaatttacttgtgccttgcctctttcccaagaatagttagaaagcatttggtgctgttgggtttcctatgtgaagttccttggagattccattccctctgatctgaaatcaaagggctgggtgtgcactgtggcggagacaggggcacaggattcttaacgtgcccttgtgaggccagatgagaaagtaatcccagcactttgggaggctgaggtgggcgaatcacaaggtctggagttcgaaaccagcctgaccgacatggtgaaaccccatctctactaaaaatacaaaaattagctgggcatggtggtgcctgcctgtaattccagctactcaggaggttgaggcaggagaatcacttgaatacgggaggtggaggttgcggtgagccaagatcatgccactgcactccagcctgggtgacagagcgagacaccgtctcaaaaaaaaaaaaaaaaaaaaaagtctcctgaatctgcacacaaagcggcatttgagccccttttgtaccatttgcactttaaatctcctcccttcccccagggaaaataagagcagatagatcagtaatcaagagatggtcaggtggacgaggcggctgattggagcgcgctgaaatgaccccataaagcaggaatgtgtgggggaggcctggtttgaccatgtgatgcagcagcaccgattcacagccccacgcacaaaggggccagcaaataatgccgtttctaatgttgtgtatgggttggggaccttcctgttatttaaaatggatgcatggttccagtgctctgacagccaggcctccccgaaagggaagccactgggaggtctaagatactttcaattggatgtggctatagaaagagaaagttccaattttgatgttgatccttaaagtattagcttgacaaagctttgcattatgggggagagaaagggagaggagggaggaaaaaagacacagtccccgggtactgtatgctgtcctgtgggcccctgcaggctgcaggcccgcaggaaggaaagcgcagaatccagggtgttctcctgataaccagagaggacgtccccagcaccccgaacgctgcaatattttcataaatgtagaaaaaatagtagtgtttctcaagcaacctttatttacccccagctttgcttctctttctatggaaggcttccttattgtcccacgtgctcctgaataatgcatgagcctcagagtccgccaggccaggaagcacaaaggccccgtggtgggggcccttccaggcaggcaccccagcagcctcgggtaattactggcccttaatgggcagtttccctgcctcagatagatttgtgtgtgtgtttaagactaatttagggttcctttgggggagcttttcaaaatcatcacctgcgggtggggtgggaaggggaggatccttcactcaagtttcacttaaagccacgtacaatacggtaagtttgaaaaaccatcaggaaaaggaaggccgacctgttagtgagcatttgagcttcccaccatgtggggctctgcactttagataatgtcctcgttcacagttttgtctcttcaccgatgttcagccagtgacagggagcgtgtggggagtgaaggcggtgaagaagctttcaagaccccatagcctgttccaaaaacagcctgaattaacttaaagctgcccttgctgccatcgtggccagcgcatgaactgttactgcagaaggactttcacagaacttaaaagtagatcatgcagctctgcgaccgcctctgccctgtgctgggagcgagtgcagggcggacacggctggcacttccagcagaaggcactgcagagctcccaggccaggcagcggccgttgtgaattgcaggttgccctgcagactggacgttgagagaggaggagggggcaggcaggcggtgaggtggtggctccagcccccgccggtgcttctccctgggcactgcctgagagggcgcccagcccctcacctctccaagaagaaacacttctggctcctggaggggtctgaggacggggctcctcttcaggggtcctgtggcctgagaccaggaagaaacaacctgtccccctgactgctgagcagcagcaacccactgggtgaaaacgctggaggctctggatgctgcctggtggcggctgtgagtgatcaggtgccagcgtcagcatcgggtcatccactgtccagaatccagcaccactccctaaattccaacttccccccaacacggggcctgctctgtgggcttcagccggctcggatgttgtctgcagctcccgtcccgtaccctctccactcccacaccctgcctggacatggttacacagtcacacacactccacacagtcacacagtcacacagtcacacgtggccacacagtcacacgcggtcacacagtcacacgcggtcacacagtcacacacagtcacacagtcacacacggtcacacagtcacacgcggtcacacagtcacacgcggccacacagtcacacgcggccacacgtcacacgcggtcacacagtcacacgtggccacacagtcacacagtcacacggtcacacagtcacacgcggccacacagtcacacgcggttacacagtcacacacagtcacacagtcacacgtggccacacagtcacacgcggtcacagtcacacacggtcacacagtcacacagggccacacagtcacatgtggtaacagtgacggccacacagtcacagtcacacagtcacgcggtcacacagtcacatatggccacacaatcacacatagttacacagtcacacacactccatgtggtcacacagtcacacacagtcacacagtcacacacagtcacacacggccacacagtcaaatgtggtcacacagtcacacgtggccacacagtcacacgcagtcacacacagtcacacagtcacatatggccacacagtcacacatggttacacagtcacacacactccacacggtcacacagtcacacacagtcacacagtcacacgtggccacacagtcacacctggtcacacagtcacatatggccacacagccacacatggttacatagtcacgcacacagccacacacacttcacacagccacacagtcacacagtcacacagacatgcactcccacacagttgcacatacacattccacacagctacacagtcacacacactacacatagccacacagtcatacacagacacattcccacacaggcccttgcactccacatagccacatgctcacacagtcacacacacaatctctcacacacacacagacacacagagtaatacaaagtcacacacacagacagacacatagacacagccacacatgcacattcacatacactcccacacagtcacacaaccacacacacagccagacacacacacagtctctctcacaaacacaaacacacgccacacacactccaccacatacacactcccacacagccacacagacacacacagtcatacactcacatgcagccacacatatggacacagtgacacactgacagtgatgaacatgcactcacagtcatgcacatacattcaaacacactcagatacacatacgactatacatgcttcagtcaactcacacagtcagataccaattcagtaaagaacaattacgtgttaatctgtcttgtgccaaatataagtcattggcttttagaggatggaatcagaggcaacttcacgaagacaagaacactgtagccaccccagggaagacgagaggaactggagtagccacggcggagaggagctttctcccgtgccatccactacgagaggaactggagtagccacggtggagaggagctttctcccatgccatccactacgagaggaactggagtagccacagtggagaggagctttctcccgtgccatccactacgagaggaactggagtagccacggcggagaggagctttctcccgtgccatccactacgagaggaactggagtagccacggcggagaggagctttctcccgtgccatccactacgagaggaactggagtagccacggcggagaggagctttctcccgtgccatccactacgagaggaactggagtagccacggcggagaggagctttctcccgtgccatccactacgagaggaactggagtagccacggcggagaggagctttctcccgtgccatccactacgagaggaactggagtagccacggtggagaggagctttctcccatgccatccactatgagaggaactggagtagccacggtggagaggagctttctcccgtgccatccactatgagaggaactggagtagccacggtggagaggagctttctcccgtgccatccactatgagaggaactggagtagccacggtggagaggagctttctcccgtgccatccactatgagaggaactggagtagccacggcagagagcagctttctcccatgccatccactacgagaggaactggagtaggcacggcggagaggagctttctcccatgccatccactacgagaggaactggaataggtacggcggagaggagctttctcccgtgccatccactatgagaggaactggagtaggcatagtggagaggagctttctcccgtaccatccactatgagaggaactggagtaggcatagtggagaggagctttctcccgtgccatccactatgagaggaactggagtaggcatagtggagaggagctttctcccgtaccatccactatgagaggaactggagtaggcacggcggagaggagctttctcccgtgccatccactacgagaggaactggagtaggcatagtggagaggagctttctcccgtgccatccactgtgagaggaactggagtagccacggtggagaggagctttctcccttgccatccactcagcaagtgtcggactccactgagtcacttgtgtgtcctatgctgggcagcagggctgtgagatccacgggacccacccctgagtccaaggctccgtgtctaacaggtgcaacagacgtgtggcggcaacaaggaagggtcatggagtgaaggaggatgtgagtcctgccctgtggaggctggatacactgtgtccttgtgagggtcatggaggatgtgagccctgccctgcgggggctggatgcaccgtgtccttgcagacggcaggagtgcgaaggactcaggcacagagcaagagggcatgacccagcagaggctgtcaagcccagggtgttcctgggtgcgtgtgctggggagtcgacctccacagaatgtggtacatggccctggctcctcatggtgccccttctgagccatctcggatgactctgcatcaaaacagcctcccccctccaccacctcttccatcagacactacatcccccatgggcattaataatgtcctagccgtccataaacctcagagcctggcccacagcacacaacaagcgagcaattctctgggtgggtgggtagatggagggacgtgtcgatgggcaggtgggtggacaggtggtggtgagtggatgggtgggtggatgggtggagggacacatggaagggtggatgtgtggatgggtgggcaggtggacaggtggtagtgagtggatgggtgggtggatgggtgggtggatggagggacacacggaagggcggatgtgtggatgggtgggcaggtggacaggtggtggtgagtggataggtgggtggatgggtgggtggatggagggacacatggaagggcagatgtgtggatgggtgggtgggtggacaggtggtggtgggtggatgggtgggtggatggagggatgcatggaagggcagacgtgtggacaggtggtggtgagtggacaggtggtggtgagtggataggtggtggtgagtgcagggtgggtgggtagatggatgagtaagtgggtggtttggtcgggggatggatggatggatggatggatgaatggacacacagttgtagatttggtgacacaatttggaagtctctggagcaattaaaaatggtccaggccaggacatggtcatgacataggccaaacctcttctatattatctgtcaggaaatcatatttttgttaaaatacttgttttgtgtctattgaacacttagcgtggaaaacttagaaaatgcttactatttgatattcttttaggatgtgtgtgtgtgtgtgtgtgtctttattttgcttttcagtttgtatgtgtgccttatcaaattgtctttaaaatatgcttctgaggaacactttggtctttatgtggttctgctgtaagttcttcaacccatgtgctattgttgaacatttagcttgtttctagtatttcattatcataagtcttgctgcaattaatatccttgggcatacattcaatctatgtggcttactgtttctttaggatacactcctagaaatctaactactatgtgaaatggtgcaagctcttctaaatacctcaattcctcttatccagttgaactaatatctccaacaaatgcaggtgcatctggcaagtccaataaacctgccatcatccactcacttaacaccaagggttaggacttcatttaagtgcatgcaattatttagggcaaacgatagcatcttatcattggtttaatttatagtttttgatttattgtagatttaaacattttatcatacttgattattgatggttctgcttcctgggataatctcttcatgaattttcctatgggagtgtgaattttctgaaatagactcacgagtactcttcatatttgtttttgcctcttacttttggccaatgttctgccaggcttgtctgtgtctaacgttgcttgttgtactgtctgaagttcagaaaggctgagctctggtggattcaaatgcacagtcgtttcctttaagattttgtcaatcgctctcatgtttagaaagtgcttgctcatcctgtcatcagtgaaacacaagtttttatttgttatttttatggttccattaatgtgttaatgtatctggatcatttctggtggttgtaatgtgtgtgaagtgagggataaactaggaccttcccccaagtaaactctagtttcttgaataagccattgtttcccacgcatttgcagtgcacccttcggctatgttgttaatttcgcccctgcaccctcccgagcgccctgagagccgaggcattgctgcagatccctgtttcctgttcttcctactagtcattctagcttcttcttgcaaactctcccccatccttaggacgagtctctttcctgtgccgtacgtctctaatatcccctcttttagcatcttttgtgctttgctcgtgattctcgaagagctttgcgggttcggttgtgaactgtagtcagttctgctctgccgcctcaatgtgaattttaactctgctattgtagttttaatttcctcacagttatttctcatctctcccagttccagctctttgccttcataacttggtaacggttctgtttttatgacaccctgtttttcccgttgtgttgtgtgtttctgctcctgtttttagagaggctgtgtgtcttgcatcttcgttggaaagggtagcagagttctcttccagccaccttaggaaatcctcctggaaggtctgcttgtcctagggggctcaggacgctgtggcctgtctcttactgaaaccatattttcagctgtccctggttgctggcttttatcttccctcttcactcattctcaaaggaagagaagagaaatctatccagcttcttttcctgacaaaaggcaagaagtagctcatcactgccccagctccattcaccacccacagcaggctacatgcattctttccccagatctgtggctcggggagtaggcggacaggtcaatgttcacagctgcaggaaaatccctggttttgctaagagaagcattgaaagctgggtccggtgctcttattgacaacacatttggggttcatgacaacaagccccgtagcctcatgtgcgtctgtcctcctaaggtgggtccccacacccgcctggggtcctccctgcaggccggctccaggctcactggaggctgggcccgcagccccgtggcttcccctctgcgagcgtgcactctgcacacacaagcacacccacgtttctgtctggagccgcccgctcgccctgacttccctgtgagcgcagctgcgctgggtgcccctggtagccagcgggtgggtcgactgatcaattgatggattgatcacagggagtgcttctggctcactgattggtgggtggaattgatggattgatcacagggagtgctgctggctcactgattggtgggtggaattgatggattgatcacagggagtgctgctggctcactgattggtgggtggaattgatggattgatcacagggagtgctgctggctcactgattggtgggtggaattgatggattgatcacagggagtgctgctggctcactggtgggtggaattgatggattgatcacagggagtgctgctggctcactgattggtgggtggaattgatggattgatctcagggagtgctgctggctcactgattggtgggtggaattgatggattgatcacagggagtgctgctggctcactgattggtgggtggaattgatggattgatcacagggagtgctgctggctcactgattggtgggtggaattgatggattgatcacagggaatgctgctggctcattgattggcggatagaaagtactacagagagtttcgaaggacgttggcagaggagaaatccgccagctccttctttcggcaccaggtcagagagaatctggggctgcagtgttggtttctgggttcagtgcgcctcagcccagtgaggagtggagaccaacagcgccagctgcccacgtcctgtccgattcgactcagaaagccacaatgctgatttatggaaatgagcggcttgttactcctaaaatgtccatggatgagagttgtgaccagaagaaatgcaaaatattgaaatttatctggaaggaaattgaagcagcggataagatcatcatactaacggctgcatctccacaccctccccaatttcctaaaacccaggagagctgctcccggaactatgctccatcaagtttaccatcatacaggatggatgggctccggccacgtcacacacttcctgaacgagtttacaatcatatgggatagatgggcaccggccacatctcgctcctggacaaattcaccgtcatacaggatggatgggcgccggccacgtcgcatacttcctggacgagtttaccatcatatgggatggatgggcaccggccacatctcgctcctggacaagttcaccatcatacaggatggatgggcgccccccacgtcacacacttcctggacgagtttaccatcatatgggatggatgggcaccagccacatctcgctcctggacgagttcaccgtcatacaggatggatgggcaccggccacatcacacacttcctggacgagtttacaatcatatgggatagatgggcaccggccacatctcgctcctggataagttcaccatcatacaggatggatgggcgctggccacgtcgcatacttcctgaacgagtttacgatcatatgggatggatgggcaccagccacatctcgctcctggacaagttcaccgtcatacaggatggatgggcaccggccacatcacacacttcctggacgagtttaccatcatacaggatggatgggcaccggccacatctcgctcctggacgagtttatcatcatacaggatggatgggcaccagccacatcacgcacctcctggagaatcccgccatctcatcacagttctttgaccagttggctattttctccattgagtaaattggtttggtaacttttcccactgtccccattctgatcacaaatccagtcactctctgctgttgcttttgctactagaaggaagagaactgctccatatactgaaatattttgggccaagccttccagtaactgaagatccattcagcctttgaatcaaccccagattcccacgcgaagcatatgtgtttggaaactgtgacagattgtgcctttccttccttctcaccctcacctcccccacacgtgcagctccttcgtgtttccatttctttttttctttttaacagcaatttttgtggcatctagaagcaagtgcagtaagtctctgggtttgaagggagcttcagtgtgttggtcagtcaggcaaagcgtgggtgaaacttaggaatcctgtgtttctctttgaactcaacagaaccgctacatttcttgacttccaccttcccaaatgtatgtttaaaacaaaaacaaaagtattctgtctccagtttacaaaggcaaccttcctgaacagaccaacatggattagtgccgcctgtcggaggagccacttggcaatgtgtgagcgcagccacagcacacggtaatttgcagaatgcagccgcctctgatcggtctgaaataatcctcctgtttatgaaacagagcctgagatgcagcatcgagcctggtgccaatcacagtggtagtgcggcttaacacagagctcgagtcctgagcctgtgagaccggctgagcagctgccacagccttggtgccacctctcatgtcctccgagcttccgggcgctgctgaagaattcatcacatggttgtgcaagtgcctccaccccggagaattagcggaggtgccaggtgctccgggaggacccctcagggccatcagcagcccagccgtcactcctcatgcagacgaagcaactgccagacaaacttctttccgttttccaacaacttaccccgctctggagctccataactgccctcccccagcttaaggatggctatgaattaaaccctggaatatccatatattttatggcctagggttccattcgtgggacgtctcgtgagggtctaacgtggccaggcttgtcataggactgggctgtgctggtgtgaggacagccccagctgcctgggggagggagacggcagcctataccttccctgcttctcgcaggcccgaagtagaggggagctcagtgcagaacacctgtgtagactcccaataagggttggatgtcttcctgctcgttctgacaggtggagatggctctgaaatgctcactgagaccctcccagccactcctctgctcctcctcttccctgcctcaccctgctcagtactgcagggtgagaggggccgtggacagggatggggagggcagctccgtctcccagccccagccccagggcaactccaaatgcacccagccctgccctgctcttccctggacacagaacccgcatcagttaagatgcttcgggaagaaataacagaaaaccccaacgagagaaggcttagactacaggatattcacggctgcacatggcgggacacctggaggaggagtggccgcagtgctggatgaggctacaggtcgctgggacaggcctgcaccatgggggcttctgtctctggacttccctgcaccccttgtaagatgctgcagggcccgagcagttcctccccacagctgggctcacagcaaggagtccctcttcctgtgcttctccctttatcccagaattttattttgcaaactccacactgtcaaacaagttgaaagaagagtaaaatgagcacctgcaccctcttcctccagagtcaccaactttgagctctcagtcatgcctgcaactctgtcatttacctgtgtgtctggatggaagtcacaaaggttgctgcagacatcacaaaacttccccgtgaggtgcagaaaagggagtgtctgcatcatcccccagcgtgcagcctggaagcagtgacgttacttagcacacgttcgtatgtggccagttttcccgttgtcccaatagcttgctttttatttttaatccagattccaatcaagggtgaatgctgtgttttgttgtgacatctcggattttctttgttctagaatacttctacctttacgttttagttttggtcttttctagcattgcaattgttagagaaaccaggcttgtcctgtgggatatcctgtggcctgggcctgttggattgccccacactactagattcagatgcaggtcttcagcatgtggtgatgtgtgtgcctccggcagctgtgggtgcacggtcagcccctccccgcgtggcgatgtgtgtgcctccggccacagcaggtgcacggtcaacccctccccgcgtggtgatgtgtgtgcctccagccacagcgggtgcacggccagcccctccctgctgggacaatgccaagtgcagtcgctttggtaaaagaggcacctgccacatcactccattgtaaaggtaaattcttcccttggtaattcatcgttgatttgcaggatgataccttgagaacttaggggtatcttgttaccagcagccttttaccatgtgcctctttttaagggctgagtagggaagaagggtgggctggatgcccctgagtctgaggatgaggactgtgaattcagggaccccagatgcccctgggggtgctcagctgccagtgagcaggcacagagaagccagcccctcctttcttccagggttggcacttcccatgggaccaagagcaggaagacaggaggtcaaggacaccatccagaaaggacagtgggagggagggtggggcaggagggggtggtaacacgggggagagaggatactgcagaccaggagttctggtgaccaggacacaatgtctttggaagcatggagggacagtgcagctagaagcacggcccacagacaggtggagctgccactgcagaggtgcagggcaggcagctgccatggggcagaggagacatcaccatcatgagattcagggtgaaacagagtttgcccagggacaaacgtgttgccgccaagtcaacatctgtaccatcatgcctgaggagtcgggccagggcttttcctggagcgaccttcaatgcggctgctctcccggccctctggacggggtggtgctggggcagccacttgggctctcagcaggtgggtgcacggtcatgctctgtccttccattgcagagatggctcagctcacagtgtggcgccttccgcctttgtaaggagtcttcaccaacatcctcgtcctcagcttttccgtgtcagtcttgctggagcctctagaaagcagaggctttcacgccgtttagcatcacctacgctttaatgacagccttgtccagactttcaaacttacctaaccccacgtatggcctgcggtgcacacgggcccgcatctgtggcctcacggtcagggtgaccccacaaaaagagcgccccagatgaggacctgtttgatgttcgtcttttttaaggacttctacttaccagccgagtgtttgatcagtggcgaggcctcatctcttttgcgccaccgtgttcagatagcacctgccccaacactcgcagcaagacgggacccttgcctttttgtttttgactttaaatagctcctcattgtagaagacagtttattatggactcttcaaaatacatttctagggaaacaaatttagttgtccttattaaaaatgtattacatatttcagaatcaaagctcacggctcacgagcatcccgcgcccggctgcgccccgcgctggcatcgcagacgtgtcctggaaggaagaactccaagtgcatttgaaattcaaattgtgtttggttttaagatggggatgtcatcaatttcccttagaaaattataaaaaccatgatgcataaagaaatacagttggagaaaacagtgacaccatcttcgttcctgaattggtgactccaaacggcttgcccttggaggtcacttttatagggggttacgcaaataaaactgagtggcgttgttaaaattctccactactggacctttttagccaaagtgggcattttcgggagtcggcaacacagacagaccctgtcttacttgtcagctgtttggcaggaagttggtactttgccatagatttcagtttacctggttttgttgaatgtctcataaacagatacttgatttgactgtttgtacctgcagtaaccaggacatctctcagggtcttgctgtgatcatacctgcagtaaccaggacatctctcagggtcttgctgtgatcatacctgcagtaaccaggacgtctctcagggtcttgctgtgagctgctgccactttccagactcttccttcaccatatagtcttggtgctgatgacacggatggctctggggcagggaagtggtcccgaggggcacagctgtgggtgccgagggcttgcggaagtgggggcaagtcttgtatccgatcgctgttccgtccatgggctctgtagtcaacgtggcctcttctgtggttgctcgtgaagacacagctcagcatctacagtctgtagcaaggtggacagtctgtctacagcctacagcaggggcatccggacaggttggaaaagggagactgtggtgaccacacgcgtggaaggggctcagagaagcatgaggacctcccaccatcttcctctgagtaagacgtgatgctgaattttaacccagaggctggtcccagctccatctgcatgtggggaaaattaatgtcaggaaggaggaaaaccagaacttacgaaatgtacttccgtggccgtgaaggcaggcaggtcccacggtggggacgcccagagctgcaccccaagctgccgtctgagggaccctccagggcagctgccttgcggagacctgtcagcccaactgtgtcctggggcttcaagcattttctttatgtttaccttttcaaaaaaaaacaaaatcagaacgtgcagcccgaggaaggcactgagactctgggaacagcccgtgacacggtggccgtccctgagtcaaagcatcacagccggcgagggcggggccggcagctcaggggccacatccaccccggcacggtgagtcgtagtggagacaccaccaaccgccctcctccaaggcaccccagcacctggtcctcagtcctcgctcaaggaacatctgcagagcacactgggttcccccaaatgccggaggggtcctttgtggacgcagtgcccactccctgggccactgggtttgaaggacaactcagcccccatgggggaaataagtgaattgaatggaggacgtcacgcctcactggaggtcttaggtccaacccccaccacccacacagcccgaacgctttctcaggcccccagacagtgcccagggacattctgatcgagcttggcctccagacagccacggcccacactgtgttgtgttgtgttgtgttgtgttgtgttgtgttgtgttgtgttgtggtctctggcttccttcatccataaatgggtgcccacctctcaaaaccgctgcaggaatcgaatgagataatatgagggctcaagatgaaaacccaaatgcagggtgttgtcgaaaagctctagagaatggaaactccagaaaaccacaagggcctttgatgcttcatgagtttgaaaacaatgtttatacaggagttagggttaggttttggatgacattcagttagaaaaactcatagccagtctgcttggttagaaaatatagtaacttcagatgtctggcagtgttgtgttaggaccagagaacctagtgttttgaccaaggaagcatcatctctagtgcaatgtgtctgctggggacacggtcggagatgcaggacaacttgaagacatttggagggtcctgtgcaggagccgggtcagtatagacccctctggtgcctgtgggataagtcgtgctcctgggcagatgaattcgctgccccgtgcgcaggatatatgggcgcctttcctggctccccattgccccatgacctcacaggaggacggtgacatcctaaagccatgttctgcccaccctctgggatgccatggtccccaccctctgcaatcaggactcccacttgctcctgtgacacccccaagtccccgccaggctccgctgagattaccagggccctcacctgtgaactgggaagagtaatgcccaccttgttgcctggcgtgagggtgaaatacagcttagcacagcacgcgtggaaatggcgctcacgattgtgacgatcgtgttcgtgctgccatctttgcacagcacgcgtggaaatggcgctcgcgattgtgacgatcgtgttcgtgctgccgtctttgcacagcacgcgtggaaatggcgctcgcgattgtgacgatcgtgttcgtgctgccgtctttgcacagcacgcgtggaaatggcgctcgcgattgtgacgatcgtgttcgtgctgccgtctttgcacagcacgcgtggaaatggcgctcgcgattgtgacgatcgtgttcgtgctgccgtctttgcacagcacgcgtggaaatggcgctcgcgattgtgacgatcgtgttcgtgctgccgtctttgcacagcacgcgtggaaatggcgctcgcgattgtgacgatcgtgttcgtgctgctgtctttgcacagcacgcgtggaaatggcgctcgttgtgatgattgtggtcatcacagttgtgttgtcatctcagcacagcacgcgtggaaatggcgctcattgtgatgactgtggtgatcacggttgtgctgccgttctatttactggtggtggcttgagcagaggggattgcctgaccccttacatgcacgggggaacaaagtgaaagtggtgaataaagcacttgcgcttctccaaagccttgactcagtgtacaaaagagcatctgtaacttttcaagcacccctaagccacagacatccagaagctctctacagtgatgctactttttgtctcctggagccttgaggtctccagaacagtgcctgggagctcggcagagaagctgagtggtggaagctgaatggggctggggccagcgctgctgctcccccgggatccagccaggttttctcagatctgcagagaaggcgcctgaggtctgcctcgagagagatacctgtgtgagccccaggtgtgaactcagacatgaacaaatgtggagggcagtggtccaggcagcagagctcactcgtcctcttaacacgggagccttcattgttcaaaggtgtgattcatacactgacgtggcattttgacacttttgagaggataatctgttcactggcaaacacgtgtgtattagtcaggattagtgtgactgagtgtgacagaaaataaaaaataaaagtggcttaaatgagctggaaatgcactttcatttcctgtggaagaagtctgggggggaggcagtctgaggaccttgcagcctctgaggtcccagaaacaaggtgttctactcctgccgctccagccctcagccctgagctgctcctcatgatcccagatggctgctggagatcccaccatccaggtctcatttcagccagcaggaagggggaagaagaggagcagggcgcgcgtcccaccatgagacactccctgaaagcagcacacaactctcacttgggttgccttggccagaaccgagtcgcatgtccagcttcaagaaaggctgggaaagagaaacttcatccacgtgtccagctacagaccagaggctccaaggaagcagaggaagaccagcaggcctgggatggtgaagaatcctcgtttgccctgagccaagctgccttgagatggggtggggtctgcagggtccttggggccacattggctgactccccaggccctcagttttcccagcatgactcagccctaatgtgggccctgggtgccgctcgtgatccgcctgctttgtggcttcattcagcatgtggaagtggttccatcatctgctccagccaaggcgaggcgggttctgcctcacgggaaacaggtcaccctttctctgaggagtgttgccttctgcccaagtatttggggcacagcactagttgggggtcactgcagtgtagcatccaggttcacacccaaagactcttctgcccaccaacagacagccagtgacccaaaagcatgcctgtcctctagaacttcctgtcgagccaggtctcaccatgtccctccggaatggggcagcctccattccctattttgcgggaggctcagttgccaacagtccagagttcctaccgagttcttccgggggcctgtgtggcagccttgagtcagcaaagagtccctgagtgtcagtgacacacctcacgccatgcaggcacagagaatccacggacagcatgcacttgtcctcgggaagctgctgcccattggacaggtggggcaccagacagaggcctcccatccttaacatcccaagacaaacctgctaattaaggcttcaggtgcaaaggggaaggccctcttgtggttctctggcagcggtcggcacaacaagctcgccccctgccctaggaggaggacctgtggtcagcttctaccttcaggagggtgactctctggcagccgtcggcaagctgagctcgcccctgccttgggaggaggacttgtggtcagctcctaccttcaggagggtcacaggaggctgtgcacaaaccccactgacggtctgagctctggggccgtgtgctctcgctgggttcagggggattgttactgatggcagagcgaaggtgacttgagatgcatcagttctctatgagggcttgaagtccaggccacttttgagccagtccatctgctcatctctagagtaaggaggaaaaaggaaaaaacacttctaatttctctgtctgtctcatacccagctgtggaacgaaggactgattcaacctcctccccactttgccctccagattccccttagagacacaggctggttagggtatctgaattatttgagcaaaattttcatgcttagggaaaagcttgatgtgatcaaaacctaagtctcaggacatcaaatccccagatgtttaaggtagactatatatatcaagcctttgaagagttcaaaggaatgctagccaatgagtgagaaaatctgaaaacttcaccagtccttgcctgtcatatgaacttgatgatctaacctgtagtcttggatgtcaggggcctcagaaacacaacttccaaaccagaacatccttgggggatgaagacaacagggatcctaggagtccaattctagtctctccattctggatatctccacatcaagaatgaataatagatggagtccagctgttttgtagcagactgcagattagtgattcactgattgtaatcagaagcagctgctcataatcacagcccaggtacggacgctcattgtcaagtactaggtgttaattttttgcctataccctgagcctgaggctaggagtgtcttgaagctaatgataacataatcttgcaaacattaattagaatttcttgaacttattctaataatttgttattttgccaggctttagtattttaggtatttatgtgttttaaggttttattaaatattttaggtgattattagctctattttttaacaatatgggtcctcaatagaaatctggatggatggatggatggatatatgcttccataggtagatggacagaatggatggaaggaaggatagatggatgcatgcatggatggatgatggatagtgggtgaatggatgagtggatagaaggatggaaggatagaaagatggatgggtgcatgtatgtctgtatggatcatgggtggatggatgaatgcttgatagtggatgaatacatggataagtgatggatagtatatagataaatggatggatgagtggatggatggatgacagattggctgatggatgagaggaaggatggatgcctgcatggatgatgggtggatggatagatggatagtggatggatataaggatggatggatggatgggctgatggatatataggaggaaggatggatgcatgtacgcatggatgatgggatatgtggatgggtagatggatagtggatgggtggatagaagagtggatggatagataatggatagtgtgtagatggatgcatggtgagtggatgggtagatgaatggatggatgaaagggtagatggatgatggatagtggatgattggatgaatggataagtgtattatggaaagataatggatagcggatgattggatggatggataagtgtattatggatagataatggctaatatataggtggatggatgatggatagcatatagatgggtggatgagtggatagatggatgatggatagtatatagatggatagatgagtggatggatagttaatggatagtatatagatggatagatgagtaggtggatggatagtgtatagatggatggacggatggatggatggatgagtgggaggatggctcatggatagcagatgggtggatggatgcatgagtgtattatggatggatgatggatagtgggtgagtggatggatggatgagtgtatagatggataatggatcgtatatagatggatggatgagtatttggatggatgatggatagtgtatagatggatgaatggatgagtgggtagatgaatgcacaatggatagtggatgagtggatggatgagtgtatgggtgattgatggatagtatatagatggatggatgagtgaatggatggttattggatggtgtatagatagagggagggatggatagatgagtagatggatggatgatggatagtgtacagatggatggatgggtggatgagtgggtgtatggatgatggatagtgtatatatagatggatgaatgagtgcctggatggatgaatggcttcctaacccatgtccctcctcccccttagtcacgtctctcacaattatcttcaccacaacctatgtcatcattctctgtgacatcaacaaccattggtttccctggcctctggtttatttgtcttcctgtttgcattctccccaatcctccatctacctcagccactgcctctgccccggccacaggtgcagactccagctcattcagagtggcttctatcccaccatgccaaccaaggccagctgtgatttcatggtgctgaagccaatggccactcttcaatcctcatcaactgtgggctctccatcagcttttgagagctaataagccccttctcaaaacttcctcttgtcttggtgtcaaccatgctgggctcaccttcatctccgatgtctctggctgctctttctcaggctcatcaatggtggcctccccacatgctctccaaatgctgggttcctcaggacacttctctccagacaccacctccctccatgacctcattcatctgtataactccaaatggcagccatggagtgaattgaccctgaatttatagctctgaccagatcctagagttatgtctttactcagaggtcttataggcctctcataactaaaactgaattcttgttgttgtctccaaacttatgattgtgctggttctcaggagagaggacagcactgttcacaggtgagttgccttcttccacctacattcagcagaggcagcaaagtacacccgagtggcattggcacaaggatgctgggtgtgtcatctgcacctagatcctgccatgcctgccttggggtcacacaagctgtccagtatgcctggcctcatcctcctctcctccagcatgggagactccaccaggctgcagggtgcactcttgcctcccctccagcgtgggagactccaccaggctgcggggtgcactcctgctgccctgtggcagttactgtttccttcatcctcggctccaaagggcaaaaagtgagccccagcctgacactttccctctgggtgaggctgtcaaatcctctcctttctgatttcacctttcctggcatgtagagaataaggaataactccaagatcattctcatgggttttgaaacctcagatgcaaaagaagaaatgctctgaggttcctcagcctccagatgccacttcccagatcactcccccttggcttggcctcaggtgaaggtgtgtgtatgtgtgtgtgcatgtgtgtgtgcacgtgtgtaggggtctgctgtgtgcatgtgtaagaatgcgtgtgtgggggagtctgctgtgagtgcatgtatgagtgtgtgtgcgtgtgtgtgcacgtgtgtgggtctgctgtgtgcatgtgtaagaatgcgtgtgttggatctgctgtgagtgcgtgtatgagtgtgggtgtttgtgtgcatgtgtgtggggatctgctgtgtgcaggtgtgtggagtgcatgtgtgagtgtggatgtgttgtgtgtttgaatatgcatatatatgggtctgctgtgtgcatgtatgtttgagtgcatatgtgactgtgttgtgtgtgtgaacgtgtgtgggtctgctgtgtgtgacatgggtgtggtgtgtgcacgtgtgtgtgtctgctgcatgtgtggattgcatgtgtgaatgtgttggtgtgtgactgtgtgggtctgctgtgttcatatatatgtgagtgcataagtgtgggtgttctatatgtgtgtgcgtgtgtgggggtctgctgtgtgcatgtatgtggagtgcatgtgtgagtgtggatgtgttgtgtgtgtgcatatacattgtggatctgctgtatgtgtgtggtggtgcatgtgtgactgtgggtgtgtgtgtgcatgtgtgtgtggagtgcctctgtgtgtgtgggtgtgttgtgcgtgtgaacgtgtttgggtctgctgtgttcatgtatgtgtgagtgcctgggctagtgcaggtgtgttgtgtgtgtgcacataagcatgtgtctgttgtgtgcgtgtgtgtgactgcatgtgtgggtgtggggggggtcatgcagtgtgatcgcatgtgtgagtgtgttttgcgtgttcatgaatacacaaatattgtgtgtgtgcccatggctggcagtgggtgggcgggtgatggggcgtgcagagggatcccatccttccaggagacgtgacagggagccccctcccatccagcacgctcccctgaatgcacctgcgctgccaaaaggaggtaggggtggggagggctgtgccgtggccgcttggtgtacccttgtggcgggagggctgtgctgcggccactcggtgtgtgcttggggcggggagggctgtgccgtggccgctcggtgtgtgcttggggcgggagggagggctgtgctgcggccgctcggtgtgtgctcaggcgctgtgagcctgcagggcgccctcgcgcttcttcctctgcgcagcccctggtgttgcgttctgagctgaggcttcctaattgacgctgacggatgggctcagactcgagccgacagagccagctgagcggagcctgttaaaaatctcacttattaacccaagtcctctaccacactcctgtccctgtcagggccatgctgatgaggcatgggggtgagggctcactttggaagacccagcgccaaatgagcgcgtccctgggtgctggagctcccaggcagcagagccctgggcttccgaagggggctgcccaggccaccctgagcgggtgcaggtgggccactgtggacccaggcccagcaggtgtttggggggctggggccagtggtgtccacagggcagcttagtggcagaaatgaagaatcccacaggcacgtgggctgatggcctctgtcctgagaggaggctcagggtgcagatttcatgggtgcctgggcctggcctgtcctgagaggtggctcggggtgcagttgtcacgggtgcctgggcctggccttgctggtttcagaggaggggtgtgttgggcgagggctgctggaggagggcgggccagcttctcctgtttgtggctggagtgccatgtgcctggcacccaggaggttctccacacgtaattaatgaattaattaatcacaaaagcatttatgttttacattttctctaaaattaacatttaatcttcctaataattgcctgaggggtaaatactatattgtcttcatttggcacatgaggaaattaaattttagcatcccagggactcacacccagggccttggactccagtgcccctcatcactcagccacaggaggcaccagctgggggcctcggtgtcgtggcctctgcccttctggaagctgccacctgaactccttggctcaggccacgccctctcttgagacgtccctccccgtttcctgtcttcctcatcgttgaagatgtagcttgggcacctggcccccaagacatcttcccaaatgtccagattattgatccagctccccaatgaccccacccatctctgaggccacacagcccccgtgtcatttcccacgctttagaaaaaaccacccatctgtttctctgctgctagaccgcagcctccaccttccctccctatgaccaacacactgccggcatctaccacacacataccatacaccacacatgcacgggcacacacatacacatgcatgcaaacacacatgtgcacacactttcacatgaatgcacacacaccacacacctaccacacacaccacacatgcacatacacatatacacacactacacacacccacactgtacacacaacacacataccacatatgcacacaccacacacaccacacatgccacacatccacagacacaaacatatacatatatacacacaccgcacacatgccccacgcacaacacatatatcacacatgtacaaacaggcacacaccatgcacataacacacatatacaccatacatacacatcacacatgatacatacacacatctcactacacacaccacacaaacatcatgtgcactcaccacacacacgcaccacacacatacgctacacacacacaccaaacatgcacacatacacagacatgtacacatgcacacatcacacacgtctctcacacattacacatagacacacacgtgcatgcacacaggccacacggacacaccctctgcagggcagccagggctctccttggccccctcaccccattgatggccccggccgtagctccagatgctgctttgtgcaggtcgggtgtgtccctggtcgacaggtcctctcagatgcattctctcctcttttccctgaggacagatgtggtgtaatgtggtctttggccacctgaggacgtggggaggactggatgggatgaaacggtgccgtgatggtggctctggggtggctccggcagtggcaccatctgcctgatactcatgtgacctcagtgacctctcctttccccacagcctgctcctcattgtcttctcagctccctgttctcctgctgggaggcacagtcaaaaggggggtttgtcatggtttcctgtgacatgattcttcgtttgggggagcagcaacgtcttctccgaataagacacacagacccccagcgcaccagcaaaatgcagcagaagggaagcagagccagacgtgtgcaaaaccctctcctaagagcacaagtgaagggttttatgtgaaaggatttgggtttaaatcagagctgctggtgtgacgcgtaagcagcctggggaggagggacccgcggcgcccccggaacacagcgctcccatgccgacacccccggtgcacagcctccctccaccttgagcagcgagagggcccatcggcctccggggtgtcagcaaatggcccgagactggccggaggccagaggcatgtggtcggcagcccatctgcagtgccctggatgtggggacccctgttagagagaggtcttggggtgcccagccccgtaactaagatgggatattcctgagtaaagagaaaagaggaggagaaagggagggggatgctgcagggtctgtgcgaatccacatgtggggcaagagagggggccagggagccgcagtcccagcaaagcactcaacgccagggcagagggcagagggcagagggtagagggcagagtctcgcaccacccgcttccaaggatgtgccgaatgccagcctgcctgcttttctgagagcagagctcctgtctgagtgccagaggcctgtagactgcgggggcttcagtgcctgcccccgggcccctcctggagacaggcagtggacagtaaaaagaacactagggactttaaacacatccccgaaatcttaacaacttaacccaagaaagtttgtttctcactcatatccagtgcagcgtcctgaggtggagtgtggctctgctccgtgtggccactctgagatccaggctggctcggcctctgccagcccttggcttccaagcttgccctgccctagagctcgtggaggggaggaaagtgtgtggaaggtctccacagccagtttagggtggaacccatcactcattcaccctggggccgacccaggcccccgaccacaccgagcagcagagtctgcaaggcagcatggcccagggaggcggggcaggcacggggcagcagctggtctccacctcagagcacgctaggaggcgggaggcaggaggcgagccggcagggctggggggtctctgggctgcaattcatggaattctgtgtcttctcaggctgctgctgtgaacaagggtggagaaggagtgagtgtatttgtatatatgaggggagcatgtgttcacatgtacaccagcgagagggcgtgatctgtacgtgcatgagtgagagcacatcttcacatctgcacgagggtgacagtatgttcatatgagcacaagccagagagggcgtgtgctggggagtctgcaacatgcttacttgtgtgaatcttgccgcccagctctttctgaagcacagcgatgtctgcaacgtgtcaccgcctgagcgtgtgcagagtgtgcacagtgtgcactgcttagcctctgctttgtggcatgcatgtgtgctgctttacacacatgtgcgcgcgccccagctcatggcaggctgtaagggtggtctgtcccaggatctctacagcttctggtggcctccaacagtccttggatgtgggtggctctctccttcacgtcgacccccatgagtgcctgtctgcatccgaatgtccctttaaaaggatgccagcaacactggactagggccaactcccatgacgtcatctaaatgtgatcctctagaaagaccctatttccaaacaaggtcccagcacagagtctgggcccaggaccccagcaccctgagctcagcccactggctgggactccggctttcccacctcggcagcggtgcttctctaagtggctctacaggtaacaaaatgtcaggaaacaccacacaccagtcctgccttttgaccacactgatgcgcggaggcctaggcctggcaccctggagggcaaaggaccgaggaagaggccacggccatgggagggcgcaggcctgagcccacctgtggcccagccctcaggaggtgcacacagcctcagcctcccgtcctgcaaacggctggccctgctcttcccagcgtgcccagcgcctgcccacagcagcacccaggccaggtgaggacggtgaggctgaagggcgcagaatcttctgcagggaaaccggtcatgcaggcccagcagccggagcctgcttccacgtctccactgcctcccgcgctgctcccagaataaagactaggagggttcaggtgcagaggagagaaacgcagggccccgtgtggaaggtcagcctcaaagtcacctgaaatcaaacatcaccgtcaccatgcacgggtgaccacgtagctttggagaaacaaatatttaaagttgggtgagatttgcttccctccatctgggactcgtgcgcttctgtgcagaggcgccctctgcaaagtgtggacacctgaaacaggctgcctgcaaagctgctctgtgacaagaagccaattcaaagatgaaaagaagctcagtttttagaaacattttcaaataatggaatgagcctgtggatggggtgctggggccccatcactctgtgttcatttgggtttagagggatctccccgcttctcgcctccttgccatggtgaatcgtacattttgggcagagggtggcagatggccccatatgggattggagaagacgtggctccctgccccctcctgccccctcctgccccccgtctctcctccgtccctgtcctccctctgtcctgcccccgcctgtccccgtcctgccccgtcctgccccgtgtctctcctctgtccctgtcctgccccctcctgtcccctcctgttcccatcctgctcccgtcctgccccatgtcgagcgccagttctcctgtccttgtggcctccccacccttctccctgcccgtcaaacgctgaggaagccattgctgtcaggcggcaccgtggacgtggccttctccgggggagctctctgtggacacccacgtttccttcacgcgcacatccgttttatgatgtggagctttaaggacctgggaggaaatgggaggtttgcagttgtaaatggcgtcagcaggggcttcctcgcctgcctgtcaagatggaggccaagcccagggaggggttcctgagcagatggcaggagaaggcccttcgccgtgtcccccaggggctccgtgcaccaggcctcacctgcgcagcacggcagtgtgggtgtggcgaccactgcctcgcgtgggcacagtctcgcagctctgaagaggccattggggcagaacaatccccctcactctaaggagcaaactcctccaaagcaccacaaaccgcgacttgtgtcggggctctcacggcggggtccccggggtcaccagcagcatcacctggggaacaacgcaaatgcacgttcttgggcccagccctggctcagaagctctggctggccccgagctgttttacccgcgctccaggccattctgactcagggtccagatgaaaaccaccggggtaaggaatgcgtgctgtgtagacagccacacgcagggcagctggagcactcggggcagctgctaattaaaaagcaatgctcattcctcagtggacatctggaaaatacagcgatgcagtgaggaagaaatgcgactcccccggacccgcccagaggcagcaaaggcgcttatcattcgtgggcatcttgtcctctgatctttcttctgcgcatttgaactttcttttttatacgagtaggatcaccacattttgtacactaacaaagtttaacaaattgttagactttcccatgacattagggccttttccatttaacgagagctgcacatgctgttttggggacctgaatggcgtatcgaacccctgtccgcctctgactctggtctcccaccctcttccctccccaccgttccccgctgtccttggtctttgttgtcctagccacaccggcttcccagcactggctggactcacaccccacagcaggaggaccgggcagggtgaggggtcccaaaggtctgggcttaccactgaagttccacttctccaaccggcttgccctggccctgtcactgccttctctacggtcccacgcgctctggagatgcttgtctgtgggcccgggtggttggcttgggggaggctgccatgcgtgtggttttagcacggcacaggtctttgcagatacacggcacgtgtcacagtcatttgagcaccgtcctcctgtttgtcaccgagtcatctctttttaacagaagctcatccagaggctgtggtccgggtgaaattagggagcagcgtggaatgtgggtagggacttggcttagggacttctaaaccaagacgaaggcttctgggtttggaaggagggcgagttttccacatcctaaccccggtttgcacaacgctggtttccaaacggaattctcaacataccagccctgggctaccgctccgggaactcaacctccatttctgtgaagcccagctacccatctgtggtgggtcagacaggtgaaatcacgggcctccttggctatacgttaaatggaagttaaatggaaattggccagcacccggctaccaagggtgacaccggctgatgaaagatgcaccaaagcacagatgagccgtccattcatctctctcgcttacagctttctcagctgacatagagtttctggtctcctctgacaacttctttcttttcaccattaagaaaaactccaaataatttcaatttgcagctcattagcaccctatgcacagggagtgttgaaagagtttttctttttcctcttgatgaaagaagtccctggaactcaggacgccctcctcagaattctctcctttgttcttcccaccctcctccctcacctccctcatgccccaaagggagtggagtggaaagggaggaaagaaagacaaaaagcgaaacaggtgccccaggaagggcagcggaacccctcctcccacaaagccccttccctctgggcgtctctcccggcaagccccaagggtcccagcacgggaggaggacggcccctcggatctaatgagcggacctcacatccaaaaggggctgcgatgttggggtgcccctgccttggccagagcagacactgccctctgctcacctgtgtgcaccagagaacatggtcgagggatgccgggttgataaggggagcccggccaaaccctcagtcacatggagtccgcctgccctgaacctcctcatttctcactgcctgtcctcagagcgaggcttttttcactgagccatgtcttaagtcgagggtggtccttccctacttagacagcgaccccatcgccctatcacctgtcggagactcattcagcattggggatacagatggccttgtcctgagttccagggaccccaaaatgtataaaacagcctcagctttggtctagaccctaaaatccagagaagcaccctatgcaaagaggtgtgggtagaattggacccgctgtttggacctcgtcagatgaggggaggctgtcacagcgaggaagccactgcgtggagtctcggcacaggggccggcctgtggggagcatcagtctcccataagccgagtgctcatcaggttccccaagcttagcagcttggcagcatttattattgagcaagtatttcatgggctcacgcacgttcctgtgtgatgcctggtgctgaggacattaaatcctgtatatttggccagggttcttaggatttgggtgccagccctgggctatctcctgcccttaagcttagaaatctcaagacgttgaacacactcaggtacacagcactgtgccaacagccacgatggagaggagacgcatctacttcacgtggagatttggggtgaagtcattttgatactaaaacatacatgtgtgtgcatatatatatatatatatatatatataatagagtagattacaaaaatccatgagttttttttgttttatttttttgggtttttttttttgagatggagtctcgctctgtcatccaggctggggtatagtggtgcgatctccgctcactgcaagctccacctcccgggttcatgccattctcctgcctcagcctcccgagtagctgggactacaggtgcccgccaccacgcccggctaattttttgtgtttttagtagagatggggtttcactgtgttagccaggatggtctcgatctcctgacttcgtgatccgcctgccttggcctcccaaagtgctaggattacaggcatgagccacagcgccccgccccaaaaatccacgagtttttaagataacagatgaaacttcaaagacatctcctacctgctgctgaccctcagtgctcagtcttcagagcccccgatgtggctggggagggtctcatggaaaagcgtgagccctggggtgaggagcacagaccccagcagtcccgccgtccccgtggaaagcctgtgcccagcagtcctgccgtccttgtggagagcctgtgcccagcagtcccgccgtccccgtggagagccagcctccagcagtcccgccgtccccgtggagagccagcccccagaagtcccgccgtccccgtgaagagcccagcccccagcagtcccgccgttcccgtccccgtccccatggagagcccagcccccagcagtcccgccgtccccgtccctgtccccatggagagcccagcccccagcagtcccgccgtccccgtccccgtggagaacccagctcccagcagtcccgccgtccccatggagaccctgtgcccagcagccccgctgtccccgtggagagcctgtgcccagcagccccgccgtccccgtggagagcctgtgcccagcagtcccgccatcccgtggagagcctgtgcccagcacggcacctctagcccagcctggcatagcctcgtcaagttgcagagcccccagtgccagggcgcccgcctgtggaccccacacgtctagatcgctgctttgggatcacgggggatggtgcgctgcgaccatgatgtgttgtgaagttctgtgctcactgtccgcagcctttgcttaaacaacaacggttggctttatctgatgaaggtggaactgcagtgttctccacgtggccctcacatggctccgcagaagctcagggtgttgtgggccaggttcgcctccacccacttcagccagcaggggaagctcccctgtcctctctgccgagccctcgtgagttggacggtggccccggcttccagctccggcctggcggttccctgatctcctccccacgcaccctctgccatcagcctggtattttccatgacccattacagtcctgttccccgaacctgcctcctgttcaaggacagcaagtccatcccatgggcagggcccagcaggactgggccagtgagacggtttcctgtgaggatcctggggtcaaagtgccacaaactgggtggcttcaaaccacagaaatgaattgtctgacgggaccgcgggccggaagctggagatccaggtgttgtcagggccacgtgctcaggaagctctcgggcgactctctgtggctcctggcaatgccgggggctccttggcaggtagacgcctcactccgttccgtctccgtcctcggggcgtgtctgtgctgtctcttcttagaaggatgccggccgtactggataagggcctcatctttactaactccatccacagagaccctatgtccagaaggcggcattcactgtgctggtgttaggagttgaacgtgtctttttggggaaacggttctgctcgccacagtgccttggtgtcatctcatccaaccctgggcctacgcgggagctcacacggcgggggtggcgcggggctccttccacacctcgctcagggctgagccccctccagggccagagtcacagcctcctggctccacagcctcggtgtcatctcatccaaccctgggcctacgtgggagctcacacggcaggggtggtgccgggctccttccacacctcgctcagggctgagccccctccagggccagagtcacagcctcctggctccataaggcatctggcttgtcgcaacacgttcctctttggactgactcagctttcgaaaccttcttacttatcctaagcaacagtacccacaaaattcatgtttttgatgtactattttgctttttctcgtgcacattaaaataaagttttaaaaattgcccacattccacataaaagcaagtgacacagcacacttcgggaggtgctgcagggactgaacgtgtgcattaaaataaagttttaagaactgcccacattccacataaaagcaagtgacacaccacacttcgggaggtgctgcagggactgaccatgtgaaatgtgaatcgtccaaggcaacaactgaatcttatagatgcttaatccaaaagagtgttttcaacaaggtcaattccaggcccagggtttgtccaggacagcggtccatactctttttggcaccagggacctgttccatggaagacggtttttccatggaccaaggttgggggaaggtttcaggatgattcaaacgcattacatttactgtgcacttaatttgtgttattattacattgtaatatataattaaataattataaaacccaccatcatgtagaatcagtgggtgccctgagcttgttttcctgcaactggctggtcccatctgggggtgatgggagacagtgacagatcatcaggcattagattttcataaggagcgtgcaacctggatccctcacatgcacagttcacaacagggctcaagctcctatgagaatctgatgccactgctgagctgacaggaggtggagcccaggcagtactgtgagccatggggactggctataaataccgacaaagtttcactcgctcactcacccgccactcacccgcttacctgccactcacgtactcactcacccaccactcaccggccactcaacagctcactctcccgccactcacccactcacctacctgccactcacctgctcactcacccaccactcaccggccactcaacagctcactcacccaccactcacctcctgctgtgcaccccagttcctaacaggccacagactggtgtcagtccgtggcccagaggctggggatgcctggtccagtgggaagacatgggtgggagatctgggatgcccatggacttttacagagtgtgagtttgggggcaaacacacttggagttggacctcagctctgctgctcactagccaatgatctcagctcacagtgcttaatgttctaagcctcagttttctcatctgtaaagtgggaatcatagcagcagttctcagggatttggtagggtaacccacgtaaacatccatcccagagcctgacgtgccatgagaggctccacagacactggatctcagcttctgccctggaaggaagccactgtccccagaaccacttccgggccagagtgaaggcagctggacagcaggaggccaggcatttgcaggggcggtgcctagtctctgcagctgacagctgtatggaaccctgcagtgttcagtacaaagctccaggatgtgaaggatttgtcagctctcaggcatgcagccctgccctcaccctcctgtgatgaattgggccaggcaaacagtagaaataggagcagtcccctggctgtgcagaaaggcatctgcccactgggctcctgcttgtcccaaggaacacctcttccctccccatggccccaggtctgaggctccatcctcctgggaccagaggagacatctgggccctgtggagtcctaaaccttggccacagcatgacaagggcagggagtgctattcctgctctctgaacccacactcgttctggctgccatgtgtgtgcagcaccatctctccaagcagccgtcttgtggcttccccatccaatgggccgggatttccttgtaatcagccaggaagcattcctactctgtctgccccaacccatctcaagagggcacggaaagggctgggcacctgcaagctgacaaaccccattgttgtgggaacatatgtgttctcgggcacagttccctggtggtacaaaccgttcacctacagctttgccagctacatcggaagggccccatttctgcctctcctcccagaagatcatgtcaaagacaccagcctggccaaacctagcagagaactgagggcccagtctggggaagaatcagctttctgctagaaggaggtgggccctgaggggagcagaggctctccctggaacagaggagctgatgctcagaggggagcccagggcagcccctgagcttggtgctgctgaggtgcaggtctgatgggatagaggctgtgcatgcagaggagagcgggaagctgggcccatgccagtggccctccaagtactcactttgttcatgcagaccaccgggccgtggtctgcctggactgagggggttctcagtgcctcaacccagatagctctgagaaactggcaggccacggaaatcatcctggcctcctcagaaagatccaatagttcccaataatcctgccagtaagaatgcagagacagaagatgtacacacacacacacatacatgcgtatgcacatacacatgcatatatctttatgggcacacagatgtacacgcatatacatgtatacacacatatgcatctatgtatacatacatacacacatatacacgtatatgcatctattgcacacatttacacctgcacatatacatatataccagacatctatagacacatatgcacacatacatgcacacatatacatatatacagatacatctgtatgtacatatgtgcatatttttgtacacatgcatgaatacatatgtagatatacatatatacacatatatacatgcacctacaggttgagcatcccagatctaaaacccaaaatgcccccaaatcgaaaactttttgagcataggcctgaccctaaaggaaaatgctgatttggagcatcttggatttcagatttttgtatttgggatgctcaaccagtaagtgtgatgtaaatattctaaaatgcaaaatttgagacacttctggttccaatcacttcagataaggaatggtcgacctttatatatattacacacacacacatttttgtggcttgtgatagtctgctctctactgtgtgcacatcttcccacacctcttcacaaagaggctaagtgggcctttcaggtgcactcagcatcagcagctggcacaaaaccacctgggccgtcacccagccggtgcacacacagccacggtgtgtgtggagaagcaccagaccccatcgctaacgcagaacaggacagggctggccccaagcactcgggtccctcctgcctcagaacaaagccaggctcacacagacactccatgtccccaaggtgggggctcctggggcctctggctgtgtctctctcccttttgaattgcttctgttctgctttgcaaaacactgcctggtcttattattgaagttactttcttgggtttattaagattcttcttttactcaaatattgaccaaggcctgccctgcccccaccgcttaactggcaaacaggctgtggagccataacctgacactagacataacgacacaacgttaatgactttaaacaaccgggagtttacgtcgaatacatgttctatgtgtctaattttcacccctggtgctcatttaaattcttcgcatgttttaaaaatttatgtcttccttttcccatctccctgaattttactccagcctaatttataagaaaaatgtgctttgaacttttaactaggatgctggagaacaagccacctttcattcctgatgagctgcgatcttttcccttttcttcagaccttcagttgatgatgtatttgcacacgcacacacacacacacacacacacacacaggagtatatatattttttctatgcttcttaaagaaacaacaagtccttttaaaacacctttcaaatgcacagtataagaagcactgtgggggagaggaacagagactcccagagaaggagtttccttaatgcttactggaatttgctattttcttcttttcatggaaaatgtgtctgagagcaccagtacagctattatctgtatcctgtggcctttgtgggtatttccaggcagagagaggactgagtctagtgtgcagagcggcactcccaccccacgctgaggcagcgcatccctctgagagctcaggggcagcaagggcagtgagggcactgcatggcgagagggtaacctggatcacaccaatgtgggatgcttgttgccaggctccacacacagtggataaaaccagccttctctcgtgagtgaggcctagacctgcagggtgggaagaggcaggactgggagaaggggggctgggaggaagatgacatcggatctgtctgcagaaatcatctgtcaagagtcagaaggtgtcagatcttgctgaatggtgggtgggtggtctctgcatcacctactggtcacccagtagggcgagaagggtcagaggggagactgtgtgcatgtgtgtgcaagtgtgtgtatgtgtgtgcacgcgtgggtcctcaccttatgtgtcacccctcatctagagctatttggctgggaccttggcattctctggagcagctgcagttacagaatggaagctccgtgcacagtctagaatcatctagagctttttggctgggaccttggcattctctggagcagctgcatggttacagaatggaagctccgtgcacagacactggagttgttcaccactgcagtccctagaacttggtctgacatatcatgagtgctcagcaggtacacaacgaatgaagaagtgtgtggaaagaagggaaggcagtcctcacagacatggaagaaaaattcccagccttagcaaattgtttcatgaagtaggaggttaatcctctctgatattaagagctaataagcattcttaagagctgtatgccaccaaactatgacttcgcgggggcattgggtaaacaggcccctccacacccggtgaggaattagatgctacgaaataagggcttgcgcctgtttcttaaggaatcccttactgtgcaatttttaaatttcccataagatcctctttaattttaacttctaaatataataaggatacatcaatattatctactcttgcatatgtttctactaaataatttcaatagtttttcttgaggaacttttagaaaatgtttattatttcactgtctagggaaaatgttagcaatgaagaaattacaccaaaaagaaaagttgacatattttgccatcatgaaaaacctgcccagagctccacaaaaaatcatgcaacagttcccaattccaaaatatattacaaagctatggttattaaaacaatacactactggcataaaaacagacttatagatcaatggaacagagagtccagaaacaactcatacactgccaagtgctccttcataagcatgaggagaatacaccatagggaagggtcgcctcttcacaggtgctggggaaactggatgtccacatgcaaaagaacggcatcggaccctcacctcacatccacaaaaacccactcaacatgggctaaagactgagacataagactggaaaccataaacgtactagaagaaaacacgggggaagcatgatgacattcatctaggcaaaggtttcttggatctgacaccaaaggcacaagcaacagaagcaaatgtgaacatgcaggacaacatcaaaccagtgagctcctgcatcagcagggaaacaatcagcaaatccagagggcagcccacgaaaggtagggtgagtggtgggtgtgtggtctctgcatcccctactggtcaccggggaggaaatatttgcataccacataacggataaggagttaatatttaaaatgtataggtggctgggtgtggtggctcacacctataatcccagcactttgggaggcaaaggtgggtggatcacttaaggtcaggagttcgagaccagcctggctaacatggcaaaaccctgtctctactaaaaatacaaaaattagctgggtgtgatggcgggcacccgtaatcccagctacttgggaggctgaggcaggagaatcacttgaatctgggaggtggaggttgcagtgagccgagatggtgccactgcattccagcctggatgacagagcaagactccatctccaaaaagtaataataataaaataaaatgtatagggacttcctacaattcaatagcaaataataatgataacctgatttaaaaatgggcaaaggactttagtagacatttctccaaagaaggcatacaaatggccaacacactgtacatggaaagatgctcaacatcactaatgatcaggaacatgcaaatcagagccacgatgagatacgtctctgtacccatcaggaggctgtgaccaaaaagacgtgtgttggtgaggatgtgtagactctgaacacttacatgctgttggtgggaatataaatggtgcaaccattatggaaaacagtatgaagttttctcaaaaaattaaaaatagagccaccatatgattcagcaatcccacttccagatatttatccaaaggaagttaaatcaggacctcgaagtgacgggtgcgctccggagttcatcacggcattgttcacaggagccaagacatggaagcacatgtcccccagggacgagcgggcaggaaagcgtggtgcatagacccagtgggtgctcttcagccttaagacaagacggacaacctgccatctgcaacaacagggataaacctgcatgacatgacgtgaagtgaaacaaaagccaggcccaggacagaggctgcacgacgtcgctgaagcgtggaatctatgacaattgaacgcaccgaagaagagaggaggatggaggctgccgggtctggcgctgggggaagcacgggaaggggccgttccaagggcacaaggtttcagcgacgcggcctcaacgcggtctcgacatctgccgtacggttgagagccaacagtaccacgctgcacactcagggaagtgtcaacacggtgggcctcgctacacgttcttagcacacggaagtgaagtcccatgaaggaagcggagtcggagagggacgccggggcgggtttcacggtggacgaaggagctgcacgccgagaagtccagccaggtgccacaagccagaaaaggtcaggagccgccccagagcgtgcggcccacccaagccctgacttcagctcagtgaaacccatctggaccgtggcctcctgtgagagaataaatctgtgttgttttcctgcaggtttctgataagccacgtgtgttttgggggagacacaggaagccaaggaccaagcactttctgtgcggccgttctgttcttccactaagcgggcgttttccttcccagaaccctcggtggaggcattcagcagccgcctctcctgtgaatttttcttaaatatcatttggcaataaatcatagcgtgcccatcaaatttttccctagagaaaattattatttttaggcctttaaaacatttgctctttccttcttctaagatgatgtttgttttcatgcaggctaagatgtttttacctatactctatcacccacagatttctcaacccagtggggcagaaatggggatttgtgctgtttcatatggaatttgacattaaaaaaatccatgcagctgctctcacggggaggataatatcccccgcacctgggttaacgcagcactctcgtgatgcagagcctctccgtgaataaataaacctcgacagctctttctggagacggcaaagcagtgctccgtggatgaggccgttcatcctgcctcaccgccgttgctcctaacaggggtcgagagactgatctcgaaggcagcgctaagcggaaggcctgatactttcagcgtcggttcagtttctggtctggcgtaacttgcaccgtgtagcggaatcagatgagaggcacaagacgcattgtgacaccacataagcaccacaaagagaaagctgtggattgggtattgggtattcatatatatgtgcatatatatatgtgtgtgtgtgtgtatatatatgtgtatatatatgtgtatatatgtgtatatatatgtgtatatatatgtgtgtgtatatgtatatgtgtgtatatatatgtgtgtgtatatatatatatgtatatatatattttttttgaaacggagtctctctctgttgcccaggctggagtgcagtggtgcgatctcggctcactgcaagctccgcctcccgggttcacgccattctcctgcctcagcctcctgagtagctgggactacaggtgcccgccaccacacccggctggttttttgtatttttagtagagacggggtttcaccgtgttggccaggatggtctcgatctcctgacctcgtgatccgcccgcctcggcctcccaaagtgctgggattacaggcctgagccaccgcacccggcaggtattcatattttaaaagttaaaaaaagcaaagaacctctttctttctctaataagatgttgattaaattttaagtgaacaaggtacaagaggtgaaaacacaacatctatttccacagaacgtccgtacgagggtgttcccaggaggaggagtgcggcggcctgggaggcacatggatgccgagtctttggatcagcagagggtcgttgagtcgctttgaggggccagacactgttgtaggagctgggagcgcagcggggaagcacgctaggggtccccttgtcgcggagaagggacaggcactatagtgaccgggtaatttctagtaaggtgtgatgtgaagaaaggagaagagggcacagtgatggaaggtggggctaagcagaggcctctgagcgttaggacgagaagaagcccagcctggaaagaccccggggagaaacacagaggccacgcaggctggctgtggtgcctctgagggatggaggagggcatctgtggtacctctgagggatggggaggccgcctgtggtgcctctgagggatggaggaggccgcctgtggtgcctcagggatggaggaggctgcctgtggtacctctaagggatgggggaggccggctgtggtgcctctgagggacagaggaggctgcctgtggtgcctctgaggtatgggggaggccggctgtggtacctctgagggacaaaggaggccggctgtggtgcctctgagggatggagggggccggctgtggtgcctctgagggatggagggggccggctgtggtgcctctgagggatggagggggccggctgtggtgcctctgagggatggagggggccggctgtggtgcctctgagggacggggtaggccgattgtggtgactctgagggatggagggggccggctcgggaggtggttcgtgatgccgtgtgttgaaggctgtggatcttgtccttggtgggtgcaaagccagcagacatttccagagggagagggatgtgacttaaattgtgacttagaaagttcactccacgctcagaacactgggcctgaggagcacacgctggagtggaggccctgggccagtcggaggggcagtgtgcgagtcagatgagggacccgcacatggagctggggcaggacctgctgtaggtcccaaggtgaggagggagccctgggctgggtctgctctggtggggaaaatgaaatgtctgcttggccaagttacactggggcctgcagtggagacgttgagtaagtggctagaggaacacacgttcagcgtggggaggtctcacggcaagagatggcgatgtggggtctttggagcctggggagagatgaaggccaggccagcccggatccgaggctgacagcagagagcagggctgctgaagcctcggtgcagggagggcccgttgccctcagcatccctgtccagcacctcccacccacgctccagcctcacccagcccttcctccccacgagcacacagcgtgctcctgctcctgctggccccaccccgatggtgggccaggcccagctgcaaccactacctctctgacccgatggggttgtcatgtctgaagggcttgccacgttattcagtcacatttaggggccaaatctagaagttggagaagaaaggaggagggggcagcaccctagtcacaggggtggtattgaagatggcacgggggtctcctctcctgctgccttcctgggagagggactggagggcacaggtgctgagaagaagtggagtccctgagtggagccgatgggatgtggaggaaggcctgaggagccggtgggacgcccaccctgccccaccccaccccacagcaccagcatctgctgattgagtttaaatatcaacggttcaatgtgtagagccatctgtaatacttttagccccagattctttcacatcaataggcaaaaaagaggtaattaataaaacgaacataaagttctaattatagggtgtaaatatcgctctcaggagaattattaagatgaaggatgggttttgtgattaggagaagaaaataacctgcccaggggaatggaaaggaggcagacattctcagaccagaagcgacgtgtgtgtgtgtgtccgtgtgtgtccatgtgtgtgtctgtgtgtgtccgtgtgtgtctgtgtgtgtggaggggccactgctaacgactgtacagccaaatgggagaaatggccggtctgttactgatgcaaacaagaaagccagcatggtgacaaaatatttagcatggggacaaaggtcacagaggcatccttgtcatctcccagaggtgacaaatcacaggttcgtctcagaggcaatttcacattccaaaaggtagagaaataattcttttctatttttatttttatttatttttttaggactgagtctcgctctgtcaccgaggctggagtgcagtggcacgatctcagctcactgcaacctccgcctcccaggttcaaacgattctcctgcctcagtctcccgagcagcttggattacaggcgtgcgccaccacacccagctaatttttgtatttttagtagagacgggatttcaccatattggacagactggtctcgaactcctgacctcaggtgatccacccgcctcagcctcccaaagtgccgggattacaggcatgagccacgacgcctggcccagagaaataatcgttaaagaaatgtaggaagacagacctggggtcaaaggaaagatgagcatagtccccagtcctccagcttgagagctgcggggcctctggaggttcagaggggtctcaggaatgggctcagaattcaagactacaaaggatgctaaagacaaagattcaggctccaaagaaaggaaggaggacacataggaaaatgtaactgacaggtgcacacccagcctggcccaacgcagcccctcaccatggtctcagggctcagggagctcctggaatgcaagcttcgcgttgaaggatcccacaggcctgcagggcagctctctggccaggccctgccaccgagtggtacgtcccacagcacacccaggagcctgtggccgcctcccgtccgggccttggaattccttttggctgacagtctttgcctgtgtgaccctcacgggatgcctcccacgacctcagcctgtgaccctcacgggatgcctcccacgacctcagcccataagcatccctgtggccagcttgtgtaacctgccaggcaggaggctgggatgaaattctcacttgccacaccttgtaaatatcaggtgtaaatatcaccctcaggagaattaagatgagcgatgggatgtcctgcaggcccagcaacaaggccggactctcctccgcttcatgagaaaatgtgtgttgtcatcagatagcctttggggctgcctgggtgcagattcgaggctacctacttctcatttcacgttggaggtttcacggatcctacatattgcagagaaacctgaggtccgtttttggttttgctttatagtgataaatccgggatgacacagccgtgggccgtgttgagggctgggatttcggtgcagttgaatccccggctgtggccccagtgcccgttcatgggcccctcccgtgtgattctcccagctgagccgtgagttcgtctgagcggcgagtcggaactcgaggcagatcactctttgctgttgagatggttggatcagtgtgccccaaaatctcctgtcgaaccgtaatccccagtgttgggtgtggggcctggggggtggtgactggacttgggggtgatttttgaatggttttgcaccaccctctccttgctgttctcatgatagtgagttttctgagacccgtgtgtttaaacctgggtagcccctcccaccttgcgcctacgcccaccgtgggacgagattgcttccctttcgccttccaccgtgactggaagctccctgaggcctccccagaagcagaagctgccgtgctccctgtgcaacctgcagagctctgagccgattaagcctctttcctagaatcatccagtctcaggtgtttctttgtagccatggagaatggactaataccactgtcaaagatggtccaagtttgtttcctctctccaaccagatttttaacgtttccttctcttctctgcgcctttcccagtgatgaggacagtggcttccatgggcaggcgttcagtaaacagcacccagtgaactcagagctgccagtttaccccgcaggggcagcagagctgactaggattgggtgtagatgagctcagagcccacaaggccccacagggatgtcaccatcccggtaaaatgtgagattcgggaatgaataggaaaatcatgtgcttagtgcacgtaacatcagcagttgggaaagttcaccgggaaagaaaagcgccacaagtcctcgcatcaatacttgcagagacaaaataacctcaaggccgatctttcatgcctgtgcctgggcatccccgcgtctctaaggaggacagttatgtaatttagatggaaaattgacaggactgggcaggtccctctgattgatgtggaggccgtatctcacgtcctggaacgcgtgtgtttatttgctgtttcacggggcgggccatttttctccagccaggaagggtaggggtgtgcaccatagggcctctcccaagttcgcctcggcgcctgcccccctccatcacggtgatcaggtgtggccttagccccaggtttctgagggcgtcagcatcacatgtgtttgttctgcttcatgggctccctccgtcaggcaggtcagggtgtgacatgcaccccttggtgaccgatgggctggctgggtctcacagaaggtacaccaggtgagctgccaggtgccacctcctccacctcccgcctcccgcctcgtccacaggctcaggaaccctctggggatgagcacaagcactttcttttgaaaacgcctccatggcggaagttccttggttggggaggactttgttgttatcaatagcttgaaaatgaatcaagttccctgaataaacatgaggtcaacctcagcaacgttagtttgggcaaatgtcagagcaagcacagaaagtggctggaaggactttctcatgcgacttgtaaataaatgactgccgagtacagaactccaagggccacagatagacagcaccttgggaagaggttgagagttaaagagcagtggttcccagcctcagccccctggggagggtgagcaaacagacggtgctgaggccccatgtggagtcggagattttgcaggctgtggctggggcccagctttgctgcagctcctgggggcctcccaggtgcataggtgaggggcttttagtttgagcaccctccctcctgccaaagtgccccctagatgcacaggtgagggggctttgagcttgagtccccctcccaggtgccacccaggtgcacaggtgaggggcttttagcttgagccccccccgcccccgaccccgccgaagtgcctcctagatgcacaggtgagggggctttgagcttgagccccaggagcctcccaggtgcacaggtgaggggcttcaagcttgacacccccaccccatccccaggtgcctcccaggtgcacaggtgaggggctgcgacgcacagggatccatgtcttagaggaagtttcaatactttataattgcatccccgctaagtgagggaagcactctggcctctttcacatggaaatccctcctctctgaggaccgaggtgatgtgctttagcatgacaatgagtgcaggcagatatgaagtattttgtgatttaaattttgcttgtgatatttcaaagaggtttcctctggaaaaggttactgggagagaaggtagctcactgttctgctggtgagctgtctccacaactccacacatttatcgtggtttcaggctgggtgtcttcaggctccttgagctgctttgcagtaagtgacacaataaaaaatgtaaaatacagaaggcacccacttttcccacttacggttttagtgggtgttcacagaggcgatgaagaaatgaaatccccacatttaaacaaagcggagagtgacagtgagggtgatagtcctattgtataattgcctcctttgactcagagagggagagcctattttcatacttatccgaaagcagtgaagcttcaaagaataggggcagacacaatgggctttcagagggaagctgccatcgtcgacgctataattggtcaccgcactgcccgagtgcccgtaggccggccagacgcagaaccggaagtgcaggcagcctgggtggagcagggaggtgtgagcccgggtcagagcagagaacgaggggaggtgtgagcccgggtcggagcagagaacgaggggaggtgtgagcccgggtcggagcagagaacgaggggaggtgtgagcccgggtcggaggtgtgatcccgggtcagggcagagaacgaggagaggtgcgagcccgggtcagagcagagaacgaggggaggtgcgagcccgggtcagagcagagaatgaggggcgagacacaggcggccccctcccggccacctgggccccgagcttgtcctgggcccctcgaggtgtgctgccgaggcccgaaggtggcctggagggtggggacccgggaaggggctgtggggccctcagcgtggcctcagaaacaccgaaagccttgacctcagacctggctctggcagagagggggccgagggaggcaggtcagccctggggtccctgcaaggcggaggaggcaaaggaggaaattgacttctgcctggaggtcaggagattactgcttctaagccatgggaggagaaggggacagaaacacccctgtgtggtgccaggggtgccacgaattatgccattcaggcctccagtggatctatacgtggccctgggggacggtgtctcctagaggctccgagctgctgacaggacacttaaaacccagagaagccaacgtgttttccacgtgtggcagaactcaccattgctcctgacagccggagggcgagcatgtgagaatcccacgtgggaatgaaccacgagcatccacccatcccaccccggaagaggcaccacgccccgcccttgcccccaccccagggtgaagccacgggccctggaggcccctcagatcctttcctcccccaatttctgtgattctacttataatttgaacaattcaagggtcaaactccacctctagaaacgtgcatactcacagggtacacagggggtccacagagcaccccaaaatgtaaaggttatcaccgccgcgagggtcatctgtgacatggagaccaacctctgccatctcacgtaatgaaacacctttagaaaaccttacaatttttgttcatctgccacattcttttcagcagaaactgtgtttgctctgcagagggaacagcaggggactctcggctgggtgcctgtgcctgagcccgtcctgggcagctccaggccctcattctcccgaccacaaccgcagctgcagatgcagctgcgcccccttcctctccccgggcacagcgcattgtagaggggtcccattaattctgaaaaaaagccttacaagatagatagaaaatttatctcatttatttaagctcatcactgctgattaatcccaaactggggtcccttgcctccactttagaaaaagagatgagttttaaactcggcacccgcggccctgggagattgatccgcccggtcatgctttgaagttgaagcgcagtgcccatcgattgcacacattaaatgaccagccacgctgtagaacgtacagctcatgaataagaagtacccaagccctcctagtcactggaaagcctcaggtccagccatcacggggcagcctccgggtggcccatctgcgggctgtaggagcagagacccccggccccagcctgggcagacgtctgtcgtgcagtgtggccagcggacaagcctgctttcctcattcgcttacaaggtgttctgtgagcacccagcttccccaaggtcctactgagttgcttgggacactggggagcaggcaaagacgactagcagatgccctggacgtgcaggagccgtgccatgtgggatccccacccccgaaaacacaccctcgagctgaaggcagctggtgctgggacgcggagacctcggctgagctccctgggggtggagatgggcttctctccactgctggctaatgtccgccagagccacagcaaagaggggacccaggagaggtggccccggggagctgaaactcagggagatggcccagggctgggctggcctgagtatagcaagtacgctgcacaccaggcgcagatgccccgctgcgggcgcctggcctctcccgcggcttgctggctcagtgcgggctgcaggtcagaggccacaccttgcagaaggcagatgggaacgcgagccccaccccatgaggcagctcaagatgatctgtaagagtcactcgattgagcggcatgaacggggagggggcttcataaggccagagagttccaggcaggggccacttcgcccaactttgacaaactggcagtgtgacccccagaggggaaggacaggctctccgggcaaaggggactcctccatgacaggctggttttattttatcgaagcacttcgtggaggcctggtcggcaggaaaagccgcacatattttccgtacatatcttcaggattttggggatccgcgtgcgcccctctgatctgccctcttgggtgcgctccgagcgtgctgcacggcgttgctggctgtaggtgcgataccctccaggtcctcaggaaacatggtctgtaccagaaacctcctaggagaacgctttgtgtttgtgacataacaaatgtaagcatttttgatgttcaaagtcctctctcaaactttttttgttgccaagtgaatgtaaaatccagaggatgctcttggtcgagagggtgactaggagacgtgtggatgaagccccagagcccctccgctctcaccaccctgagtagggcaggtgggtgcagggagggggggcgggtgcagggagggggggcaggtgggtgcagggagcgggggcgggtgcagggaggacaggcaggctggcgccaggcaggcgtgtggaggcgggacccgggcacatacatgcatccgcctgcaccagtcccgacctcagagccaagcccagcggccgctccgcttcccaagcacgtaaaacacgccaggcacgagaatatgtggacgcgggcgcttatttcttgttgaattttgttctgttctgttttcaaacatggaatcgggtgttgcatcgtgttccatgatttgctgaaaatacttaacaaatacgaaactgtggaatatcttttcttatcacagcaaatggacgtatctcattcttcttagtcacataaaatatttaaataccctccgcgagagcttgtttgccactcatttatttgctgttgcaggcgatgccagagtgactgttctcatacacatacatgcacttatgctataattcttatcaattagattataagaaacgggattttttttgctcataaagtatgtgcatttttattgccaaattactttccaaaaaggctttatcagtttgcatgtgcaacagcagtatattaaaaaaagttattaaaccttttaacgtttaccaatgtgatggtgttaacttttgattttttaatcattacagaacggaatgtctttcatgtacttatgtcttcccctgagcttcacccgagcagagaaaatgctcctggaccctgtttcctcaccaagttgtaggagctatttgtctataggaaatagcaaacttttaatacttctggattaaaaaaaatagcttaggttttgtgacaacttgaacccaagattaaaaagtattttatattttcttctaattatcttatggtaaattgtttattatttagattttgacctatctgactttttaatattggaatctcacttcattttcttacacaatttcccacttgtgtttatcgggtggattttttctgtacccacgggtttgaaatgcccccttcgtcatacactccaggcccttgtgttgtcacgttcattcctagaccatctgttttgtactactggtctgaacgctgatcttcacgcaaaacacgatttaatacctgcaggagcgcccggtctccttcctgtgcccccagattgcttgacagttcctgagcatgtactccaggacctgaacccaaaccacctttagaaccaagttaatgacatcctgccacccccgcaccacacacacacaccaccatacacacaccacacacattcacaccacacaaacaccacacacacacccccaccacagacacacacacacaccaccatacacacacgtcaccaccccacgcaccacacacacacaccaccatacacacaccacacacaccacattcacaccacacacacccccaccacacacacaccacacacacaccaccatacacacatgtcaccaccacacacaccacacacacacaccacacattcacaccacacaaacaccacacacacccccaccacacacacattcacaccacacaaacaccacacacacccccaccacacacacaccaccatacgcacatgtcaccaccacacacacaccacataccatacacacacaacataccacacacacagcaccacacataccacacacatacctgcacacatactacacacaccacatacacatcacaccacatatactacacacacaaacataccacatactacacacatcacacacacaccacacacataccatatacacacacaccacacatataccccacacacaccacacatgtaccccacagacacacacaccataccacacacaccacacacacatacccccacacacatacatgcacacataccacacacacatatcacacccacatttcacaccacacaccacatacacacacactgtcaaaggctggggacctcaggggaccacggagccacctggtgtgtggctgaattcccttgttgtcaggtaacacttttgaagagaagcccaggccgccccttttctctccggcagagacctgaccctggaggcctcccacgagcctcctgagagctgaatttctgaggctcatgaagcccgaaacccagtctctctgaccttgtacaagatgtctgtgcccagggggcctggatgtcccagggtgggtctggctgccccgggaccaccaggagggaacgtgcccaacaggcagcttagaaacagtagaagccagcggcaccgggcggggagcttctcgagggagcggagagtacaaggcccagccagttttgttgtgttgctttcaaagtgtccttcaaaggtgaaccaaattcatcccggaagcatctgacttcatctgtcaccaaagaggaccagcccgccggaagacagtgatttcccccatcaggtgtgggcattacctaaagttgctgacctcctagaatttttgtgacgctctctaattctagcaatttagctcaaatcctaccattctgactgtcctgtagtgactgttacggtgacagcttgggaaatggaggcaggaaggggcgtgagctccgttccttggggaaggtgtgggtttcgcctctgtgagaaaggagatggctccagggagctatccccagcattggagaggtggttccagcggcctccagcatagcagagatgtggccccggctgcctcccacatggcagagaagtgggccggcagcctcacgtgtggcagagggctggccccagaagcctcccctatggcggagatgtggcccccgaggcctcccgcgtggcagtggggtggccccggaggcctcctgcatggcagttgggtggccccagaggccttcagagcacacatcttccccgcatagcccagcagggctgcatgcctgggagctgggctccatgtggcttctcatggtgggaaatctgccttctaggcccttcctaggggtgacgactaagaggtcgtgggggactctttggagcttggggactgctccagccccgtggaggcctgtggagagctcctccctaaaccaggatgggttctggtcacgttggttgatggcacacttctcccagggtctccagacagcagtgtcttgccaaggaggctgaaagcttcctgtactttcttttttttttttttttttgagatggagtctcattctgtttcccaggctggagtgcagtggtgcaatctcagctcactgcaacctccgcctcccaggttcaagtgaatctcctgcctcagcctccccagtagctgggactacaggctcatgctaccacacctggctacttttttgtacttttagtagagacggagtttcaccatgttagccgggatgatctcgatctcctgacctcgtgatccgcccgcctcagcctcccaaagtgctgggattacaggcatgagccaccgcgcccagcctcttccctgctttttactggttcttctcttctttggcagaactctgtttgaacactgggatttgcgaatggcagagaggctgggtctggcttgtgtcggcctccaggccccggctgcgtggttcccaggggacccggtgctggctccccattgtccagacctccaggcctgtcagtgtcttggggacgtcgatgttgccagcagcttttatccactgggggtgcagaggtgtgagggagatgccaagaggggaacagcccaccccagcccttggcagcttggacggggcccccaggtgcctcccccagccatgagcacaaatgaagtccgagggaaagatggggctgggctcacccagccaccaccccaggggacccagatggcaccagctcaaacaccaccccgtctcccacagagcaggtgttcagggtgtcccagggaggccccggtcagtgtgaaatgcatgtccttgtcctccaggtcacggccactctcctctgcctctctctctgtggggtcgcctacaagacatgaaggacaaggagagaagcaggacgtgaggcccaggggctctcctggccccctagactgtggggaagccccctgcccgccctgcccactggggtgacccaggcacagcaacagctgggagtccacgcgccccccaggcccaccggctgctgcgccagactttctatggcatcttcagatgtcactcccagcagaggccagaccccctcctgtcgcagtttccatcaaggtggggcctggaggccacggatgagcccccttgctcacctgatccccgacaccccagaggggttgtgggcatccactggcacgcgggggtcataagtggcatccaagtgggtttcccacgaattgcttccagaagagccagtcccgggcagccacccccgcgtcccccgccgcacccgcgtccgcctcccgggcagccacccccgcgtcccccgccgcacccgcgtccgcctcccgggcagccacccccgcgtcccccgccgcacccgcgtccgcctcccgggcagccacccccgcgtcccccgccgcacctgtgtccgcctcctgcccctcaagctgtcccaggctcagtggcttcctcaggccatgggacctacagctgacactggcactctgtgtgcggtggtgcagacagcactgtgggatgtgccagagctgctccctgcacttcccacagtgggcactgagctctgggcactgggcaggcaaggccaaagccgctggaatgtgccacccacctgatgatgaaaccacagcaggctgaggttctgtgagtcttacgcgtttttaaatgtggctgtttctcttctaaatgttaccgctgccacatgaattcatgtttccaaacacattgcaatgagagggtgctttctgcacggatgtggcctggtgtggccctcaccggcagcgcctcaccgtcctctatctctggggaccatagtgaggctcctgagagtgggagcgagcccggtcctcaccccgtcaccaactacctggggacagccactctgtgcttccagcctcaagggactcacgctgtggacaagcccagtttccagtgccatccacagctgggacagtgcccaggagtgctttgtgaatgggacgaagatcacagcaaatgagcccacctctgggggcttttcccagaagtacaataaataatcttccttcttagacttcatggtccttaaactttataacaattcagatacttaggcagtttttcaaaacatgttgatttaaataaatactgaactagcactaaatgctggtgagaaaaccagcaagactaaagccaggatacgtgaacggtacctgtggggccctaggtgctagtcctggttaatattacctgtgccgttccccgtgtggtttgtgtgagcagggagaaccccacgcagggctggcccgagggcctgggatccaccccacagcaaaagcgctcagccagctgaagcccttggcgcgcactcggagtgcggctaacgctcgtgccccacagggggcagaggaggccaaacagcaggggcctggcacttgcacgggaccatctctcctgggagcagcagcacccagagccggcccagggggtccctgcagccatccccacccggccctcccaccctgctacccaggtgagcaggctggtgaacacgcacacaaaaaaaaccagtgattatgaactccaggaaaacctccgctgttgtgcagaagggaaaacgcaggcttcagctgggccccctgcgcgtctcagctcccagccgggcgtggcagctgctagactgtgtacctggaaaggatcgcgattcttctcccctcccgccatgcttcccaggccggccccatgcccatctctgagcaggctcccccttggtgtgctgtgcccacggtctccgtctctgccctctgcccaccgtctgcagaaagcagggaccctggtcctgggagaagcttccctccatgtctgtccagtgtagactgttcagatttcagcagagaccaggtttgcggatggcacccaggcaggtcgcaggcgctctggtcctggggaggcctgcccgcgagtgctggctctagtctgggagtggggccggcctggggcccctctgagccctgccccaggctccaaggccttttccaccaccccctttcatcctcgggggcgatttcgttttggagcaccgtggtctgttttcactcagtggctttggggttggggggacccgcggcagctgtggatccaccgtcaccatagagtgtggatttacaccactggccttggcgccccagacagggcaggccgcaccccggtgcaagcctgtggggcggggcgtgtccccacgtgggcccgggttatcctgctccatgccagagcccctgtggagagcctgtgctggctgcttctcggtgttcggtcagccttctcgccgctgtgccaacattctggaaacacacacacagctttgttcaactcctatgacgacgcgatgaaacagcggctgtaacagccgttacaagtggaaaaatggaaactgaagagaccgcgtgacctcagccgcctggacagagggcctcggctccctctgctctcctctccagccccactgctcacctggccactggggaggggcgcgtttcctcagagaaacagctgcccacccatttgaacaagtccaaaaatatcttgaccttattacttgtccaggccccctgggcccctatgtcgccccacacgatgggttcatttccttccattagctgcagagaggccgggtgtggggtcagggtttgcggtgaaatgtcgagacccagggggccctcggtttgcactgccacgggatcagctcagcccctgcccgtttcatacgggatcagcccagcccctgcccgtttcatacgggatcagcccagcccctgcccgtttcatatgggatcagcccagcccctgcccgtttcatgggtcagttgctcttcaagccctttgtggagaggagggtcaggccgagcgggatagggctttctctccagcgctgaggctgaggctgaggtggttcctgcagggcaggaaggttcccgcagccacagcttttgcaggtgaggctggacccagccctgagccttgtgggcgctgctgcaggtcggcatcttgctaggagcacctcctccagtgtgaagcagcaaacgagccccgggtgaaggttcgaggggctgctgaaccgcccccctaatccgtcactgtgcagatgctgagaccccagaggtgggggcaggccccccacttggcctcctgagacctagttggtgcctttccaactaggccaggctgactcacgagctgctctgggccagaagccacgtggtaagattggtccctggcctaacgttgagctgcctgtgccctgcccacaagcagaatttaggaatagtccctggaagcagaactaaacacacccatcccagcttccttctcctcctctgcacttacaccatgagtgtctctaccttgagagacttaaactccaaccatgtgggaaatgtttcagccactcatcctgaatttactcctgtgggacagcagctgcgctctgcttgaaagagtaagagatggaatatcctccattcaaccagcctcccagccctctggaaagacacctgccttcctggtttcacttttcttcttgaatgaaaacagggcagtgttcaagcctcagagggcctggagcaaagatgaaatgtgaacagcctccggaggaaatcactcaaaagtagggtcatacgaatccacatgggaaagtccctgttccgagtaagtgggagtggggcgggaggctgaatccaggacccacaggtgggacaggccttcctgccagggcgtcttctctgctgtttcaagagggctcctggaatcttgtttactgccatacttttctttgcagaactttttatagccaggatcggtcaactttagtatggactccgctggcccctgcatgctcagaattagtggagttcttagtaagatgacttcatactagattaaataagcacaaggtaatgttcaggattgtgggctgtcagctcctcttgggccagcagtgccgaggaacatcaggctcagacatgcgttcgatgaaccttcctaggtatggatggacgtatgtcccaggctgtgtggtgaggaccctcccggtgtgctgtgcatgggagtgtccattgtgcattacatattcagatgggaacgtgagtaacaggccacgtgtcacagcaccgccaaggcaggtgtattcgtctgttctcacgctgctaataaagacacacccaagactgggtaatttatgaaggaaagaggtttaatggactcacagttctgcagggctgaggaggcctcaggaaacttacaatcacagcagaaggggaagcaaacatgttcttcttcacgtggcggcagcaaggagaagtgccgagcaaagggggaaaagcccatgataaaaccgtcagatcttgtgagaactcggtcactatcatgagaacagcatggggtatccacccctgtgatgcaattacctcccaccaggtcactcccccaacatgtggggattatgggacaattcaagatgagatttgggtggggacacagtcagaccatgttagccagccagcaccgagtgcactcaaggctccccgagtcaagcagccagcacattctgtcatcccagcgcctctactatttaaggaaagagagcaaagcctttattttcattgtccattttcctctgattcctctttccaaactgggcatttttgtgctggaaagaaatcctgaatgttgatgcgatgctgtgtgatcatctcttgggtagtcattttccaaataatttcttggagtaccgacactcgtcgttctttcagggacccctgggggcagttggtatattatacatgtatgagtttttagatggctcctctctctcaggttatttctgctgtttctgttaagattatagacaacataactgggatgtgtgatttcataggttgaccctgatcagcttcccatgcctggatgatcagtaagaagccctggaccccctctgtggagggcgggctgcagctcctacccttagagctgattcaccgttttcagatactggggccaaaccggccctcccagacgcctgctggaaccgattccgcctggcactgcatgcatcccaacccggggccccattaattctcggatgcctgagtccagacccacttagcgtggttgactggagcctgtgccagggctgagctcatgagctgaattcttacatgaacaaattacttgcagtttggtctgtggctttgcactgcacacctctgtggccgcccctcagcatggggtctacggtcctgtgcagagcaggcgaggcctgggtaagccatcagggcaaatccacccacacctttggcaaagccagcccaggtctattccctagggacagtgaaagagatagcataggcgaggccatacctgtgtgcccgcacctgggaacctactcccgtctgtggcaagcttggaggacagtggtggctgaaaatgcaggaagcttctcaggcatatgggcatctgcctgaagctgctgtgtgggcatttcacatccacccctgaaagcccagaaagggctgacagctgctgccaaagtcagtggggtgtggtttgccacagaagtcagcgacagcagtgggatgtgatttggagctggctgggaggctggggcagggtattgaggctgaagtaatatacgttttgggtactgtgaagtcagatgacttgataaagatgcagaaataacgatttgactgagggcaagaaagcaacctgggaggaagctgggtcagcttgtcctcagtcaggaagcttccgccatgcaccatccaggagctctcccagctgcacgcttcatactcgaacttgtatgagatgggaacccatgacaataaaaccaggctctctgggatagtattgaaaaagtggaagttttcttagtacagattcatctcaccttgaagtctgagagcagacccagaagaattgattgcagtggtcgagtctggcctgattcgatggtgtttgctgcatttgctgggaccagaagaagggcacgcatgttgtaagcactgtcctcaaagagacttgacatcaacaacttggcacagggagggttaactgtgtgttattctgaaaatatgttttggtccggacatgtccaggcggtaatgtagcagaccctccactttgaggagatgataataacactagcccatgtgtaatatatcaaatcaaaagcagccgtggacctgggaaggacagacttttcatcaaaaggcctggtgctgtggggtcagggctgtggcagggcagtgctctggccataggaccgcaagcactaccacagccaggcgaagggagcccttgtcttgttccgcagaggggagtgagcatggctagaaggagccgcatgtgggtgacgtgggtgtgagtggaccaggatgtggggtgattgtggccgtgagcggcaggaggccagagaaggtttggcctggagctgcctggctcaggggctgcccactgcctcggtgggggtggtgagagttcaggtgtgcactgaggagagaagtgaaaccgacctttggttagtgagtattctgtcctgattgatctgtggggacccgcggggcagctcatcacggatgaggcagagaaagcgagtttggagagctcgtccaccttggcccgggggcacatgcaagcaacagtgtcaagtgctctctccgtgctgggtgtggccccatcatgcattccaacatagggaatacccgtgaccaccctgcgaaatgggtgaagccccattgtgcaaacagggaaactgaggcacagaggaaggcagtcccttgtccaggggcctctcacggtgaaggcgtgcagagccagtactggaagccagcaagagggctgctgtatgcctgacttggctgccacggtctgcaccatgtcgagctgcctgtggggacaagcgaacttcagttgctctgggccgtgttccgccatctgatccagcagcacggcccctccgccagccaagcctccttcacactcctgaggcctcgctgagcagccgccaccccttatataaactgacagatatggctggatgcttcgacgtcacctaaagcttcaccttcagagtgtgcactatcccatcctatttcaggtgttagctgggagtgggaaggccgtgtgtaaggagcaaggggagcgagcaaatgccttgctctgaggaacgtccttgtgctggaggtagaccaggaggacacacggcccagaggctaattctttaatagtagagatacgtggtgggatcataaacaaagacagtttcacgggcttttgctcgtcactagtgagccctaattataaagtatcgaatcagaattcaactagccaagccatcatcaaaaactcatagcagttcatcaataagtgtgtaaaatcctactctccatggacattgtggaccttgggaactggggtcagcatttttattaacccgtgtggacacagcagtctgagagttttccattcctcgagggctgcttgcggcgtgttgtacgtcgatggtatcagtggcgtcccagccctgcttgggaggacacacactgctcattttcagcaaccagggagaatgaaatcacccagcactcttcctcaggctgatgacctcggggtgccctgggtgacccagccatagggtgagcattcaggccacagcgccttccccagaccctcaggacccctcatcaggacatccttctggccggggcccctcaccccagctcgtcctggccagagtctagggtcagcctttgtgcttcggagactcctgcagcagggtgagaagcaagttatttagacagagaaggcaagcaccggagacagcctgccgcccccaccctccgtcgccctgctggggacaacgtggagggcactggcctgaggagggaatttgggggttcctgctgcctgtcaggatgtggagcacagtgcagcagtgtgtggtgaggggcagcgggtgggcggtcattctggcagcctgcagggtcccaggaaacacggtcttctttggtcagatgagaagcaaggccttgctcagcacaagcgaccagcacgtgacctttcacctcaggtcaccaagagtagcaacagttaggcctcctccaccgagcacatgccttgctgaccttgcccagggaagcctggcagccagggcggggctcccatggcaaggaggcagccctcctccaggagataagccgtgtccagcatcctcaatgtagcgctactacctctatatgtaaggcctgcacctggtgacctaagtcaggttttgcttctaggtggcatttgcttgagggtcccaagaccccagggagggcactgtctgaagaccccggcacaacccctcagagaacacggccacctggctgtgagcggagctctgcttgagcgctgtggcccgtttccagcataaagcaggaagttcctgggacttgagctgagcactgtgtggcttcatcattgttttcagaatgtggtctgtccagagagcagtggcataggaagacattgacttgttgcatatgtgggcattcagcgcctgtattcacgtggacatgtttatgtgggcattcggcggcacctgtattcacgtggacatgtttatgtgggcattcggcacccgtattcacgtggacatgtttacgtgggcattcggcacctgtattcaggtggacatgtttacatgggcgttcagtgcatgtattcacatggacatgtttacgtgggcatccagtgcctgtattcatgtgtacatgtctacataggcattcgatacctgtattcacatgtacatgtttatgtggacattcaacacctgaatgcacatgtatgtgggcatccaacacctgtattcacatgtacatgtttacataggcattcgatacctgtattcacgtgtacatgtttacatgggcacccaacacctgtattcattcacctgtgtacatgtttacgtgggcatttgatgcctgtattcacatgtacgtgggcattcaacacctgtattcacgtggacatgtttacgtgggcattcaacaactgtaatcacatgtacgtgggcatttgatgcctgtattcacatgtacatgtttacgtgggcattcgacacctgtattcacatgtacttgggcattcgacgcctgcattcacgtggacatgtttagtcgtcagcctgagccatgcaggcggagcgttggcttttgagaaggtcagttgccttcctcacttcctagcctgtccccagggaggaaaacagggagtctgtgtgttcttggagctctggtgtcaccgcggagtttgctgtgctcactttagactctggttctgtaacttttaattccttcagtggttcctgtctgaattggtttttgctctcgtttggtttgaattggggtatttttttttttttttttgctgtggtgtaaagatttttctaaaggtcctttaatgttatacaagtcaattatgcatcaatattatggattaaaccattttcctcagcagtggttgaaagaaactagcttttcagcagacatcttattctggtggatctttcagtgcttttaaagtaaataacaataaagaaattttcatttctatttcaaagttttactgtaggcattgcatgcagactgattataaatgagcgagcctgcccttcccactgggatgtgaagttcgctgaattatgtcagcagcccaggaatgactgctgtgcctaagcacaccttctggccctagctctgaatccacatgtgtgagaggagcatgcatgtccctgatgcagcgggactgccctttcatagtgtccgggggacaggacatgacaggcaggatctgccagagccttgctgcatccctgagcttagcagtgtggggcactgcgtgtcctccggcatcaggaaggctgcgtccctgagcttagcagtgtggggcactgcgtgtcctccggcatcaagaaggctgcatccctgagcttagcagtgtggggcactgcgtgtcctccggcatcaggaaggctgcgtccctgagcttagcagtgtggggcactgcgtgtcctctggcatcaggaagtcacagtgcatggccccttctgtaactcagcgaccgacatgggcgtgtttccaattccacttgtatgtgtttcttgtgtatctaacaagaatttgtggatctgtttgaatgtgaaaaaaatgcaagcattctctaaaattgaattgtgtgtggagaaaatgatactgaggataaaagtgttgaaaagagaacaggaaaagcggagaaagaaaatgagggaaaggaagagaggaggaaaagagggaaagccacagcaccagaggaggggagtggagaggtagggaggaggaggagagggaagaggaggagagggaagaggaggagagggaggaggagaaggagaagatggaggaggaggagagggaagaggaagaggagaggaaggacgaggagaagagcgaggaggagggggagaaggaggaggagatggaggaggagagggaggaggaggagagggaggaggaggagagggaggaggaagagagggaggagagggaggaggaagtggaggaggaaagggaggaggagagggaggaagaggaggaggaaaggtaggaggagagggaggagagagcatgaggagagggaggaggagagggaggcggaggagagggaggcaggaggagggaggagcagaggagggaggaagagaggaggaaaagagggaaagccacagcaccagaggaggggagtggagaggtagggaggaggagagaggaggagagggagaagaagagggaggaggagagggagaaggagagagaggaggagagggagaaggagagagaggagagggagaaggagagggaggaggagagggagaaggagagggaggaggagagggagaaggagagggaggaggaggagagtgaggaagaggagagacagaggagggaggaagaggaggaggaggaggagatggaggaggaggagagtgaggaagaagagagaggagggaggaagaggagaaggaggaggaggagatggaggaggaggagagggaggaagaggagagggagaaggaggacagggaggaggtgaagaggaagaggagggaggaggagagggagaggagggaggaagatgagaaggaggaggaggagatggaggaggagagggaggaagtgaaggagagggagaaggaggacagggaggaggtgaaaaaggagaggagggaggaggagagggaggaggtgaaaaaggagaggagagaggaggtggagaggagggaggaagagaagagggaggaagaggaggaggagagggaggaggtgacgccccctccgcctcactccttgcccacctccgagtacacagctggctgcggctatccccccgggcccagcccacctatgcacacctctgagtctgcattttgcggcggtctcctcactgaccatccctatagcatcacagagacagcggcgttactgtaggtcatgaacagaaacggctcaaacaactcaagaaacacagttctggccacgccaggcttacttggtgagcagatgccctgtgaggaacccagcctgcaggcctgcgggggacaccatgacccgggcctggggcaggaaaccctggatgccccagcaggtaccccagggcgtggagcttccgtccaggctccgtcctgcccttgtgtggggactgccccgaggctgcgcccgcctcagccccacacccaggcttgctgtcctgggcgactccctgcatgtgagcgccggctcccgaggacgaagccttcccagcgctgctgtgtccccatgtgccccgggcgtgctccacgctcctctcctcgaggcatcgagtcctgtattcaggaagcttctcacgctgccgcctccgccctgtgggttgaactgcaagggtttgttttccttccatccctcggccctgtccatgctggttgcaccttcactgtccccgttatgcctatgggagaatagggactgcccagacccagcagggtgaggtgaggtagcctggccactgcggctcatgaatttgggtggaaactggggtcctgtggatttctgtccctctaaagagcagctcatatgacagtagctgccgcagacccgaagggtgagagcgagtggttgccacacacggcgtcctgcagagtggcgccatcttcccaagtcacatctgagcctacactgccgtgacggagtgaggcgttccgagactgttcgcgttttcatgaaacgtttctccttcctgaggactgagggactccctggcatgtggacgttttcaggccctcagactctgctgacagcagttaggatgcaaggccaccttctcatcttccctgactttgctttcattgtgtcactgttctcatcaagaactttcagagactctggcatgtaagtagcagaagaagagaccatgttccttgaccagttattatttcaggccttttacctccactctgacttgtcctcatggttcctctagaggaagcctcccccgtcggactggtcctctcatctttggaagcctccccactcggactggtcccctcatcttgggcagatttctacttcccattgttgactcgaagacctcccctgtcgggcgtgccctctgctgtaccatgaggctgagtcactctggggtcctggatccagcccaaggccagcttcctaaccccttaaccgcagttacagctctgagccctgagcccacttttgccgacactgtcaccctccacgcacactgtcttgtgcacatgagccggtgtgtggtctcacaacctagattatgaactgcgtgcagagatggggggcttaccattttcttaaactcactgcagctcaacttccagtgaaatcttggttgggaagaataatattgacgtggtttatcccttctaaaccctcgcaggcccaccctaggattcaccaggcttgacaggcatgatgcccaggccatgctgggctcctgcatagccatttttacttggcctgaggccagcaaccctaggcattcccttgccctgttgtataaagacatcatggaggatggtgcatattctattcagcgcatctctgtgaggactcctggaacatttcttttttaatttaagaatagctatgattttcaaaaaatagattgtctgtttttgtcatatagacattgtggatcctgttcctctcttccccgtggcagctagggagctcacagccccatccgtagccagctcctagtaagtaggtccgtgtcatgggttttgcatactaacctcattctaggctccaacttatttcccattcttgttttccctatgttttctttttgtcacctctttttaaatatgtgtttactttgctaacttgtatgcatctttctggaatgaagtgaggtataaatgaaaaagcaaattacttagtgctctgtatgacacttaggatgtgctgtgtagagctctcagttggagtttattgattcattcaccaactgacttcaacttggatcagtccagttattgttaccatcatcacaaagagtccagaactggatgaggcggacacaagccccaccaaccaggacctgggggctgaggttcgggaacaaagacaccaatgggcagagaaattgaggctgaggaagatacagctccaaggaacagaggcaacacagacagagggaggcactgggccaaagtctgggtgagagggccctgggcttgggtgggaggtacagcaagccgcctggccccacagcccactacatctttgtgaagctgatgttgagtgcataggggcccctggccctcgcagcgggctgatggagaaaactgagcacgggctcttctccccagatgaagacacgggtggtgctgggaagaggcaggtgggcttgagcaaaggcgtctgtggggactgcagagctcgtcagggtaagagtcccacgcattgtaagaacaggttttcatctcctggaggttgggagccgcctctctcctgtttgttttctaggcatgactcccactcacagaaggggctgtgcttggtttgtgcttctaatgtccgcgtagagctaaacctcagctaaaggccagccggagcatgaccaaggaggcttgtcctgaagagagaggggtcagaaaagcggaggtggaggacccctgcctccgtctgctgcgagtgcctagaacgaggtcctcgcgatgagctgctggttggaaactgtagcatcttgatggtcccagcactgaggatgatgtgtggacatctgtgcaaggcaccttctcacccaggcctggatccagttctgggagttctgggaagctggttgtatcactgcccatttacaggggagcaggcggcccaggaagaccccgccagtacccagtgtacacccggagtcggcatgcagcctggaccatatcacccaggcctccagctccacggctccaagccacaccctggacagccacccgtggcctagcagcacatgggacctcgcacaaaggagctggggcgcagaggccagagaagaaagaagatgcaaaagcgaccaaagactcaatgtgtttacgtgtttgttcaaaaagatgttctcccaccccccacaggggtccccccagacccggccaagagacccaacgctgagacccaatgccgagagcctcgtgtgtcctctggggtcgccctgggtgccagctccacctgattcatcctagagagagtgtggagctgaggccgcccgcagcaggattcgcccaggtcacagtcgttcacaggcggttccgggagcaggagctgcacctggatcaggggcctctttccacttcctgccccaggtctctgggcagcactgagcaggactctgctgggctcacactgcagccaccatggtctgcgggccagggctctcacaaactgtgtttgtgtctatgtgtgtctctgtttgtgtctgtgtatctgtgtgtgtctgtgtctgtgtgtatgtgtgtgtgtgtatgtctgtgtgtatgtgtgtgtctgtgtctatgtgtgtctgtatgtctgtgtgtttgtgtgtctgtgtatgtctgtatgggtgtctgtgtgcgtctgtgtctgtgtgtatgtgtgtgtgtctgtgtctatgtgtgtctctgtgtatgtatgtgtgtctgtgtctgtgtatgtctgtgcctgtgtgtgtgtttgtgtctgtgtgtgtgtctgtctgtgtatgtgtatgtctgtgtgtgtgtatccatgtgtgtgtttgtgtctgtgttctgtgtgtgtatctgtgtgtatttctatgtgtgggtgtctgtgcatctgtgtgtgcgtgtgtctgtgtatgtatctgtgtgtgttcatgtgtgtccgtgtgtatgtgtgtgtgtctgtctgtatgtgtgtctttgtatgtgtctgtgtgtgtctctgtgtgtttgtctgtgtgtgtttgtgtctgtgtctgtgtgtgttcatgtgtgcctgtgtctccgtgtgtgtctgtttgtgtcttgtgtctgtgtgtttctgtgtctgtgtctgtgtgtttgtgtctgtgtctgtgagtgtgtgtctgtgtctgcatgtgtgtctgtttgtgtctgtatctgcgtctgtttgtgcgtctgtgtgtgttcgtgtgtgtctgtgtgtttgtgtgtctgcatgtgtgtctgtgtgtttgtgtgtctctgactgtgtgtgtgcactgccctttgcactgctttgccagcacattttccctgtgccgtgtgtgtctttctcctccactcagttgtaagctccctgagggcaggggctgtgtctcactgctctgtggagtcccagatccagcactctgcacccgtgacatggtgggtggctgttaaattgagttggcaaagaggtgtcagtgtcagctgctgcaagccacagaagggcatgaactggcagcaggtgggattagttttatatcagagatggagacagggaatgggggggcaggtaccccaggaatctatatctgcatagcaaattatcccaaattggagagccctgttttgctctcagctctataatctggtcaggcatgacagggaagtcttgtttctgctccactggcatcagctggagtggtccaagggggctggagggctcgccccaaagagggcttgtctacatagctggcacattgtggtggcagttgtggagctcagccagggctgtggctgggagctctgggcctctgcatgtggagcctccacaaggctgcttgggcttcctcacagaatggcagcgagtttcccaagaacaagtgtcccaagagaggaaatgggagctgccagtctctcgagtctgagcccagaagccagaaactggcagggcgttacttctgctgcctcaaccggccaagcgggcccacagcccccgcactcaggtggggaggacagaggtctcacctcgggggcaggtgcattctgctgcctcaactggccaagcgggcccacagcccccacactcaggtggggaggacagaggtctcacctcgggggcaagtgcgtcagagaatgtgtggccctcttcagcacacccagcaatgaatctgaatgcaggcgcctcatgaccttgctgtgtctggagctggctgaacgctcttcccgaggatgtccgtctacccgagctggagggatgtattagaggatacgaaggaagatttgatgcttttttcagatctgctctgtcattgggcaaaataagctcccctatagcgctaatttttaacaaagatttctccccaaaggagagagtaggatcatgtatttggaaaagctcacataccattgaatgaaaatgaaaagaaattagcttcacgcattcataattcctacattctctgggtgcacagggcctgacaacagcagaaagcctccggtttaacgtaaagaggtgggacctgctgagaccctcacctcagaaagtgcttaattgaaaatccagtttctccacatgatgctgctaagaatatttaattagcgttatcattaagcaagggtagttgttatactgacatcatgcattctgtgactgacacacttaaaccagcagaaacctccagtcatattctatctacataaactctgctctgaagctaagcatggttccaatatgttcctgaaattaaattcactggattaaacaaatagaattaagggtgccagaatttcatctctaaattgcagagcagtgttctagaagcagaagcagcattcaccggggccggtggcagcgggaagtgaaagtgctggggaggctcggagaccaaggaagccacagagaaccccaggccggacgggctgctggggccaagcgtggatgcggtagccgaggtcggggtgtgtatcctaaagcccagtaagccatgatgcctgcaccagaggccacagccccacatgtgctttcaggccatctgccgggtcttgggaagaataaagtgtgcaaaggggcgggtggcagggaggggcccatggcagcccccagggaatccaggtgaggagcgcctgggatagtgttttagatgtgaagcctgcaggtctgggagggagctgtggtggagtgggaggcaggaacgcgctgagccacagggagctgcggaagagagttccgtgtggaggggctggtgacatgtctgctgtgctgttacaaatcctggtgaagatgtgtgggtgtgttttatgcaggaccaagggagcccgtggcgtggctaaagccaagcccaacatcttctacccaaggcctgcagaaggtctggggtgtatcagcaacccatactgtcttcagtggagttgtggtggctgaattccaaaatcctatctgtgttccatttgcctgttgacattgctgtgatgtttccataggtgcttagtcaacctgtcacacctagaagtcaatacaccttccttaactgcccccccgacaatgaggggagtcatccagggaaggggtgtggaattccagcagggcgagctggttgccggcagctcattagctgtggcctctcagattagcagtaattaaactgtgaaatcagaccagcgccttaagcctggatgccgtcgggagtggcctggggataaatcaccggcatgtgttggtccttgcttggcacgggcaaagcgtgtggggggcggaataatgaggacattcaaccgctgccctcggtggacactgggctggccgcggtggaggcgttgtcatgacgatggctgggtgcaggcaaacgctcctcccgttcgctgtggttaatgaagatgatcatgaaaaattatgccaacattacggccatatttttatgctgactggcacgtgcaacctgatgccagcgtcagcacacagcggtgacagtaattatgtgttgacaaatgaggggacaatgtgaggaaatgtctgactcagagatgtgtgtgtcgacttcgccgagtaacttcttccgagggcatgtttgttctttaaagcctccataggtgccatggcactgtgggtgccaaaacaccccaatcacttgtccttattttctaaagaaagacactacaattaaagcagaaactgctcccctaagcagaatggatgagatcgagataaatcaatgttttttatattttaaggaaatcagtgtgatttccaaatgatttttccaaatgacttttcttgtggggtgatgtgtttaggtttttttgtaactgattttgtttctgaacagaaacatctggggtggagctggggctgggctggggcgtcgcagcccccttggcctctccaggagctggggagcctcacgtcatccccatcatggctccttgaagacaagtgttgcggccgcgtgctctcatggccgggatatgggaacgggaggccagcgtggggcgtccggcccggagccacactctgtcactgtaggggggtcgcttcttggccccaaagcaaagcctgaggatgtagcgtgcggttctgcccgtgtgctgtgcttcagtgaacacactcagatcgcacagccgaacgcagatgagctgctcggaggagcagaggacgatccgttgactgtaaaacaggcttgctgggcctcactctctctgcatctcctgtgctctggatttgatattccagcaatctggggaattcatagccacaaatataggttgcagtcttgttagtgaaatctttttttattgattttgttaaacaaagatgcttaagtagttgcaatctgaagtagagtttgtctttccagtttgttcttgtttttaccgtttggaagatcaatattagtcgccacactgcagagtgtgtgactcacagtggcaattctctttttaccgctcggtgtcagcaataagcaggaatcgtgtatggaagcgtcccatgactgtgccttcatgtccttaatgtccctcaagcgggctttcttgcctcctaagtcctacctgccttttgagtttaaaaacaataacaaaacaaacaaacaaaaaatagcaaggagcacagagctggaagtttctgcttcagctggggcctggctctgctccaggtctgagcctggcaggccttgccaggaccactggttcccaccgcctccacacacacacagcgtttctaagaggagcaggagtatagacagttctcaccacactgcagaggcacagcaccaaacagaacagtgttcgcctgtgaccacggaaggcagactggcctggcagtgaaagagcggtcgccctggccagttgctgacttgcacccatgggcactcacttccccaatgcagtgtttcctgggagagcaggagcattcttactgctgtattcgtgagcattcttactgcagggtgtgactgtgaggacttcccagccatttgtacgcaaaggcaaacaccgtacaaagtgtcaggcatcattatcaaggtagaaggagagagaaagattgggttatcctaagaacacagataacatggcagtcagtctcattgtaaaaccaagatgccaggaggaacagggaaacccctccttcttgttcagaagcttccgtggtccccttaaattggtagggtccaaggataaatctggtacaaggcgttcataagccacagatggatgatggacgtggagtgctgtgtgcccagcacagcctggctacttcatgtcaacctccctgcagccagggaagctcagtaccttgcccagagctcctcatctacactgcaagtgccaggatttgaatcaagacgtgccaaggcctggcccctaccctgcagggggagctgtggcaatggcagcccctggagtgactattgtatggtgctaggtggtgccaggaggagggctggcagtgtccagagggggacaagccactcccagctgggtcatcagacaggattccacccacccggcaagagccagtgctgagagctggccaggaagacagagacataagcccagaaaagaccatttctggtgccatcaactacaagtagagggtgaaggccccaacggaggtagccaaggggacgtgtttcgagagccacctgcaaagtggccctgtgtctcacccagcctctgagatttcaatgtcctgtcctccaagaaatggtgtctcagccaaatgctatggagcattgagcaagttcttgcagttctgggtaccttagtgtctcctccataaactggggaaaagaataggacccgcagcacaggcatttgtgaggaacacccaagtcatccaaacacactctgcaagtgccagcaattctctaggatagaagctctgagaatagctttttctgattcctcccgtgtctcttcagtgaaagtgtttgtttatgggtggatcaatggatggatggaggaaggatgggtggatagatggatggaggaaagaaggatggatgcatggatggatggatggatggtttggttgacagatgagggatggtggttggatggaagaagagtggatgatggatgggtagatggatgatggatggatggatgaaggaaggatggatgggtggatggatgtaagaagaatggatgatggatgtgtgggtgaatggatggaaggatggatggatggaggaaggatggatggttggatggatggatgggtgtgtgggtggatggatggatggatggatggatggattggtggacagatgggggatggtggatggatggaagaagagtggatgatggataagtagatggatgatggatggatgaatggaagaagaatggatgatggatgggtgggcggatagatggatggatggatggaggaaggatgaatggttggttggatggatgggtggatgaaggaaggatggatggttggatggatggatgggtgtgtgggtggatgaaagaaggatggatggatgggtgaagggtggatggatggaggaagaatggatgatggatggatgggtgggtggatggatggatggatggagtaatgatggatggatggatggatgagtggatgagtggatggatggaggaagaatggatgatggatgggtgagtgaatggatggaggaaggatggatggatgagtgggagtttgggtggatgaaagaaggatggatggatgggtgaagggtgaatggatgaagaatggatgatggatgggtggatgggtatgtgggtggatgaaagaaggatggatggatgggtgaagggtggacggatggaggaagaatggatgatggatgggtaggtgggtggatggatggagcaatgatggatggatggatgagtggatgggtggatggaggaaaaatggatgatggatgatggatgggtgggtgaatggatggaggaaggatggatggatgggtgggtgtgtgggtggatgaaagaaggatggatggatgggtgaagggtggacagatggaggaagaatggatgatggatgggttgtacggatgagggatggtggatagatggaagaagagtggatgatggatgggtgaaaggatgatggatgggtggatggatgatggagggatggatgaaggaaagatggatggatggttggatgggtggatgaatggaggaagaatggatgatgaatgacaggtgggtgggtggatgaaagaaggatggatggatgggtgaaggatggatgcatggaggaatgatggatggatggttggatggataaaagaaggatggatggatggatgaaggatggatggggagtgagtggatggatgggggaaggatgggtggttggatggatggaggtatggatgcatggatgatggaggaaggatggagggatggatgagtgcatgatggatggatggatggaagaatgatggatggttggatggatgaaagtggatgggtagatggatgggtgggtgggtggatggatggatatggatggatggatatggatggatcaatggatggatggatgggtagatggatgggtggatgaaggatggaaggatggatgagtgcttgatggatggatggatgaatggcaggatggatcatttcccagctgtaggacagacaatcggctcctgtcccctgctgtatgccaggcacgcagtctctcactcttttattttttaattttttattgtggtaaaatatataacatttgtgatttttaacctttaaatgtacaatttagtggtagtatttacattcaaaatactgtgcaaccatcatcactatctgcttctaaaactctttccatctttccacactggaagtctgtccccattaaacactaactccccagcccccaggacccactgtcctacattctgtctctatggatctgatgactctaaggaccccatacgagtggaatcacacagtgtttatcatattgtgactggcttatttcacttagcataacatcttcaaggttcatccatgttgtagcctgcatccaaaatctctgccttttcagtgctgagtaatattcccatgtgtgggtggaccacatgatgtttatcttttcttccattggtggacgcttgggtggcctcacctcttggcttctgtgagcgctgctgctatgaacatgggcgtgcgaatctctctctgagtcactgcattcggtgcttttgggcatatgcccctggtggaactgctgggtcctgggctgattctgtggttagttttttgaggacccactaacagcgactgcatcatgctatattcctccctgcagagtgtgccagttacgattcctcagcattctcgccagcacgtttttgttgtgtgtgtgtgtttagttacggccatcctagagggtgcgtgcatggcctctcctagcctccacatgctccactcatgtggctgcgactaaagcttccctgtgttcacggacatcatgaagatcaaacgaacatgagagtgtttggaaaatggtcacaggttagactgaatatgaggtgttgttgcttctctgaaaacaaaaggtgggcaccgtggtgctctgggggatggggcagccacatggggcagtggccacacagcagaggcccagcagcccctaaccctgcccggtgcagcctcctcctaccactgccggggctctcctgccctcaggagactccagcaagtgactgcactgcgaagagaggaccagccaccagccctcagcatccaagggaggaattaattccgaatgaagaggaaaccaagcagtgaggcaggctaagatttccagaagaatttaatctgcagtcaggttaggggcgtggccttcccccatggccaggggggcagctgctcccaactctgaaaaggaggtggaggctcagtgtgcagctcccctggggacccagccgagaggatccccaactgtgccgtggggtttggggctaggagaagggactcgaggccacaccagcctggctcagggccaccgccaacctgtgcctcagagcgaaggccgccccatggccacagtgactggggcaggctgtcttgggcctctggagagctggagtctgtgctgtcatcaccagggctgagcttttgttggaaaagggaagggagagaaaaatgaggagggcacatcacgccagaggtcatggtgtatgtggctggaaatttgagttggactggacacctcagggcatctccctctccttcccactgtggcctgggatggactctgtgcctgtgagtgggcagccatgggctctgatggagggttaaccctgtgaccgaccatgagtgggcggccgtgggctctgatggttagctctgtgaccatgagtgggcggccgtgggctctgatggagggttagccctgtgaccgactgtgagtgggcggctgtgggctctgatggagggttagccctgtgaccgaccgtgagtgggcggctgtgggctctgatggagggttagcctccggcaccagcacctgggcctaacatgcttttcaggggcggggctggattgtggctgcagggccttggacacgcagggacacacttcccaaggggggccctgatacccctccctgcatgcggtgcctggggccaccatgctcccacctctctcctttggctctgaaaagttttttcttttttctcttttttttttattattatactttaagttttagggtacatgtgcacattgtgcaggttagttacatatgtatacatgtgccatgctggtgcgctgcacccactaactcgtcatctagcattaggtatatctcccattgctatccctcccccctccccccaccccacaacagtccccagagtgtgatattccccttcctgtgtccatgtgatctcattgttcaattcccacctatgagtgagaatatgcggtgttcggttttttgtttttgcgatagtttactgagaatgatgatttccaatttcatccatgtccctacaaaggacatgaactcatcattttttatggctgcatagtattccatggtgtatatgtgccacattttcttaatccagtctattattgttggacatttgggttggttccaaatctttgctatcgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttgcagtcccaccaacagtgtaaaagtgttcctatttctccacaccctctccagcacctgttgtttcctgactttttaatgattgccattctaactggtgtgagatggtatctcattgtggttttgatttgcatttctctgatggccagtgatgatgagccttttttcatgtgttttttggctgcataaatgtcttcttttgagaagtgtctgttcatgttcttcgcccactttttgatggggtttttttcttgtaaatttgtttgagttcattgtagattctggatattagccctttgtcagatgagtaggttgcaaaaattttctcccattctgtaggttgcctgttcactctgatggcggtttcttttgctgtgcagaagctctttagtttaattagatcccattggtcaattttgtcttctgttgccattgcttttggcgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccattcattaaatagggaatcctttccccattgcttgtttttctcaggtttgtcaaagatcagatagttgtagatatgaggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgtgggctcttttttgattccatatgaactttaaagtagtttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttggccagggcaattaggcaggagaaggaaataaagggtattcaattaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatatacaaaaatcacaagcattctgaaaagttttttcttattttggatgccttgttaaaaggcaagtaccccagcaggtgtcagtggagactgtgaccgctgaatagcaatggtgatggggtgaggctggatctggccagaagagggctgaggggcatggagaagactcggggagcacagggaagatgtgggaggtggggaggatgggagggaggacagggagaggacaggaaggactggctctgctcattctccttcgcacttctgtggagcagctgctctgggcccagataatgatctctcgagggcaggacttgtggttttatttgcgtcatgagcctttaggaagtttggggtcgtgcatgtagagctgaacgtggggacaccgagaacgtgcaccctgcatcccgactgctgagttcacttctctgcaaagcacaaatcgctgtcccatcctgggtcacactcctgggagccaaacctgggtgggattctgtctctaccccacatcagctgtaagatttggggcagggcgcagaaccccctgagcacgtgggaaactgatcaccacgtgggggatgtttgttagagagattcagtgggtgatgtgggggcagaaggaggcccctagagcagagtatggcatctgttctgaatgccgatatggcgttggggggacagcaccctggcggcctgcagcaccctctgtgaacagggaaggctggaaggaaggggtgggtccccctgacaggtaggggctgctggatggtcccactttgcccgcccggtctcttcctacactatggttctcactgatgttccctgggcagacaactcaggatgagcctctgtgagtgctggacttgtgttccatccagctcctccccaagagaggggcaggggctggtgccccaaagcaccagcaccccacatggactggcacattttgaaagatataacacaaagaacttccattataatcgctgcccaggcgaccattctcaacgcgtacattatttgttaaagtaatttttaaagcctcaaagtcatgagtccagaacttgcagatctgaacaccaacatcattgaccaataacagcaaccgctgaagataaaaagccaggccgccccggacagtgagccccacatgtctgagtcacacgtgtccgtcttccatttgaaggaggcctttgaaaagacagcagttcattctttaaagtctggctttaaattcaactttaatgaagcggccctgatgggcttacaaggagctgacactggacacgccaggctcctgggccaagcggctgacactagcagacctctgtccacctcgggttctcccacctgccggagttcccgcaggagccagtccatccaggaagcagggcctcccagctcctcaggaacatcgctccccgatgctgcctaaacaggtgcatctcagcccagcaggctcccttggcgcatggtggacacggtgctgcattgacaggatttgggcagaggagacgtaacttagctcggacctaagtaacaatgccgaccgcctgcgcccacggcgcccaggcaccgatgctcccaggagagggaaggggggagcggcagatccagggactcgaaccccaggcaggtctgaagggcttcacaggacatgatttttcagacccaagagaaacgaggaataatagagtcacttgcctttttcttgaaacgtcggaattatttgatgtgacttgtgtaacttggaaagtatgacataaacctaggtatgaaagttaaggagcgatgtcactcctccagttgagcaatggcctgacgtggctggaggggcgtaccgtggcagggaaaccaggagcacgctgtttgttagccacagagcagccacgcaggcagggctccatccgggaggcagagccactaggagtcccgtgaaatcagggattttctgagcagggccttctgctgtgcagcaagggttggggggtagcgtggggagctggggaagggaccactgcctccacgtctctgagccagtagggtggatgggcgggggtcaggagggacctggacacaaagcaaggacaccgcgggatgcaggagacatgccagtcccgtcctccagggacccctgcgtccgcccacccgggccaagagaggatgccccgcgcacgcagccttcccagcacagcagctgccacctgcctcggctccctttagcctcccaaaccttgtgcaaagtccaccttggccagctggacccagagctgcacgggggccacggtctggggcccgcgtcccagcccggctgagctgaccagctgtgtggcctcgtgccacctacctcgcctctgagccggtcttgccctttggggacatggaggttaccctgactgctgtgcaacttcactgaaggagccgcctgagcggagcatgacccaggagcgtgcaggccacggggaatggcgcctggacaggcctggactgtgggcaacaccacgctcgtcatcatccatatttggatgtggtcggcattagtacctgtccagtcaattacgacaccggcccttttcttccccgcaaccggcccactgcagccacgccgggagctacggggagcacatcccatcccgcgaccgcatctcccgctccgtcaatcccgcgcgtcccctgcgccgtcagtcccgagaccgcgtcccccgcaccggcaaggctgtccctcccgcaaacccctggcttcaccacgtttgccctggggctgccccgtggatgatccaccacgtggtgctgccttttcagtgcaccagagagctgcttcagggccctgcgggagatccagcactgccttcttgtgcgcggtgtctcgggcgtcaggggcggagcctggttcattcgcggggccccaggttaagttcagcagctggggctcttttcaaaggtctctgaaatcacctgtttgtagagcaagtgggctttgagcaattatttcccttgttcttcaaaagctgttttgcaaggctaggtttttaaattgcaataataatttatttagggggtgggggaggtttaaaaaaaaaaacttgtatcttgtgagccacagagcataccagtcgaacaacaggtgaaagacgcacggcttcgagatagaaaagatcctcatagcccgctaactgccaagtgcttgcatcttaacacctcccgccttccccgactggaagaccttcctctgcccgtatccaaagttccctggggtcctgcccagttgccccggccctgcccgcgcctgccggggtcctccttgtccccaccggccgccgagagctccagcactcctgcctcagtcggagggtgagctgggcctgcggcgtggagcatgtctctctgctctcccgctctgccttccaggcctggcttctgtgtcgctgccataggaggcggctcagtgctcctcctccgtgggccacttctgctgtgggttcctcgacggtctctgcctgcacggtgcagactcagccttcacccatggccaattctgctgtgggttcctcgacggtctctgcctgcacggtgcagcctcagctgcaaggctaggtttttctatgtcgtaacaataatgatctctttagggggtgggggaggttttaaaaaaaaacttttatcttgtgagccgcatagcataccatagtccatccactgcccgtttgcttttctggcaggggtccaccccacacggcggctcctggccccacatccctgacttcggcccgtccctcacgcgtggccctgcatgttccaggctccgtccatgtttcgcagaaagactttttcttcttcatgtgcttaagtgaccagcgctcccatccgcacaaccctggctgaggaataatgacatggaaagcgacgtcctctttcccctgagcagtttctcgtctatcaggaacagggtttttttttttttttcctcccttctcctgacatagtcacccataaatggtttggccttaattcctatgaaggtaaggacactgctgatgttccttgagtccccacgctagcagcttctcatgcctttccctgctaagctccgtgctgtattgcttccattgcgcagtgagagcagcgcaggcgcagatactgctactccacaaaacaggaggctgagctttagaaggttaaaggctgggcgcagtggctcacacctgtaatcccagcactttgggaggctgaggtgggcagctgagaccaacctggccaacatggtgcaacccgtctctattaaaaatacaaaaattagctgggcgtggtgacggacacctgtaatcccaggtacttcgggaggctgaggcaggagaatcacttcaacctgagaggcagaggctgcagtgagccgagatcgcgccactgcactccagcctgggcgacagatcctgtctcaaaaaaaaaaaaaattaattaaaagattaaaaaatttgccctggtttacccagataataaattacagagccgagatcctaacctagaacttcattattcactcattcatggaaactcttttggaagtgccactcttccagataattccacttaaaaacacatacacgtaattctttgattgtaaagaagtctggtctttctggcatttcctactgtttttcacaagtatatttttggttaaaactatttttgtgcagtggtacaaatcctacccataaaatgtcagggtagtcagatgccaagtaaaccactgcagcatttacctacacaatgccagccccgcccagccctggctgggaacctgggtgctggacgctgccgtgggaagggcctgtgaccaatgggaaatgctcgcattcttctttttttcaaatttattttagaatcgggggtacgtgtgcaggtttgcttcctgggtgtattgcatgatgctgaggtttggagtaagaatggatccgtctccaggcagtgagcatagtagccaaggggtggttttttttcactccttccctctccccttcctaccccctccctctgggggtccccagtgtctgtcattcccatctttgtgtccatgggtacccagtgcttacctcccactcataagtgagaacatgtggcatttggttttctgtttctgcattagcttgcttaggatcatggcctccagctgcacccatgttgctgcaaaagacatgatttcattctttttatggttgcatagtattccacggtgtatatggaccacattttcttataatcaaatgaggatgactcaacttctcaaacccccccgtgaagacacagctgtaaacatgaacctgccctagaagttcgatgaacttctcaagaaaggctgaaatactcccattcgtacccaggactaaattgtaatttttaaaataacaaacatcatcagaagctactgtttggaattacagattttctcaacatttggcacagtactgggtttctgggtagtttttgtctttgacagcttgaatagtctaaacatctcaatatttacatatttacatctttcataaagatttttaagagtaaaattataatattgtctgggtgtggtggctcacgcctgtaatcccagcgctttgggaggccaaggcaggcagattgctgagcccaggagtttgagaccagcctgggcaacatggagaaaccctgtctctacaaaaattataaaaattagccgggcgtggcagcgcacacccatagtcccagctcctcaggaggctgaggtgggaggatggcttgagcccagggaaggtgaggcttcagtgatcccagactgcaccactgcactccagcctgggcgacagagtgagactctgtctcaaacaacaacaacaaaagcattataatctaagttcttcctccccttgaagcacaccccgctgcagagtgttcatgaagcaccttcctttctctgcagctccagtgtttacgccaccttttacctgaaatgaccaacttgacgtggcatcccaataactacaaagaaaactaactacaaagaaaacacgcatgccaagtagggctgggggcaccccgtgaacttcagtaaaacacaaagatcccttgagaagggcccccccagactgggcacctttccagccggagcctcggcctcctccaaaggtggtgatgaagccaccctggcagagttgcagagggagtcccgtgagtgcagtgggtgcagagaatggaaggccactgtcactgtcacctctgacacagccaaggggggacaggggctggtctaggttgatgtctgcccacggtcccacaccgcctcctcccggttttctttctagaactcagtgcttggaccaccctgtttggtggaagccgagtgtcggggcatgtccgcctgcccccagctcagagcactgccactgctttgctagacaggcccatgctggagaagcaccaggtaacgtggctcagtgtcctgacggctcgtgagtccacaggagcagcagcacaggccacattccccacacggactcagcctccaggcctgagtttgcttctcccaggactcaggccccacaggcttcctcgggaagggcccgcaccaggccctgctcttcctgagcccacagtggacgattgttttcacaccccaactcctcggagttgcagctccttcctgggttgccacagatcccagccacaacgcctggtcctcccagcctctcaccagcacccacttcagataggggagcggggaaccagagaccaaggcctcccaaggatggggtcagctggtgccaggatgaggagggagcaagatgctgggcctggtggcaggtgtgggcgtgatgcctggacagcagccatggccgcggatgggggtgctgtgctaggtggctttggttcttgcctggcaaggaaccggtgggggatggggaggtgggcagggcacggttgcagatgccaggagagcagggacctgcagccatgcacgcatgccacgatctgggaagcgttagggcaggtgtggggcctggcacatggtagagaacggaggggaggcgttaaggcaggtgtggggcctggcacatggtagagaacggaggggaggcgttaaggcaggtgtggggcctggcacgtggtagagaacggagcttcgactagaaacatggacattttcagaggtgggggtgttggaggaagggtcactgccatgctgtgagctgcggcccagacggaggccactagggctggagtgaggcccagacgggaggagaagcagtggtggctggtgcctgtgctggtcactttgtaatgggctttgtgtctggggctgtgttctgatagcacaggaggctggcaggaagggaaaagcttgcaccaaactgcacttcctattgtaagttctcaactttcccgatgaagggtctgtgggaaccacaccccacagcacagttcctctgtggggtccagtgggcatcggccagggaacagcaccgtctcctcccacagcacagcagacatgcctggcacatggcactgcccgggggacagaagcccactgcgcggggtgtgggttccgacgtcagcagagggaggcgtttaggatttgagcagagacataagtgtcagtagcttcactgtccttgccccctgcacgcaggcctggagagggtgcctgtgccgacaccccgcctttcctcccagttagttcctgccccttggagaacagccacaccacagaaatccatctcctgaccgtctgttatcagcactgccggccatggcaaaaccatctggtcactgactgtctgggcttccagcaggagtgggtgctgccagatgtttgtcataagccctgaacccttctgaaaggcggcgtggctgctgcgagggtctgtcccacggctgttccttgtcttggcggccctcgccatccctgagatggagctggccatctctaatcacagatttccagagtcagtggtttgctgcctttgatgggtgtcctctgttctaaaagatgaaaatatggatgctggactccaggtaggagaggaagctgcaatcagggcaggaagacggaaacagagagggtggcctctgtacctggaggtgggctgtaggttaggtgggagcttgtggctggggagaggatcagatttgataagacgaggatgggctttcgggtgaagaagccagctggaaacagggaagcagaagagagagtgcgcgttgaccctgaggccagcacaaaagggcgacagccacaccgcgcaccagtcgcccagctcgaccccaggggagctctggcctgggctgcccaggaagggagactggacgagggcacgtgctcgcccagagcacagctgcagacccatcctgaagcctgccccctctggggctctcagaggatgggaagctgtggctgtgccttccctgggatgcaaagtcaggtcatgttcggacaagtcaccatgttgttgaggcagcacttacgacgttccccgctacatccgtgatggccgacctgtcttagccgccctggccactcggtgcccccaccctggagaaaacccagccgagccaggccagagctgcagacacagcaggcaggtgggctctgaagagcccctcgtgagtgcgtgtggaggagcctggggtttggggtgcaggagctcgtggatcctgcttgggagcttgcagcctgaagaccagagcttttctgagcatatctaccctcaggggtcaagaaatcggaatgggagtctcgcaaggccgggctgtccagggcaactgcaagtcccacttggctgcaaagtcccatgtctatggaagcatctgcccatagcgaaaagcggagatgtgttcacggtggtctctgtccttccccctttccatccctccctccctccctcctctctctttagaaggcctgtgttagatgtgtttcctcatcccgtaggaatggtcccctcggtcttggtgaacatgaaacaaagggtgcgggcagttgggattctgtgcgcgcggctccatcagccttgattaagttctccaagtgatgtcgggctttccaccgcgtgtcagcggtgcagagtaacctcaattaaacagtcatttgagggagagagaagggaaaacgccttccaaacaatgatctcgtgtgtcttagcaacagccaagcttcaccttctcaaagaccctcccacgccgaggacagagacacctcccgagcgagcgcactccgtgggcgctggagagcaggcactcagccactcctgcgagctgccggctttccctgcacacgctcagcctcttgatgcctgggtgctaaattacatctgacatttaatttaaatgcatggtgccttcattcaaaaataaacccgctgccacagccagggcgttcgccgcatggatttttttctttccacctgctctccctcgctgaccccatcctcactttgtccagtgcgcgcaaactggaattgagcctgtctctctcctcgggatattgccttgtgccccccatccacgagcttcccttcacatgtcagcatgtctccagttgcaatttataaccgagaaagaaatcaatcccttggtcctgcggctgcaggtccccccagcctactactgggcgtcgggagcctcctcggccccacagctcacagcagctccccgccaggatctgggaggttttcccagagttgggcaggacgctcactggtgaggaggctctttagagcccacggtcgagtagccctttctagagaagctaaagatgcggccagaaggttccacggcctaccagcgagccctggctcgtccaggaagatcggccgatggtgccgagctggcccaccccagaatgcagctgcaccctgctccaatgccacggtgtctctgggaggcaaaccctgaggaagccatctcaggcgggctttacacccttccttccagctgtttccgaacccactgaggagctgaacgctgcggtacatttaagaatttctctctcaacagctcactgggtactcgacactggagccggagggagaggacaactgaaagcctcaggagtttgacattttgaacttttgccaaaacctatttccaaaataaactggagacactccaagaaatgccagatacaactgccatcctcgggccagccttcctagcttgcaagaactgttcactcagatattggcagggggtccctggggctgggtctccagcagctccatgttacctgccacttcctgcctctcataggtgcggaggaagcagctcacctgggtggcatcttgctgcttccccaaggagctggcagcaggctgggacattcctgtgcagtagtagcagctcatcctctacgcctcactccctacatccggccagcctcattgccgtgggggaagccaagacccagagatttgattgttttgatcgtttggccaaaaccacacaacaagaaacaagagaaagaacattggtagggctgcttccaaaactcatccttttttctctaaatcgagcattctctaaaagatgatataataaaaattatgaacaacaagcaaccaaccagtaaaatacacattacgaagaaggatcaggaccacgtgctatgttgcaggcctgagtatgcatgccaagcagaagggccacaagcaaaagagccctcagaatcccctggggagcccacagcacagagaagcaggcctcagagtcacccgaacagtctacagctcagggacacaggcctcagaatcacgtgaacagcccacagctcggggacacaggcctcagaatcacccggacaccccacagctcagagatgcaggcctcagaatcacccagacaccccacagcgcagggacacaggcctcagaatcacctcaacagcccacagctcagggacgcaggcctcaaaatcacccaggcaccccacagctgagggacgcaggcctcagaatcacccacacaccccgcagctcagggacgcaggcctcagaatcacccgggcagctcacagctcagggacacaggcctcagaatcaccctgacaccccgcagctcagggacgcaggcctcagaatcacccggacaccccacagctcagagacacaggccgcagaatcactcagacaccccacagctcacagccgcaggcttcagaatcacccagacaccccgcagctcagggacacaggcctcagaatcacctcaacagcccgcagctcagggacgcaggcctcagaatcacccagacaacccacagctcagggacacaggccacagaatcacctcaacagcctgtagctcagggacgcaggcctcagaatcacccggacaccccacagctcagggacacaggccacagaatcacctcaacagcctgtagctcagggacgcaggcctcagaatcacccagacaccccgcacctcagggacgcaggcctcagaatcacccgggcagttcacagctcagggacgcacgcctcagaatcacctcaacagcccacagctcagggacgcaggcctcagaatcacccggacagcccagagctcagggacacaggcctcagaatcacctcaacagcccacagctcagggacgcaggcctcagaatcacctcaacagcccacagctcagggacgcaggcctcagaatcacccggacagcccacagctcagggacgcaggcctcagaatcacctcaacagcccacagctcagggacgcaggcctcagaatcacccggacagcccagagctcagggacacaggcctcagaatcacctcaacagcccacagctcagggacgcaggcctcagaatcacctcaacagcccacagctcagggacgcaggcctcagaatcacccggacagcccacagctcagggacacaggcctcagaatcacctcaacagcccacagctcagggacgcaggcctcagaatcacctcaacagcccacagctcagggacgcaggcctcagaatcacccggacagcccacagctcagggacgcaggcctcagaatcacctcaacagcccacagctcatagacgcaggcctcacaatcacctgaacagcccacagctcagggacgcaggcatcagaatcacgtcaacagcccacagctcagggacgcagacctcagaatcacccagacaccccagagctcagggacgcaggcctcagaatcacccggacaccccacagctcagagacgcagacctaagaatcacccagacactccgcagctcagggacgcaggcctcagaatcacccagacaccccacagctcagggacacaggcctcagaattaccgagaaaccccgcagctcagggacgcaggcctcaaaatcacccaggcagctcacagctcagggacgcaggcctcagaattgcccggacacccctctgctcagagatgcaggcctcagaatcccccagacaccccacagctcagggacgcaggcctcagaatcacccgggcagctcctacctcagggacgcaggcctcagaattacctcaacagctcacagctcagggacgcaggcctcagaatctcccagacaccctacagctcagagacgcaggggtcagaatcacccagacaccagacagctcagggacgcaggcctcagaatcacctcaacagcccacagctgagagacgcaggcctcagaatcacccggacagcccagagctcagggacgcaggcctcagaatcacccggacaccccacagctcagagacgcaggcctcagaatcacctcaacagcctgcagctcagggacacaggcctcacaatcgcccggacaccccacacctcagggacgcaggcctcagaatcacccggacaccccacagctcagggacgcaggcctcagaatcacccggacagcccaaagctcagggacgcaggcctcagaatcacctcaacagcccacagctcagggacgcaggcctcagaatcacccggacagcccagagctcagagatgcaggcctcagaatcacctcaacagcccacagctgagagacgcaggcctcagaatcacctcaacagcccacagctcagggacgcaggcctcagaatcacccgcacaccccacagctcagagacgcaggcctcagaatcacccggacaccccacagctcagagacgcaggcctcagaatcacctcaacagcccacagctcagggacgcaggcctcagaatcacccgcacaccccacagctcagggacgcaggcctcagaatcacgcggacaccccacagctcagggacgcaggcctcagaatcacccggacagcccaaagctcagggacgcaggcctcagaatcacctcaacagcccacagctcagggacgcaggcctcagaatcacccggacaccccacagctcagggacgcaggcctcagaatcacccggacaccccacagctcagagacgcaggcctcagaatcacccggacaccccacagctcagagacgcaggcctcagaatcacctcaacagcccacagctcagggacgcaggcctcagaatcacccgcacaccccacagctcagggacgcaggcctcagaatcacctcaacagcccacagctcagggacacaggcctcagaatcgcctcaacagcccacagctcagagatgcaggcctcagaatcacccggacaccccacagctcagggacgcaggcctcagaatcacctcaacagcccacagctcagggacacaggcctcagaatcgcctcaacagcccacagctgagagacgcaggcctcagaatcacccggacagcccagagctcagggacgcaggcctcagaatcacctcaacagcccacagctcagggacacaggcctcagaatcacctcaactgcccgcagctcagggatgcaggcctcaacacatgcggattcccacactgcctcaccatccccctcaactgctcagcagaccaggcagctgaacggaagagatctgcctttaatgggcatcttctgctctagaaactgctgaggactgtgggtgcagggcagtcccgtgatctccatactcagggccccgtgaagactgtggggtgtatagaggcccgtgatctctatgctgttggcaccgtgaggactgtggggtgtatggaggcccgtgatctccacgcccttggccccgtgaggactgtggggtgtagggagtcccgtgatcacactcagggccccgtgtggactgtggggtgcagggagtcccgtgatctccttgctcagggccccgtgagtactgtagggtgtagggagtcccgtgatctccacactcagggctccgtgtggactgtggggtgcggggagtcccgtgatctccttgctcagggccccgtgaggactgtgggttgtagggaatcccatgatctccttgctcagggccccgtgaggactgtagggtctaggggaggcccatgatctccatgctcttggccccatgtggactgtggagtgtagggaggcccatgatctccatgctcagggtcccatgaggactgtggggtctaggggaggcccgtgatcttcatgctcagggtcccatgaggactgtggggtgtagggaggcccatgatctccatgctcttggccctgtgaggactgtggggtgtagggaggactgtggggtgtagggagtcctgtgatctccacactcagggccctgtgaggactgtggggtgcagggagtcctgtgatctccacactcagggccctgtgaggactgtggggtgcaggggaggcctgtgatctccacactcaaggccctgtatggactatggtgtgtagggagtcctgtgatctccatgtttgtggcgtgcgtgctgagtgcatcctgcagccagagaaggagctttgtgatggtcaaatcagggcgtgcgtcaaacatgttaggtttcatttaccgactgcctggaaatgggtaggaaccagatcgttgggtggtctttgctgctgtatcagcttcctcttgggtgagcgttttgctttatccacacggttctggagcctacaaaagatgctgacatttgagagcaaagcagcggcctccagcctgccctgcagatgctggcaccctcactcagcctctgcccagtgtcccagacgttttggggagataaatatcaggactgaggtgcaaatggaggggagaagagaggtgagcattgtcggaggagcccagcattgtgcagcctgccctctcccccagcctgcctccctgagcctgccctgtccctgagcctgcctcccacagcctgtcctctcccccaacctgcctcccgcagcctgtcctctcccccatgcctgcctcccgcagaccacccccggctctcagccttgcgttcgtctggagcaatgtttacagtgagagggtggacgagtccgtgcagaagcttctcatccagcagatcactggctggatctgtgatgacctgggctgagacatacacagaaggacctgggcagggccccaggagctctagggtctgcccaggggccaccgttgctgactgtacgagctccacctctttcatcctcatttcttcccctgagaaatgctggggtggccactcctggagctgtctcggtctataaatcttagctccgtgcaaggggagcatcgtgacccaacccagatgcggtggcatagggactcagaggcgcctctcagacacccgtagtcctcgtaaggaaggtgccgcctggaaggggacccacatttcatggaggcagaagtgaggggtggtggggagtgaggtgacacgcctcagggcccctcagagatgccgggggactggggtgcggctgaagtgaacacccaggggctgagggaagccccgagtcgtttggtaagaggcctttgaacccattctgttgctttttcatcagcctggatgtgcctgagtgatgaggacagtggggatctgtggcttcccctccacctcactcagtgtccaccaggcagacagacctgtccttgggggcccttccacatcctccgtcttctgcacacgttctgatggtactgaagtgcctcacacatttaaacatgaaaacagcagactcttactactttctaaaattcaaaagcagacccaatctcatatcttaaattgaggttctagatggctactatattatacctctatttgtgttttaaaccaagaattattttaaattttttaatattaaaatggaattctgagcatgctcaccagagccatttattcttcccagagcagattccatcgttgtgtaatggacggcacatcacggcccgatgctgggatgggaggcttgggtctgttgaacgggcgccaggtcgggtccccagttcctatcaccttaggtgacgttccagcctcttccacttgtttgagtttcaggctccttgaatctccttcgatgtctgggagagctgctgtgttcaccccgttgaggccagctgacccccagcccaccccagcatcacggcttctgtgccctccatgcctggaccacctcgcgcccgcttgtttacgctctgattcctccatggtcttgctgtacccagtaacctagcacgtagtagcacctcaggaaacatgtgttgaattaggacttcccataaaaacagaaagcatgaaggggatccagatggtgtcaagcattagctcttctaagctgcgtcagagtcgtgccccggagcacgtctcctgcagcagcatcgccccgtcacggcaccgcctcacagctcccaccacgacacatgcaacgtgcaaagaggacacagggagctgcgacttccgtggctggtggcaaagaaatggggcagcactttcacagccatgccaggaacctaattcagccaacctggaaataactatcccagccacggccttgccagaagcccagctcagccaacctggagattgttatcccagccacagccttgccgagagcccaactcagccaacccagagatagctatcccagccacggacttgccagaagcccagctcagccaacctggagatcgttaccccagccatggccttgccaggaacctaactcagccaacccggagatagctatcccagccatggcttgccaggagcccaactcagccaacctggagatagctatcccagccatggcttgccaggagcccaactcagccaacctggaaattgttatcccagccacaagtgtgggtcccacttaaatggaggaaggatgagtcacaaaagcagggtaatgtggcctatcccgtgcctgtatcgctggcaggtgggaagcctaattcttaggccctaagcatagcccgccgcaccgattgcaggctggtcccaccgtgagcagacagcactcctggctccactccacagcttagccaggaggattcaggcaggtccaagcccattaccagacctcgctgtggaaggcggctgacattcgaacccactggatgggcatctaagtctctgacctttgctgatggtcggttcccagagctgcctcccctgccctcaccccaagagacctcctgacctgtgagtatctctagaactctccagaagtcagatgcagggagctgcccaggctcagtgagtggtccgttcattacaaggttctctccaccacagataacacaagcacagcctggctcagtgagtggtccattcattacaaggttctcttcaccacagataacacaagcacagccttagcacagagcattgggttggatcatgcatcacgttcatgcaataccgaagcattttcaagacagattaaactgagtagtgggatggtcctcttccttggctacttatgagtatttaatatcaatactttggaattacaagcaaaaggtattaggaagaagaaactaagctccaagttggtatcatctcactgagactgtgtctttctgcccaatgtgtcaagctcatgaataaaagatcaagaggacagttaaggggttatgtgaggagttcaaagctcaaacaaagaacagcaacagacagcagacacacatcttgagatggagttggtgctgctcaggcgaacagtcccccaccctagattctgggtgtgcttggagcttctcaccctcgtggggtacacgcatctgcagatggcttcacctccaaaatgctgccctgccatccacattcatcgtttactccagcaatcagcaaacctagatacccacttctggaaaaaaaaaaaaaaacagaagtcagctcatcaagtagtctctctgtacctctaaaactgttcaatgaataaataccctcacaatctcaaaggaatattttctgtcctacttgtatccaagtaactgaatttacttccttcttccttttcaaaaatctctggagactgccccgtctaaatacagttaagtagctggttaccccagtcacctgtttaaaaacatctggagactgcccatctaaatacaggtaaataacgcgttaccccagtcacctgttctccatctacatatgcaaaagccctcgataactttggcccttttgatgctcaaatcagtgaccacattcacatgagttacaggtgattggaaaaagcctagttgtaagcattgagcacactcagtcaccgtagagagatacatctagaagggaatcgtgctggattatttaggtgtttgtcaacacagggccagaccatccacacagaaagagcgctggtcagattgttggtccctgccacacccgactgcacacattcatttattggttcgtcgttgacacaacttctgcaatctgatggagaatgcaaagatgaaccagacatagagctggccctcaaggaccccaagtctaagaggaaagatgagcagagaagtaactgagctaggagttaaaaatgccggggacatgaagagcaaagctgagagaggacagaagcccaggagatgccaggtgcagtgtccacaacatccttcttcccaagggccacagagactatggtttggccaaacagttgtccccttcttccctcatagcttagaggactccacgtacaaccagtaaaactgacctcccagagggaggagagccactgaatcgtgcatgggtcatgtggacgggtcttgcttcttcctgcaaatgtccagagagaggtgaggaagagagcgtctccggggagggttccaggagggactgattcttgaagtggttttgatggaggagaagcatcctagacaagatgaacagcgttagcaaacacacggggaagggatgatggggctctaggtgccgaagagccttcagtgggggactaagagcaggccgggcacccatgggagggaggtccacaggcaatgccttccttcaccaattctcagtcttgggcttgttggccggaaacagccagcagtagtaagacacacctttcattttacttactaaagatatgttgcaatcagtagtcattatcaattgataattgattggcaagtcattttaaaaagtgaggaaatcaagtcccaggaaaggtgctggagccaggctcttttccatagggctggtggacagggcctttgccgtcatggagcctgtggaaggaggcgtggggtggctccgactgtgagttagaagcacctttggcctccaaatcacatgagcatcatctccccccttcccttgttgctcgtttcagtagcatctgaaatggagagtttatttgattattttttcctctctgacaaagtaaatagggttttaacctgtggtacagagggaacaaagtggcccatgggttttccaataatattttggcccttgctcaggctaatgggaactttcaaaaaggcggggagagagagcggctctaattataatctgaagaacgaatctgcttacaaatccatcagaacttgattcctgggatcccgtgggccaggggcactgaggtgattccgaggcttgctggaaagaagccagtgcccatcgggatgggattctccaccctctcattagctcgtggattgtttaaaagaaaaagcattgattaggagcctctgagaagctcccgccactccttggagccctctctggggaaagacgacaatatttcagttgctctgtgtgtttcccctgccctgggcactacccacccccaacccaggtgatggccatggcagcatgaagtcaccccgtggacagagggagacagggttccggagctggtcaggctcccgcgttgccgtggacggagggagacggggttccggagctggtgaggctccccctgccttgccgtggatggagggagacgatgttccggagctggtcaggctcccgcgttgccgtggacggagggagacgatgttccggagctgaagccgaagcaatttgaccttgctggttctctggtggcttttctgagtctgggtcattgataggttagtgttctgtgccctacaggaacctgatccaccaaggaaagtgttaaatttaacaatgtatacataataacaaatctgcatctgggcaatggcattaaggtagctcaccatatacaaagcaaagtgggtgtatgtgtacaacacggttaaataaagtgataaaaggcatatggaggaaggggtcctgctggccgaatcagcaataaaaaagcacaatataatgtacagttaaacccatgtagatataaaaaaattaatgaaaagatccagctgtgctaaaagtggaaactccatacagtcccagtgattccgctctccctgaaccctggctggctctggcttctggaagaggaagaggtcagaggaaagctgctctgtcttgctggggagccatgcgtgagcacgcagagggggtggaatgagcggcccaggagctcaggcctccttgcggtcaccttgggaggtgtcctgttctctgccgtcagaaccaaagcacatccatcttggagtgtcccaaaaacacagtatggtgaccccagggctgatctgtgtgcaagatgactgaaattagcatctgccataatttggtatttgattccataacaaccttgtctggtcacacctggggagaaagagctctccaagagtcccagatggcagttggcattgagttgacctcggggcagctgaaggcacaggtgtcactctgcctgtatggtgaccgtcagaactcaggacggctcttctcacaacactccaagatactaccctcaatttcttgctggcactttaacattttttacaggagaccatcttttcctcccctcatagacgaataagctacaacgaaggtgcccctgggccgcaaacccatctccaaaggctgcgagactctggaggcagatgccggggtgagagagtagtcaggaagaagaggcattttaccagtttccctcggctgtcccagccaacatcacatctgctgctgcttatatttgtgtccagctgctgttatgtgggtaattcaggggcaattcagaggcatgaagtttcagacgagactgagagccatggagtttgctttaatctccggaacatggaggattaaccgtgtgaccttgggtgagtcccccccggctgtggctcttcatgtctgcagtgggttttagagaaaggcctgtctccctatgtcacagagatttgggaacaagaaatgaaaactgatgcagaaaccactcaaagctccttggaataaagatactatctgaattgcaggagcctatgaagaaaacccctaatgcgaagttaaatcttaaaatcaaatccttccaggtgctctgtctcctgggctgcacccctctctcctgactcttttccatcttcctccaaaccaaagtcgctggggatgtgtgggtggctggtgggacagccctaatttgacctgtgagcatcctaaggacatgatgcccctaccccttcatggaactagaaataatacatacaaaaccctaaaacacgtgtccagaaacagcacggagctctgaaataatacatacaaaaccctaaaacaagcacgtatccagaaacaacagcacagagctctgatttctcctgtgatgagccgtgatgacgacttcaatgcctaaaatgtcaaatatcgagtgattttattcaaaatgaaaaaacatggattttgtcctaagcgtcagctcagtctgcatgtgagtgaccagccgctggctgcaccacaaacaacccgggaccagcaccggcagcctgcgtccctcccacccacctctcggataaggctcccatcagagaggagcctccagaggctgagaaacttcacaggatgccaaatgcttccatgagtccctggtcttgaccctgccctcctcccttcgctcctctgctgatgaacttcacgccagtatcaggctctcaatcccgctccccagcacctccctcccctctggggcgcctccttcccggtggtgggagagatgtcgaattcagacgccaggaatgttgaaatgtcagccttcccagagcacacagatacgtccccctgggtcacgtggagcttattgtgtacggccacattcctgttgattctcagctgcctgtgagatccttattctaatagatgtttcaaaagaagtataataccgagaggccttaatagtgtttaaaagtgaaactttcatgacaagatataatttcaaaataacagctctccacaggaacagtgaggccctttggggcaccaggagatggatgagaagagaggaggggtgagtggcagagccctctcttctgacccaggcattcccgggagcctctgtccctgctgctgcaggtctggccaaggcagcaagagcccctcggagcctcctcccccgcccagacaccaggtcctccccgcatcgggggtggtatttgcagattaacgcacagcatcctaattcctagtcaggctcttccagaccttctaagccggccttgtggccttggtggctggcgccccagccggcacccacgatgctgtaaatgctcccgaggaccagggcccttcctctgtggaggggctgccacgcccaggccccattctggggaaagcaaacccctccctgtaggggaacactctggagctcaactcaggaccgtgagtacgaatgggagcgcctgggcccagagaagccaggccaggggatgggaacttgctgctgcgtcctcgcctcaggggataaccagggaagctcagccctcctgcctgcgccccctgcccgggcacaacgcttagcttccactggaggtgaggctgcccggccagagagcaccatgctcctgcatgtagggctcactcacagcacacgtgccctccaagcccagcgcactcagactcccagatcaggttgaggtcgtgctgaggctcagcgaacagagcctccaaaccacggacacaggaacactgctgggggccgcgtccacacaggccccagtctggggcgagcttgggcttctcagccctcagacaggagagtgagctcgccaggccgtctggtgaaggaagacgcatgaagataaaatcggggagcaacgtggcgtgtgtaccgaagcttcatgaaatacatgtcaaattaactttttaaatgaatgtgtgaaataaatacagctgcaaccaggacgtagttcacttctgtttatccaagacgcctggtgtgatttcttgctggggtttcttcttactgagaagatgcattgcccccgggagactcgggaagcctctgcaaagggcacctgaagcaggagcacatttactctaccctttaaaaatgtcatccccatcccaccaggacggagaggagcttttcatttgtagagggaaactgttaccccttggctccaaaaccaatatgtgtccagccgggcactggtgggattgtacctcctctgattttttcactcaacatggagggacctgcatgtaagatgtaggtgagcgccgtccacgaaagagcaggagacacgagactccgtggccaggggcggacaccaagcctcccacactaagacaagcactggccatgctccccaagccgtctgcgtgcatctgtgtgtaagtcatcacgggtggccgtgcccaggaccacagactgggtgcattaaactgcaggacacgtctgttctcacagctctgacagtcccagaccaagctgtggggggcggcgggggtgggggcggttcttcctgtgacctctctcccgggcttgtggacagcatcttctccccatgtcctcacacggcctttccctggtgcaggcacggggtgtctctcactcttcttgtaaggacaccagtcctgtaggatcggggccgcccttttggcctcattgaaccttaattagctccttggaggtcctgtctccaaatataggcacatggggatcagagcttcaatggatggatttggggggtcacaattcagcctataacaacctctaaaactgcaaggccagagttaaaccctgaatctcgcccagatttaagcctggaacacagaggccttctggctaagagcagcctcctttgaatggtggtgggaaagggaaggttctcgggctggtgtgatcgggtgatgtatccccagccagagatgcttggggctaccagtggtgaagctagggcagcgggtgccggcctcgcccaggcaggaccaggacacatgctctgctccagggcatgagatccaaggtgggtgtttgggaacggggcccacccaccggccgtctctgacccttctttgaagcctgtctgtcacgtcaccttcagctcagaaagggcctggagaatcttggggcagcttctcttccaggtggcttgaggcatgtgccgatcgctatcaacacaccgggaattcagagcccacccagcctcacgggggcctcctttcccgagaaggtactcagccactgcctgccaggaggacggggaccaaaggcgcccacctgctccccacatttgcggagcgtctcccacaaacaacactgagagtgtcactaaagaaagcgcctgccccgaggagtttagaatccagccaaggaggcgagtcatgttctgtcatttaatgtgttttgatgccattcaaccccttcatatttttaacaatatgttaagtagacttccatttattttagccccagctgccttttgagaaagctcaattacttttgaacaacctaatcatttccaaagggcagcttcaaaccctcattttctaaagcagctcagcagccctccaccttcctgggccgctgcacacagttgagtgtggacgcagataagatgcaggtcaccagcaaagtcagatgcactcctggccgctctctgatgacttggagctcaggatggacaccatacagtcagagatggctgcacccagctgggtccacaggcatagtcagtgggactgctttaccaaagggactcatcaggttagtccaaaaacaatacattcgatggatcttcccaccaaattcacgcaagagttgcttgagtgtctgttgggtcaaaatggccaatgtggctgtgcacatgaacacggagcttcgccggccgaaccacgggagcaacacaggactgtggccacaggagccgtgttcagctgagcacacggcgctccccagcaggtctgggagacaggtccaccaggccaggtgctctcggtgccagcggcaccactaaccgtcctgctgcagttggcatcacagccagaatttgtttggggagatgggactcctgcatcgaggcagttagcggctgctatttaataatctcagatgtgtgtgcgcgtttcctccatagcaacttgcctcccacgtcgacatcaatattggaaaacgcaggcacatggccgagcgccaggtcctggtgtgggtttgcctctggctggctgccctgctggtcccgggttcatccatgacacgggtgggactgaatgtgggatccccaggacccttacagttccaggttattgtaacagttttgtgttatcatttcgaagccaaatgagaatggcttgaccccagatgtaagtacagccttgtaacgcttcagtaagatgggagcagagttaagaatagagactgtttatttggggcgtctcggctgaatcaccatttagtcactgggatgttgctaaaatatttgtacatctctggggctggaagatgttgaaattgtttctttgcctgcctttttccatccattacaaacccaaagagctgaaatttaccttaaaggtagactcattatattcaagcatgcttgctcctgaaggtgtgtataaatcttgtttgaaaagctgaattgggttttcctggaacaaacattgacagtacctaccctggaagcctatgactgtgctgggtgcatggaatggaaaagagtaactgcgctgggtgcatgggacggaagagtaactgcactgggcgcatgggacggaagactgcactgggcacatgggacggaagagtgtgctgggagcatggggtggaagagtaactgtgctgggcgcatgggacggaaaagagtaactgtgctgggtgcatggggtggaaaagagtaactgtgctgggcgcctgggacgggaaagggtaactgtgctgggcgcatgggacgggaaagggtaactgtgctgggtgcatgggacggaaaagggtaactgtgctgggcgcatgggacgggaaagggtaactgtgctgggcgcatgggacggaaaagggtaactgtgctgggcgcatgggacgggaaagggtaactgtgctgggcgcatgggacgggaaagggtaactgtgctgggcgcctgggacggaaaagggtaactgtgctgggcgcatgggacggaaaagagtaactgtgctgggcgcatgggacggaagagtaactgtgctgggcgcgtgggacggaaaagagtaactgtgctgggcgcgtgggacgggaaagggtaactgtgctgggcgcctgggacgggaaagggtaactgtgctgggcgcatgggacgggaaagggtaactgtgctgggcgcatgggacgggaaagggtaactgtgctgggcgcatgggacgggaaagggtaactgtgctgggcgcatgggacgggaaagggtaactgtgctgggcgcatgggacgggaaagggtaactgtgctgggcgcatgggacggcaaagagtaactgtgctgggcgcatgggacggcaaagagtaactgtgctgggcgcatgggacggaaaagagtaactgtgctgggcgcatggggcggaaaagagtaactgtgctgggcgcatgggacggaaaagagtaactgtgctgggcgcatggggtggaagggtaactgtgctgggcgcatgggacggaaaagagtaactgtgctgggcgcatgggacggaaaagagtaactgtgctgggcgcgtgggacgggaaagggtaactgtgctgggcgcatgggacggaagagtaactgtgctgggcgcgtgggacggaaaagagtaactgtgctgggcgcgtgggacgggaaagggtaactgtgctgggcgcatgggacgggaaagggtaactgtgctgggcgcctgggacgggaaagagtaactgtgctgggcgcctgggacgggaaagagtaactgtgctgggcgcatgggacggaagagtaactgtgctgggcgcgtgggacggaaaagggtaactgtgctgggcgcgtgggacgggaaagggtaactgtgctgggcgcctgggacgggaaagggtaactgtgctgggcgcatgggacgggaaagggtaactgtgctgggcgcatgggacgggaaagggtaactgtgctgggcgcatgggacgggaaagagtaactgtgctgggcgcatgggacggaaaagagtaactgtgctgggcgcgtgggacgggaaagggtaactgtgctgggcgcgtgggacggaagagtaactgtgctgggcgcgtgggacggaaaagagtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcatgggacgggaaagggtaactgtgctgggcgcatgggacggaaaagggtaactgtgctgggcgcatggggcggaaaagggtaactgtgctgggcgcatggggcggaaaagggtaactgtgctgggcgcgtggggtggaaaagggtaactgtgctgggcgtgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagagtaactgtgctgggcgcgtggggcggaaaagggtaactgtgctgggcgcatgggacgggaaagggtaactgtgctgggcgcatggggcggaaaagagtaactgtgctgggcgcgtgggacgggaaagggtaactgtgctgggcgcatggggtggaaaagagtaactgtgctgggccatggggcggaaaagggtaactgtgctgggccatgggacgggaaagggtaactgtgctgggcgcatgggacgggaaagggtaactgtgctgggcgcatgggacgggaaagggtaactgtgctgggcgcatgggacgggaaagagtaactgtgctgggcgcatggggcggaaaagagtaactgtgctgggcgcatggggcggaaaagggtaactgtgctgggcgcatggggcggaaaagggtaactgtgctgggcgcatggggtggaaaagagtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcgtgggacgggaaagggtaactgtgctgggcgcatggggtggaaaagagtaactgtgctgggcgcatgggacgggaaagggtaactgtgctgggcgcatgggacgggaaagggtaactgtgctgggcgcatgggacgggaaagggtaactgtgctgggcgcgtgggaaggaagagtaacacaggccctgtccccagggagacctctggacttacttatttgttctgtccatgggttttgtactgaatgtctgccatatgccagatacggttctagtcaccgcagagttcacattatgagcaggcagttgtcacacgatgcaactaggctgtaacagggctttctgcctggtgcagaccttcaggaaggcacctcgattaccttcctcggaactcagggtgggcttggcagagcagctgatatgcgggcaaggttttgcatgctaagaagtgatttgacaactggacgaggttagcaggagcttctcagtgggggcagcgcagaggtgaagtcgtaaaggagcctgctgtcctaaggctgctgggaactgcagggggtttacttgaatgagacaggaccccctcgtccagggctgggagttcaggagaccacgtgtggcacctccattttctcttcagagcaggacgtgagctcacctgccacaaaagagggggcattgggtggggagttggggagaaggggaaagtcctagtgcagtccccatgaggaatgagagagagaacaagcggaagagctgccaggtccctggcgggagccacgccgaggtcagagccctcccctgtggcttgcatgtctccgccatgtgcccaggcggggagcagccccggggccacagaacgcctctgtagcggggaagtgttgggagggccggctctgtcccctaggcgggccgtgcactgttttaaagaccccactgtggtcatcatcacctcctaactataccgtgtacaattccacttggtcatacccttcatcgtgaagcaatctcactgcattttaagagaggttgaagcattttgacaacctcagtaatgggattttggcagatggagggggaaatggcccagcctttattttcagttgtgccatacaggagggcaaccgctgtcacccctggggcaccacctcggccaggcgtgcgacctcttgcccaggaaccccagaaagggggctcaggggcttaagctgctttcaaatgtctgccgcttgcgacaccctcctctgttttggctcctcatcctcgtttttctagaagaggaaaggacagtagccacatttcaaaaaacagttccaggaagtttactttgtctggcgtagaagacgagccttaaagccagacacagttaaagagcaactctgattccaggacatgtgtccagccacagtgacacagcttcaccccgagtgcccgggggggggcaggggtggtggcctgagtgggactcaggtgccatccccaggggtctcagaacccagaattgccaggctctgtccctacttggttaaaattttatgcgaatgtggactttaccctataagcccatatcgttattgtataaaaatcattttctctaaatcttccaatgaaagtgaccctcgagcacaatgggccatgtctatcttgtggtttctgctccctggagagaagaatgccctgttcctggcccactgaatccaatgctggactcctccgagtcacactcacagacacacgtggatcaggtttaatctaaacacctgtggcccagtcaaatggacggtccttccctcatccgcctgccgctccccgtcctccacgtggccagcaggtggcccttatgggtgtggtgcagtcactacctgggcaccatctctgccaggcgtgagacctcagccctcttcctgggtcctttccagcacatgggctctcagcgtcctcaccctagcgaccctcccaggacctccctgcaggactgggtcaggaccaggaagccctcggaccccaggatggccctttgcaggtctcaggcactgcagagctccttttgcaagctctgatgttgtttgatggtgtccggctcaccagaggctccactcggacagcaccagcacagtgcccacctgccttcggggaactttgcattttagcagcggaaacatttcctcaaagagaagtcttcccaggagtccctatgcacggagctgctgaagatggagctgtccacgggagcagagtggggggtccgggacctgaaggcatccagccctccagagcccagggttccagccaccgcacagactccagccactgtgctcaagacagctcatgggttcccacctgcctcccaaaacaaatctgggccaagtggattagagttttaaattcattcttttttaaaaatacatgaagattcaaagatgggcagatgcagaaaatgaaatactctatattgtatttaataggaattctgtccaaaaaaaaaaacagagatgggtatatcaaagcaattatcaacttctgcatcttttctgttttcctccccgactattttcaaaggcccggtatcagcccagattcccattgtctgtgtccagacaacgaccgacctctgtgtgactggatcacgtgagccaaactcccctggccccgggtcagcgccgtctccctcgaggctgtttcctggtctccttgggacatttatgaggagagctgattaaggtggtgccactcctggacccagagaaagagttcttcatgcctgggctcagtggggctcatggaagtctcttctgggggatttgaggttctggtctgggattgggaattcattcctttttgttccaatttcattaacctcatataagaagcaggtaaaagcaatttatgcaaatccttttttcaatagtctaagacattttaccttttgataatagcagccaggcaaaggaaggagccgcagacaggcaggttttgaggccccaatttaaaatctgagctacctttccccacctcttcaaaagcctttctgtggataagttaagagtgtaatcccttagtctggtacaaatgttttaagactttgtatttctaaaatccaatttgagttatccttgaactttaaagctgttttgtccactgagccaagggccccgggatgcagacaagtgtggcccagcccctcgcccccgtgaaaccccagccgccatgggcgccaggagccctgtcagaggcaggaggcaccgacgcagatgctgtgggcttgtcctttctgagaaagatcttcacgcgccttcttcccctagacggagaggcttggggtgcaacagcagcccttgctgctggccacatggggctgagggtggcctgtcaggaggctgtacaaggcatgattgcaggaagcacagtgaggagaccgcgcggcagagtcggccccatctgtgttctcctggcttcgtgggacccggacaccccaggcctccgggctgcatgtgtctgcccagctgagctgacctccttgccagaccctcgctgggtacccaccgggtaccaggtggccctcaggagcccctctgggcctccaggtgtagacgggagaggcagagcccacagacgtctgcagggtgggagctggggggcccacagatgccccatagcagaggggagggtgctcagctgggaggaggctctgagtgtggaaggatggagggtgggtttctgggcacagggcagccagagatgcagcagtgcaggccccacagactcaggggtccaagggcaggggctgctgcagcttcaggcagggccagcagcagagctggtcgcgggggtctgggctcaatcactgctcacggctcacgcctcacactttacgtgacacttctggttctctcaagcctttttctcagtaatacagaatctcatagttacgtaaacgacacaaaacagaaaatggatcgtcctaaccgtttttaggtgcacgcctcttagcattgtatgtgttcacaacgttgtgcgagcatctccaccacccatttccagaaccttccatcatcccaaactggaactctgtccccagtaaacactgacccctgttcctccccccaccccggcagcccactctaccctctgtctctgagtttgatgactccagggacctcacacaagtggaatcacacagtctgtgtcctctagtgatggcttctttcactgggcagtgtccccagggttccctgtgttgtgctgtatgtgtcctttggtgactggcttatttcactgggcacatgtcctcaggactccccatgttatgccatatgtctgcaccccctcctcttagggctggtgacatctgtcagtgtggatggaccacattttgctcctctgtccatccgtccacagatgctggccttgcatccaccctttggctgctgtcataaagttgctgtgaacctggcgtgcaaatacctcttcaagaccctgctttcagttgttctccatggacacccagacatagggctgccggctcctatgggaattccatttctaactctgaggaaccgccaccctgttctccctagctgctgcaatagcgcagtgttcccatctctctgccttctcaccagcacctgttactttctgtttttttcggtaagagtcacgcacatggcatgaggtggaattgcactgaggaatcatgcttccccaatgattttggtgacgccaagcgcctctgcctgtgcctgaggtcatttgtgtgtcttctttggagaaacatgtgttcaagtactttgtgttttctgaacgagatggttttccatcgttattgtagttgagttgtggaagtttcctacatgttctggatattaatcccccactgcaatttgattcgcaaatcttttccccctttatatgggttgtcttttcgctctctggatggtgcgctttgacgcacaaacgttttgagtgtcatcaaacccaatttatctatttttttcttttgtgcctgtgtttttggtgttatatccaggaaatcgtggccaaatccaatgtcataaaggtcttgccctgtatgttttaggtctcacatttagctctgagttcatgtatgttctggccaagtgtgcgtccagccactctgctattcgctgtgagtcagcgcacgctcgggtgggaggtgacggtctggctcactcctctgcgtgtggatatccagttttcctgggaggcgagggtctggccacactcctctgcgtgtggatatccagttctcctgggaggcgagggtatggccacactcctctgcgtgtggatatccagttctcctgggaggcgagggtctggctcattcctctgcatgtggatatccagttttcctgggaggtgagggtctggccacactcctctgcgtgtggatatccagttctcctgggaggcgagagtctggctcattcctctgcatgtggatatccagttttcctgggaggcgagagtctggctcattcctctgcatgtggatatccagttttcctgggaggtgagggtctggccacactcctctgcgtgtggatatccagttctcctgggaggcgagggtctggccacactcctctgcgtgtggatatccagttctcctgggaggcgagggtctggctcactcctctgcatgtggatatccagttctcctgggaggcgagggtctggctcactcctctgcgtgtggatatccagttctcctgggaggcgagggtctggttcactcctctgcgtgtggatatccagttctcctgggaggcgagggtctggctcactcctctgcgtgtggatatccagttctcctgggaggtgagggtctggccgcagtcctctgcgtgtggatatccagttctcctgggaggtgagggtctggctcactcctctgcatgtggatatccagttctcctgggaggcgagggtctggctcactcctctgtgtgtagatatccagttctcctgggaggcgagggtatggccacactcctctgggtgtaggtatccagttctcctgggaggcgagggtctggctcactcctctgcgtgtggatatccagttctcctgggaggtgagggtctggccgccgtcctctgcgtgtggatatccagttctcctgggaggtgagggtctggctcactcctctgcatgtggatatccagttctcctgggaggcgagggtctggctcactcctctgtgtgtagatatccagttctcctgggaggcgagggtctggccacactcctctgtgtgtagatatccagttctcctgggaggcgagggtctggccacactcctctgggtgtaggtatccagttctcctgggaggccagggtctggctcactcctctgcatgtggatatccagttctcctgggaggcgagggtctggccgcagtcctctgcgtgtggatatccagttctcctgggaggcgagggtctggctcactcctctgcgtgtagatatccagttctcccagaaccacctgttgaggaaaccgtcctttcccccacaggttttttaaaagtcagtttatttttgtttagtatgggaaaaagcaggttatttttaaggacacgagaattttatttcagatcagtacatttttaaggttataaaatttagttaatattatctttaaaatattgataatatttcaagccagatattgactctgtcccatttaacatgtaatgcatgccttttaatttactttaaatttatcatgtaagaagaagcatgattcatggaaagcagactcaacaatacacagatggtccccgcctcaggatggttggacttagtatttctcactttacagtggtgtgaaactgtactctgagtgctcacccaactacgctgttattcactttcagggcagtagtcaagaaatggcctgatatcttcagcactttatcataaacaggctttgtgagagatggtttcgcccagctgcaggcttgcatgagtgttctgagcacacgtaaggcaggctgggctgagctgtgatgctcagcaggttatatggatccagtacgtctctaacctagcacatttcgacttgcaccgggttcattgggatgtaaccccatgatgtaaccccatcatacactgaggaacctccatagtgtgtttatctgagaactgaatacatatcaaaatgtaaagtaaatttaaccaggaaattggctccaataatagacaaacaaagctttcagtgacctgatggctaatatccttacccgtttgattatagaagttttatgttcgtaattcctgttttatttgtgaattacaagagaaaatgaacagtttcaggctgctatttgtaagcaagcgtctgcaaataaatgtgtttcaggtgggggtagcctaaatgtcacgtaaaccagcgcaattcagacgggggaagcctaaattccacccacaccagcacaattcagacgagggaagcctaaattccagatacaccagcgcgattcagatgggggaagcctaaattccacccacaccagcacacttcagacgggggaagcctaaattccagatacaccagcacaattcagacgggggaagcctaaattccagatacaccagcgcgattcagacgggggaagcctaaattctacataaatcaacaggtctcaggtctctaaattccacataaattaaatcaaatttggatagattgattcccagacgttctgctctgagcgttgtgtgcagcgtggaagtctttctggcctgctgtgtatgagcgggaattggatggtggtggattcgctttggggcatggcttcattgctggcttacgtctctcacacttgctcagggtccgtgttccttccagagcttgcctttcatcagactccatctgagcaccaatttgactgcacatccctgagtaggaaaaagcctcacgtttaacatctgcagtgcatagaacttccacagtggctggcaggtcacttgggtgggatgacagcgtctccggggacaaggatggacaggtggatgggtgaagagcatgaggtgaggaaggcctgggctgtggtagagaaaggagaggagggagaaagtgcttgggaacacagccggcgagcgcagtgacatgctggtgtggggagaggggcacggggccgagagccacagtgtggagctggtttgggactggagtagaagctggttcagggagaagccgtgagctcagtgggggacaggtggccagccggggaaaggccaggggacaccaggggaggcattcagccagtgctgtgacaggagagcctgcagctcaggccaggccagaccagagctgtccccgtggacattctggtgccagagtgtgggggcagaggccaggagaggcgtcagggcaaggggacagtccgtcagggccccacattctatgttcaccacagagcagctccgctatcctcagatgctggctttctcagcttgactgtgtgagttcctctttgaaggagaatttctgaatgtgacttaattcaattttgtgcttccaacaaatcttccctcattaaaaatagctaggagaccatctgcattggtgagagtctgggtttccgggaaatggtaacgaaactctgcagttgagccagggacgcaaaatgcatcgccctgccctgctggcggtgggctgttgattcagtgacctaccaggtgccaggaacaggggtgacctcacaggtgacacagcctggccccaccaccaagcatggccccacatcgaacccgtgggagcagagccccaccctgcaccgcctcgctcacccctgccttctcccttgcctctctggatgacagactgggcccctgctgccctctactcctctctaggctgctctcccaggtgtggggaggctggcactcatgcctccttccctcctcacccctgtcccccccggctgcacctggatgctgcgataggcagtgccctgccgaggaatggagggccgcccaggcccacactcgggccacgcaggagttgcttctggcgtcaagtccacacatttcagtgcaaacgcaaagcctccaggatctgggccaagctgccactccagcttcatcttcattcactgctcgtctgcaccacccacgggagccacgcacctttcccaactgcaccgacatgggcgctgggtcccaggttctgcctcgagagcccctgcacccccgccctgcccctggccctggctccatctgacatgacatcaggaccccccctgagagaccatgtcttctgtcaggcctcccctccctggcgggatcactcccttcccaatgccaggctgcagtcagcattcgtgagcacccaaaatatgccaggcagcatatgaggcacatggcacacgtggtctcacccgtcttcccaccagccgtgaagtgggtgccacgagcctcctcgcaggtggggaggaccagggcgtggggagctgacctcacagacacgtgagggtgggggccaggggctcactgtaacctcatgacagggaccaaatgctgccagatacagacaatgtttcttggttggtggctgctccgggggtggggggcgagactgaagcgcttttgcggccgagcaccacatgtcaggctgcgcacagcacgtggtcttcgggaaaagtctgttgaatgaagtgttctcgtttgaagacacatatcccttaacccctgagcctctactctagaaggaaggaggtttagaatgctctgtaacacgatgaataaaatggaagggtctgcaaagccaccatcctccagcgggagccccaggcccctggggtgggagcaggagcacaggaggagccctaggcagaaacccggctctccagggcaggcaggtcctctcagcctctccccaaacatctgtgaggaaaccgtgctgcagccacagtgtcgagacacacacccttgccatcagccaccttcctcccatgcagcaagctcgggcacacccagtgtagaggggagctgcgactcagtggacgctgacactgggcatcggtgggaacagacagcggtgctgtggctcctgctggtgggacgctgggctcggctgacagtcaggaggcaacgcagctgtgcacatccgaagctctcgacgtgtggagatgctttggcatggacactcgtcccctgacacttcatcctaaggacacaattctttgagatgtgcaaagaatgaagtgcgtggctgttcattacaacattgctcatgatgcgaacatggcacatgaagggatgtggatgggagactttccgacgagggaagccccttgcagaccaggcacccctgacatttctgaagaagcaaatctcccttgtggatgcagcacccagagcaacactaatgggcctacaccgtgcccgttgtgtgttcttagcaggaattttctgtgccggggaacagctgtttctttctattcctttatatttttctaagacttccttttgccccgaagtcttctgttttatatctgtacctaaaataggccagagcacacacaccacggctgcatcctgagcggctgtgatagtcagctctgtggacccacgtccatcccgctgtcctgacacctccccgagcccccacacctacctccccaacatggggcctctgtcagaagtaatgagaccttcctcaactcgcgaggggctttcaccttgtcacacttaagaaacactcctgcgtcccgtgttttaggagagctagagccagtcacacggtgtcccctgcccagggctccgctgtcccagaaagactggaaatgagggtctcggctttgccacaggaatgggtgggattctgcctgtttctccatctttttgtaatttctattataaagagtgaggcacgctcaccatttgccgttatccttgaaggagtttctccccagaaagcgcttgatggagacgagggcacctgctcctggtgtgggaagaggtagctcgtggaagccacatgattcacgtgactccctcggtccccgcgtgcacacccatgcatcggtgcagccggggccgcagtgtccttggctcaggcctcctacgcagggaagcagggtcggccgctggatcacccggctgtgcagctgggatttgcccttgacccgggtgtgcaacaaggctttgtcctgtgggccgcacgcgttcccaaacacagagcaggagctgcaggaggcggagaagccagagtgacaaggtgggtttgggggtctgagggccccagaggtcggacattggaatgaccgattgcggcagccgagaaaccaagagtggctgcagtgtcaccgcggcatgatggggcgagggtagctaccaactgaacctaaggaaattcagttccatgataagccaagaagggtcaacagcgtctctcgctaacactgcagatatctggactggccccggggcctggtccctggtggtgccatgcagctgagaagaaattgctcctataagcgaatatctgacaccccagccaaaagtcttattctttcccctaaattccaaaggaatttcctctctattttccagtcgattggagtcgtttccatcggtggctgtcttaccagtgggtgatgagtctgagaaataggaaccatgtcttatttatctgtatgaccccacagcagtaactattataatgcctcagacttaaggactcaataaatattggatgactagacagaaattaattaatgaacatgctagcttcctggtaacatatgtaacatctctcttggtccacttagactgtaaattaatgagacctttgaggaatgaagaaagtacgcgggcaactgcgggaaggccggagattgcagaggctgtcttcagagaggggtctggggagctctttcagccttgtcccgcgggccgagcccactcccccggcatacagagctcctcttggaggggccctgctgatggtctggccctgctctccgggggcgctcatgccttccactgccactggctgttattctttctgccttcatgccagctggagctcccggatgccaagaactggacagcaggcacgaagttctccgcgttcccaggaggccgggatgtgcaaagggcatggccggagccgggctgtcctgacagacatgtaagcacacagaagggtggcaggtgacctttctctggagcgcatgacggcagtgctgtggccttggccttccactcccaatgggggacttcccacttctcagacctagagagaaggcctcagggtcccttgggaagcacgatctccgctccccctttaatgggtcgagaatggagacgtgagtcaggcacaaccttcagaagtcctggcacgaggggcctggaagctcaggtggggcttccgtgaccacctgcggccacacagggcccagggccagcctggacgaattgtaaagggaccctctcatggggcttcctgctcaggagaggcaggaatgggagatgtgggtttggctgcaggcctgagcaggtgttggaggacaggggccatgcactggggaacacgctcctggggagaccccctcctggagcccccagggccagagacgcctgcaggagggagaggtccagaagatggctgcccaagaaacagggcaatgtgtggggatggaggcaaggggtggggcatggcaggctacagtagcgctgccacctgcaggaggcggagaggccacagcgacaaggtgggtttgggggtctgagggccccagaggtcggacactggaaggaccgattgcggcagctgagaaaccaagagtggctgcagtgtcaccgcggacgcctggacgtgctgagactcaccccggggccatggagagtggctgcagtgtcaccgcggacgcctggacgtgctgagactcaccctggggccatggagagtggctgcagtgtcaccgcggatgcctggacatgctgagactcaccacggggccaccgagagaggctgcagtgtcacctcagatgcctggacatgctgagactcaccacagggccacggagagaggctgcagtgtcacctcagacgcctggacatgctgagactcacctcagggctgcggggcagacctggagccaggccggggactgcagggttgggaggaggaaggcgctctccaaacacgccctgtgaagccaccgtagaatcagactgtgcctccagcctgacctgtgctggccccttcctgtgagctccaggaaagtccgtgcttgaagagctcattcatgagtgccttgttttatttccttcacatgaaagcagagaacatgaattgttttaaaaatagcctctccttctacaagtcattatttgcagaaatagctgatagttcaaaaactctaaattcatttgccacgttcattcaaattgttctgatcttatcatctttcccaaatcccacatttattacagatgtatttattctttgtctcccctccctcctctatataatggtttaggagagattacaaaaggtaatttataacaggttaaaagagagacctcaccactcacagaaaaacgaagcattcccctccccagagtggagacgtggctttctggggaatgtggcccagggccctggccgcctgcccacacgcgtagaaatacatgaaatggctgcgcatgtttcagtcacttagagaaataccgaaaaatggcttcatataaacctctgaaaggtacgcggggtagcaattaatctccttccgtagtaaagagcccagctgctttggccatgatgaacatcagtctttgctcttgaaggcttcagaacaggtgtaacagggatggggcgcaggtgctggcccgcaggtcgggatgtgcctgctgcgtgccccggccaccccagccagcggtcctgcagcaaggagcagccggtgcccatacctggtgaagaggctgggttggccgctgcctggcctgagaggtgaggcgtggagctgtgtccacatgaggagacgcaagggagcgatttccatgaaggagtccatagacctccgagctctttctctgtagctcagctgaacaacgttgccaactagggagggcactggcttccgcggtcaattgcaggctcggacactcactgcaggcttagcctttgactaagtcagctgaccctgcagcacccaggtgcccacctgtgaccttgtggcgatgcatgtcccatgcaggtgctgagtgtccaagctgatgtttgcaggatacccacccgtggctcccacggcaccatcaggctgttgccccagatgtgcagttgttccctcactgggtcaccgacatgcctcttgcctccatgcactgagttcaggaccgtgaataagtgaggcttgttggacccaccaaatgtgctttttttagagatgcattttctcaaagcctcgtggatcgattttggtgatgctgtgaatgaccatctttgtgtctgtgagtccccgtgcagtgagaggtaacagcagtgttcctgcagagtctaagtggccaggcagtgttcctgcagagtctacgtggccaggcagtgttcccgcagagtctacgtggccaggcagtgttcccgcagagtctacgtggccaggcagtgttccctcagagtctacgtggccaggcagtgttcccgcagagtctacgtggccaggcagtgttcccgcagagtctacgtggccaggcagtgttcccgcagagtctacgtggccaggcagtgttcccgcagagtctacgtggccaggcagtgttcccgcagagtctacgtggccaggcagtgttcctgcagagtctacgtggccaggcagtgttcccgcagagtctgtgtgaccaggcagtgttcccgcagagtctacgtggccaggcagtgttcccgcagagtctgtgtgaccaggcagtgttcccgcagagtctacgtggccaggcagtgttccctcagagtctacgtggccaggcagtgttcctgcagagtctgtgtgaccaggcagtgttcccgcagagtctacgtggccaggcagtgttcctgcagagtctacgtggccaggcagtgttcctgcagagtctgtgtgaccaggcagtgttcccgcagagtctacgtggccaggcagtgttcctgcagagtctacgtggccaggcagtgttcctgcagagtctacgtggccaggcagtgttcctgcagagtctgtgtggccaggcagtgttcctgcagagtctgtgtgaccaggcagtgttcctgcagagtctatgtggccaggcagtgttcctgcagagtctacgtggccaggcagtgttcctgcagagtctgtgtgaccaggcagtgttcccgcagagtcttcgtggccatggcccacccaacaactgcgacttcttaggacgaggactcaggtgtatgagttcctcacagccccctttttcagcccaaggcgatgcccacagtgtcctggcaccacctcccacccccagcctgtggctgaacccaaagggatggcccgggagctgatgggtcacaggccatcccatgtcccacgtgggcttctcaaaggttttggttcccatccctagttttggggcagtggctgtctcacatggggttagggtggaaaacagctaagtcagatcagagcgtggaaccccagagctggtgtagctgtacctccaggccgcccgctgccctgctccttgccatctgtgtctccccggagcatgcagcctgcctggagtgctgccctgggtgtcttttcagagtgcaaccctgcaacctcagcacaggagtctgtctccatcttgacaggcattgctgaagatgtaagtgctcccccagaacatcggggtgtgtaggccctccacgatgtgctgcttggacggcggagaccgccgttttctcttggcagtctggcgctgagtggatttgcccaaagtcacagatcaacttgctgttgcagcaggggccggcctgtttctggagtggtttagatttgggatgatggagctatgatcagcttacaccagcgcagtgcctggcagctttagcagaagggtcattcactgaggtccagccagcagtcaacagcacttagaaaacaacaaccaagaagagtagccagcgccaagcagaaccgggggcctcccctcctctgcgagcacacagcagcctcctcatgcccttcatcccctatcactttgcctcattctgttttcctcttcttcctttatggtagcggggggactggcaccccagtgtccttgcatctgtgctggtaggttgctgaggggtttcccgcggccgccggcctgtctcccaacactccctgggcctcattcattcccaccacgaccctcctcttgggcgcacggcctggactcccgcctccagccctccccacctgtcggtatttctctcccaccctgcagggggtgcttttctcaaggccattttaagcacacatttcactcattcagagtgaagatgacacagaagccaccagattcaagtgctcagaaagcaggacaagcgcgtcgggctcagagctcttccccaggaagctggcctccaaaagcaggagacggagaatccattcaggaaaagcacatggggctgggcgccgttccctggggagctggcctcggaaagcgggagacccagaatacattcaggagaagtgatcgggcttggagccattccctggggaaatggcctcagaaagcgggagacctagaatctgctcaggagaagcgcctcaagctcagtgccgttccccagggagttggcttcagaaagcgggagacctagaatcctttcagaagcatgtcggactgggcgccgttccctggggagctggctttagaaaacgggaaacccaaaatcggctcaggagaagcacgtcggactgggcatcgttccccagggatccctgacttcagggccttttgtgccacctctgttagtgagtgtcgggattcctgcaaataccagatttctggagggtttggaatattgattttctgttgaagaaattagggtgagcattttactcaataaaaatcaggaatcacaattcctaaactcatagatttttctacagatcttaagcctccattgttattcctatagtagctcgccctggataaaatggagacatccctcaattctgccaagcagagctgccgggaaagactgaggtcgcaagcccagccctgcacagggcgaaaggaaggaccactcagactgtcctggcctgggtcaggtgccaccccacaggtagtaactcatcaaagatgcgcagtttaacggactgtactatactgacagtaaaacgaactaatctggcatccatacactgtgtctgtcaaactcagtgatgcacacaggtttaaacattgttttttatgtgttttaatttttcatagccttctaacgtgacctgtgagacgtctctgcagagttgatgccatgaggtagtgagctcacctaagaatgtcatcgtcatatagtcagcaagaataagatatagaagacgatgccttcgtggctttacacacctcaaaatgtggagctgtatcatttatgtgattcttttaagacataatcactcaattgaaagcttggagcagataatgcatcttagtagccagagcttcgcggctgccattgtatttccgctccttcgtgaaggggagcgaggcgtgctctgcagagcagcaggtgtgtgccatgtgagggctggagggcacagcccacgagagctgcttcgtggggctctcaccagttctgtggctccatgtccagaccagttctgtggctccgtgtccgtagcaaagctggatctggccacagctgtcgggaatgtctgagggattggcagagttgggaaagacgccggaataagagagttggacaaacattcagaaagggttacaggtagattgtgggaaccgcagaccagtgtgcttgccttggtccctggtgagatcctaggccgtatcagtgacggggagggagccgggcgtcacaccgtctctttgctgatggcatttcttgctgagagatggaggaacggctgttgacatcacaagtatagattttaatgatttttttttttacaaagtatccaaaagaaaagatagagacttggaacgatcatgccgttagataaatttctacctacgtacactattcttacaggctattaattaaataattacttaatgaggagaaaatagattaagtgcaaaggggttctctagaaacgtgccgtggggctattcctcaattctgttatattccacgatgttgtcaataatagaattaaagatgcgtcattgggttgagtaaacttttggaccatgcagtgctaggaggaggaggggtggatggagatgagggtctgagtaaggtctcccgctggcaccagaagagccctgcccaagtgcgaccatcagatggaaacgacctcaggggttttagagccagtgtgagtccactgtgttgctgatagcaggggatgcgcatggctcacccagaacaatcccgcccacagccacgttctgtgtggcccatgtgtgagctgcccgaggccgccctcaccaagtaccatgaacctaggggccttcaaacaacaggcgtttattctcccacagtgctgggagccagaagtctgagagcatgtctgaagctgtgctccctcctcctccagcctctgccagcacctgacagctcccagtgtccctcggcttgtggctgccccactccagtccctgcctctgtgtgtgacccgctccctgtgcacgtctgtctgtgtctgaatttccctttttttttttttttttttttttgagatggagtttcactctcacagcccaggctggagtgcaatggcgcaatcttgggtagccgcaacctccacctcctccgttcaagcaattctcctgcctcagcctcccaagtagctgagattacaggtgcccaccaccacgcctggctaatttttacattttaagtagagacggggtttcactatgttggtcaggctggtcttaaactcctgacctcaggtgatccgcccgcctcagcctcccaaagtgctgggattacaggcgtgagccaccctgcccagcctcaaatttccgtttttgatcaggacaccagtcctactggattcatggcctaccccagagacttcgtggtcacttgattacatctgtgaaggtcctttttccaagttacataacatgctgaggtcctggggttaagactcaacatatcctcttgaggggacacagtttgtactctaagagctcaatgagggttttcaaaattgagaaattttacataaataatacaaatgcctgatttctattttcttaatcaaagatctgagcaaccccagacccgcattcccagccagcagtacctgtgtgctctccccttggggtaggactggccgcccccagccacccagccccccttccacgacgcagcccctccccccactcatggtgcccccagctgcccggccccccttccaccacgcagcccctccccccactcatgtggcctgcccggccccccttccaccacgcagcccctccccccactcatggtgcccccagctgcccggccccccttccaccacgcagcccctccccccactcatgtggcctgcatggccccccagacactggaggctacagcccctgatgtctaccctgttgtggcccacgaaggatttagacacctcttaaaaggaatatatgcactaaatgaatgctgaaataacaaagtcggtagaaaatgacggccatgggagagacacatatgccccctgaggttaacccggcagaactgctgcgtcccagtgacggagaccagggtcccagggatgcagccagcttggccaccccgggggcttgtcctcaggcctaggccctgcattagacagctgcctgcaaggccagaagacaaagaggagagcaggaggtctgccggggtcaggtgggcctgaggaagggaaggagggcatggagtgtgggcggagtcctcaggtcccaggacagcctcccacgtggtgaagggccaggactcccccgggctgcaggggagcacagacaggacccgtgtgcaggtgcacaaaccggacctccggcgcgtggggctctcgcgtgtaacccggctgccccggaacctccggcgcgtggggctctcgcgtgtaacccggctgccccggaacctctggcgcgtggggctctcgcgtgtaacccggctgccccggaacctccggcgcgtggggctctcgcgtgtaacccggctgccccggaacctccggcgcgtggggctctgcgtgtaacccggctgccccggaacctccggcgcgtggggctctcgcgtgtaacccggctgccccggaacctccggcgcgtggggctctcgcgtgtaacccggctgccccggaacctccggcgcgtggggctctcgcgtgtaaccgggctgccccggaacctccggcgcgtggggctctcgcgtgtaacccggctgccccggaacctccggcgcgtggggctctcgcgtgtaacccggctgccccggaacctccggcgcgtggggctctcgcgtgtaacccggctgccccggaacctccggcgcgtggggctctcgcgtgtaacccggctgccccggaacctccggcgcgtggggctctcgcgtgtaacccggctgccccggaacctccggcgcgtggggctctcgcgtgtaacccggctgccccggaacctccggcgcgtggggctctcgcgtgtaacccggctgccccggaacccctcctgcacatgggcgggctgagggccaggcgcaagggcacctgtgcccaggcggcaggcagtaggcaccagtccatggtgggcgtacagatggcagggctgaaagggaccctaaagatcctccggaagagatgtccccccaggggacatctgggagctgtgcacggtcctgagcggcttggggtcccaggcctgtggccctcactgcacagggttcttctgcagcgggaccccgcagccatgtcactctctgccctgggaaacatcctgtgccacggggcgggggggtgggggcggttaggcagcttgggtgatttttttattgtttgtagagatggggtctcactgtgttggccacctggtctgaaactctaggcccaagtaatcctcccgcctcggcctcccaaagtgctgagattacagacatgagccaccacacctggccaagagtgagttttaatgagcacacagtcactgtcttctcacatcagaagtccgtgtgctgagaaatgaggattctctttattctggacgttccagaaagcctcgtccaaggggatcgaatggacgcaggagggagagagctcagattttagctctttgttaggttcgtataacccaagtgccctgtgggttccccttgtgtggatgcttcctgaaactgtgtcctcacggccgaccctgtgtctcaggcgagcacccttctgtgggtggtggggacacacccatgcgtccgacccccacagagccacctgggcctctgtatgcctcacgctcctctctccagcatccacggtttgcccccagctgagggctaagtgagggaaactccttcaggctcacgttgtaaggaaccactgctcccccaaaacatccctgccagagccttgtctgctcactgatgaggattctgtctctgggctttcattgtccatccttgaattccagctccccagaatatccgacttgtatgtgtaaatctctgtcccagccatccgtggatgggccgggctgagtgctctgggacttcagaagcccaggcacgccgggctgaatctgaaggcgggtgtgtggcgcagctcctggagcaggcgtgttaaaccctaagctccttcccatgtagcaggaccgcccattcctgtgggccatgtggctgcacaacgtggagcgaggtcgaagtccccatagaagacagagctggggggctcgcagggaatttctcagaggggtgcccacttgggagggaaggagggtccccggcctctgtgtcactcacttcgtgctctagatgtccgagtaacccagtggtaaatgtccactgccagtaatttcccagcacctcattctgtcccacacacctcacttaggctctcagctacccgcaggaggaccaggactgaaagaattgtcaggggtcaaaatcgtctttgtcattttcttggaaataaaagtaagcagctcatttcagacactatgcccaggaggagcttttgtccagagctgtgcatggaagggcatcgtattgatctgtggcacgtatggcctccatctcccctgatgggagtcagcagggccgctctgtgtgaccacctgtgagagcctagattaaaatcccacccagccatgggcagcacagcccccgacccaggccctctgaccaggggcctcactcccactgggagaggcagaagccacagttgtctctctcggctcgctcctctgccgcctgagggtccagactgtagtctccagccccaggtggcttcccctccccagcaggagtgtcggttcccaggtgacagttatctcttttcaaagtcggtggggtgcaggctctagtagagaagagtagctgggagagcacgttcagctctcactggtggctttcatggagccatacgtggcttgttattgaattgtgactatgaccatctcatgtttgatgtaaaggataaagaaatgatggacctgtgggtgattatagccattctttggtttatggacccgtaagtctcacggagagcattatcaatcacacagtgccgtcacggctgcgttttcatgtggaatgctgaattgctttagaatgcataaagcagggagccgcttgtgactatgcatgtgtggttttacggaagttggggcacacatgaggcctgccctggttctggtcatctcagacaggaacacggagctcatgaaccttctcagtctcaccgagagccctgggacggcccctccgtccaactctggagtaccttctgccacctgcaggtactcctgaatggccgagagccactcacaccactgcccaacctttaggatgatctggacagtccctgtggaaggaacgagtctctgtggccagctctgagtgctgcaggtcctggctgaagggtcgtgggcagatggtgatgcttgcacaagcagagagataatcgtaaggggacacagggtggcaccccgcctggaaggcagggaatggaagcaggagggaactggcaccagggagctggcagcagaggagaggatgtgcctgagcttcagaagggaaggcaacactcagaggcacacggcacggggcagaatcagagctaaaagaaagggtgcccatccgaggcaaagcacctttctccagcctcagccctggaaggccactgtcctgcttacagggacccttccttgcagagcagccagcggctggccccagcggcccaaggcagatgcacactgctaagggatgatagcatctccactttgcagtgacatttgctgaaatgagatcataaaatccacaaggactttatttttgagagttaaaactagaaatgttaactcttgtggctacttttgttttaaaagcagcataagaaatcttcctctggctgggcgcagtggctcacgcctgtaatcccagcactttgggggccaaggcgagtggatcacaaggtcaagaccatcctggctaacatggtgaaaccccgtctctactaaaaatacaaaaattagctgggcgtagtggtgcgtgcctgtaatcccaactgtaatcccaattgggattatgggaggctgaggcaggagaatcacttgaacccaggaggcggaggttgcagtgagcagagatcgtgtcactgcactccagtccagcctagtgacagagtgagactctgtctcaaaaaaaaagaaaaaaaaaggaaaaagaaatctgcctctgcctgtaatacctgccgagactgatcaagtcttccctgaagcttttaaactacagcgggttagcattgccatccctgaagggtacttagcgggcacgtatgttaactgagcttatgacatcaattcatgggaagctaatatagtgtcgactctatctccacgtgtgtggggggggtgtccatgcacgtgtgatgtgtgcttgagttggtgtttactatatgcctatgtgtgtgtgaatgtggttgtgtgtgtgctgtgtgtgtaagtatgctgggtatgtgtctgtgtgtatgtgtggtgtgtgtgtttctgtgtatgtgtgtgcgaggtacttgtctatgtgaatgtggttgtgtgtgtgcgtgtatgctgtatctgtgtgtgtttgtggtatgtgtgctgtgtataaaaggacaacccacagcactaaacctgaatctatagattcccaggtacctgcgtatcagaaaatatgttttactattaagttttctgtgtccttcatctgtctggcattctggagggatgtggtccaccttgatccggaaggcaccggggtcagattcactcagttcccggcattctggaaggatgtgttccaccttgatccagaaggcacctgggtcagatttgctcagttcccggcattctggagggatgtggtccacattgatctggaagatactggggtcagattcgctcatttgctggcaatcaggagggatgtggtcacgttgatctggaaggcactggggtcagattcacccagttcccagcattctggaaggatgtggtccacgtttatccagaaggcacctgggtcagattcactcaattcccagcattctgggggatgtgatccgcctttatccagaaggcacctgggtcagattcactcaattcccagcattctggaaggatgtggtcacgttgatctggaaggcactggggtcagattcacccagttcccagcattctggaaggatgtggtccacgtttatccagaaggcacctgggtcagattcgctcagttcccggcattctagagggatgtggtccctgttgatccggaaagcactggcatgagatttgctcagttcctaacattctggagggatgtggtccacattgatctggaaggcactggggtcacattcgcccagttcccacatcgtggagggatgtagtgcatgttgatccggaaggcactgggtcagattcactcagttcccgccatctggaggaatggggttcacgctaatccagacagcactgcgtcagattcacgcagttcccaccatctggaggaatggggttcccgctaatccagaaggcactggagtcagatttggtcagttcctggcattgggaggggtgtagtgcacattgatctggaaggtgctggggtcagatttgctcaattcccagcattctggaggaatgtggtccacgttaatccggaaggcacctgggacagattggctcagttcccggcattctagggggatgtggtccacgttgatttggaaggcactggggtgagattcactcagttcctggcattctggagggatgtggtcacattgatctggaaggcactggcgtcagattcacccagttcccagcattctggaaggatgtggtccgcctttatccagaaggcacctgggtcagattcactcaattcccagcattctgggggatgtgatccgcattgatctggaaggcacctgggtcagattcattcaattcccagcattctgggggatatggtccgcgtttatccggaaggcacctgggtcagattcactgaattcccagcattctgggggatgtgatccgcgtttatccagaaggcacctgggtcagattcactcaattcccagcattctgggggatgtgatccgcatttatctggaaggcactgaggtcagattcactcaattcccagcattctgggggatgtgatccgcattgatccggaaggcacctgggtcagattcactcaattcccagcattctgggggatgtgatccgcgttgatctggaaggcactggggtcacattcactcagttcctggcattctgggggaatgtggcccatgttgatccagaaggctctggcgtcagattcactcaattcataccctgcctcgcctcctgctgtgtgaccttaagcaggttaccttgtcactctgggcttcatttgcctgtctggaaaatggagggttttgttttgttgtgttttgttttgttttggagtctcactctgtcacccaggctggagtgcagtggtacaatctcggctcactgcaacctccacctcctgggttcaagcaattcttctgcctcagcctcctgagtagctgggactacaggcgcatgccaccatgcccagctaatttttttgtatttttagtagagacggggtttcaccatattggccaggctggtctcgaactcctgacctcgtgatccgccccctgggcctcccaaagtgctggattacaggcgtgagccaccacgcccggccaagtacaggttttaatggtgctcacctcacaggattattgtcagtttcacaaagagccttcctgcaagcatggaggttagtgctcgagcacagagttagacatttgataacagtcactgtcatttcatgagggttttttaattgtgaaaaaattgtccttagttacagacacacactctggggcttatgaagattactttaaatatttagtatatgtcaattctaagttaaaagtctgctttgcaagttacgagagcaatagaatggccgccgtaaactgcagtgaatacagatgcccctcattctgcttctgactccagtggttcctgttctgtcctggggcttcctcaggaggtgctgagaaggaaagaaagggaacacctgaggggcacctgccctccctccacgtgtgcccagaagcgaatgtggggagccaggaggtggtagggtgcccaggagagcgggagcagcatggggcagggcgggcccagccgagggtgggaccttcaggccctccattcccaagcacacacacgtggtctcttgcactcttcatcggtgatcatttttcctctttatatttgtgttacttaatcctattatctttaaggatgccttccacatttgtctgaaaacagaatttccattggcatccatgaaaaccaaggtcggagctcctagagtcaagatggtaataaaaagtagcagggcccctgagggtgtggatgccaccctgtcctgagcaccttacagccaagagctcccgggatcagttcattaagcccatgagtcaagtacattttattcccattttcagggagagaaactgaggcacagggcagtgaagccacttgcctcagtcacacagttagtggcagagcttcctctaaaccatggcagtgtatactgggcacccaatcgtgtgagtagaaacaggaatcttctaactcacagcatcagacaatctaaggaaagggattcctggtggcacctcaccccgcggaggatggcacccggagctgcagctggaaaaaacagaggccgtcagctttgggcgagtgagagcttcagagggccctgagccccacggtgatcacgcattcaaaatgtttgctgcactcagctacataaatattacagggaaagagaaagtggagggcaggggagaggcagcctcaccacagccccggagaaccagagtgaggcaaatgtagttttccgggcctcctgacctgccagtctcggaatcccaaatccagagcagcggcagaggacaagcggccgcggggagtgaggggagcgtgctgaggtgggggttggaccgcaggaaccccaccaggctggccgggaacttgcctttcacctcctgcaggtgcctctgcctggctgagaagaagttcttttgtggaagacccacgctgggtgttcccatctggttctctcctggacggcttgacgttgctagctccagtagttaccctccactgcacagcgagttatcccgaaacttagcttaacacaaccatgttttatcttacagtttctgtgggcctggggtcctggtgtggaccagctgggggttccagctgcgtccctataggctgtgctgagggtgtcctctcagctcagcagcggcagccccaggccctctgtgctgttagcccctgtccatgggccctgtccaccaggtttccccatcagccgccaccacctggcagcagacatccctcggagctcgaaagtcggtcggggaccccagtgtgcgtccttagcagccatctctgctgcctttgctgtcctccaggcatcggagtggagtcaccaggtccagtggcgctcaggaaagagaattccaggaggacggaggccctgggccgtctcagaggctgccggccacactgacatttcaagaatgagcccgttcaatttcaggatactccctttgccacaggctcagtttaggagctcttcttatttctctatttttccaaactttcgatacttccttttctccccttcatcttaatttaaggctttccacaaagagctctatcacagccccttcctaagaccggtctccaacagcagcagcttgaaaacagctattttggcccctcaggtatgaaggtcccctagtgtttcctggagacacctccttctgacctcagctccttctgagggacgcggggccagaggagagaggagcagattcggcagcgcggagcagcaggacggcgggtgtttgaaatggcacacacgcacttttctggtggcatatgttgtggtattcatttagcaaaaatccatttttaaaaccctggacctgtagactgatcaacagatgaaacagtgagctgagctgctgcctgcctttttgtgttgccagagattattatccaccatatgctggaagcctgatggtgagcctccgccccggggctctcaccaacgccgcagcacgcctgccggtggacaggagcctatggagggcactgagccagccagtgagcgtgggcaggcagccctgtgctccccactgggctgtgagaggtgcacacacctcagcttacttctctgaggggagacacccatgttcaccagcaccgaccaggctttctcataaactcagagcccgtgtcagttacaccagcacctaccaggctttctcatagttacaccagcaccgaccgggctttctcacaaaggcagagcccgcaacagttacaccaggaccgaccaggctttcttataaatgcacagcccacgtcagttacaccaggaccgaccaggctttctcataaatgcacagcccacgtcagttacaccagcacctacccggctctcttacaaacccacagcccgtgtcagttacaccaggaccgaccgggctttcacacaaaggcagagcccgcaacagttacaccaggaccgaccaggctttcttataaatgcacagcccacgtcagttacaccagcaccgaccgggctttcttataaatgcacagcccgcgtcagttacaccagcacctacccggctctcttacaaacccacagcccgcgtcagttacaccagcaccgaccgggctttcttataaatgcacagcccgcgtcagttacaccagcacctacccggctctcttacaaacccacagcccgtgtcagttacaccagcaccgaccgggctttcttataaatgcacagcccgcgtcagttacaccagcacctacccggctctcttacaaacccacagcccgtgtcagttacaccagcattgacccggctctcttataaacgcacagcccacgtcagttaagagtgagaagctttcatacctagaaccgcagtgctttgtgagtgggtcagagtgtaggataaagtctgcatggctgtggccacagaacttcgggtaggaagggtctgggggcagcgctgagtgacaggaggagacgcccctggaaggtgcatctggagctgccggagcagacaccccctggcctcttagagtgtgtgtggtagaagcacagaaatggcagtgctcacacgatgcctgtgaccacattctatggaaaatagagaataaagaccaccatctttttgaaagactgatactattattgaattactattcaaagaatagtaactattattaatattattactggggggaggcttggaggctctggcggagacccgcggagctcagactgcagagaggagtgactccaagcctgcctgagtctgtagctaagaacggagctctcccctgtgaaacatgccctcagtgtgtgggttcgcataggagcctgtgtgttgattgagattctgccactgaccagcttcggatacttcatttacctctcagtactttggttttctcatctgtaaaactggaaaaaaaaatgcatgaattccacggtttctctgggagtgaaaggaaataaaatatgggaaagtagcttgacaggatggagccgctgctgtcatgctgactagaaagtactcgcctgtctccacgtgtgcgaaagcgtgcgtgtgtgagagacagtgcatgtgcacatgcgtgaaatgatgagcagtccgtagcactcacatgttctgaaggtgagggactcagcattcgacctcaaacaaatgaaaggccccgagcccaccgctgagccagccagggttcctcgatggggagagagtgtgcaggagagggtgagggtgccctcgcggccgctgaccaggggctcctggtgtggggaaggcatgcaggggaggtctggaggcgcccctgtgtgtccttggttgatcagatgaaagggagccagcctctgatgggtgtgaggaagggttggtggaattttcagggagggacaggaagctgttccagtggacaaggtagagatggccgaggctgagggtggtggatggaggggaccagaccccaggactgcaggaggccagccgccatcagcatagggggatggggaataaggtcagataagggatgacccgaaaaaagtaatgggatctgattgtggggaggacaaaagacaaggaagcctcaagcctcaccccaaagatggacattcaggacaggctgtcgtcatggaaactgggaaacccagtggaggaaaagtaactgactctgttgcgaacgtgcttggacaagtgagcctggtttttccgcagtgtcactcagaggtgctgtctgtcttagtgctcaccatgtctggggcactactcttttgaaatggccttttcaaatgcactcttaatggtggaagtgatatttcagatttgtttcttttttaatactctaaagccatttggagacaaggacagtcaactggaggagtgatgaggttaaggtgtggagaatcacaagtgaaaaagcttagaaaacgtaagactagatttctggttttctttgggcatatttctgaagacaattccaaatgggaatttcagaaatgactgagcaaggtcgaagtaggtatatcacttcctaaagtgtgtgaatggaaacatattagggagacatatagttacatgtggcagattcatgagggttttaaaagtggtctcagtacctgacagcaccctgttgcagattatatgctaatgtgccagacttgctagaatgccagcgtgcatcccaccgcactgaccgaggacatgcggcggctccatgcagttggccacttggcagctgagggtgagtcacatggaatcctgcaccaccaatgctccgtctcagtgacagcttaccctgaacctgctccgcactgtgtcagaatgaaaagcaactgggcagggtgcggtggctcccgcctgtaattccagcactttgggaggctcaaggtgggcagaccacccgaggttgggagctcaagaacagcctggccaagatggcaaaaccctgtctttactaaaaatacaaaaaaaaattcactgggcctggtggcagacacctgtaatcccagctactggcagcagaatcatttgaacctgggtgtcggcggttggcagtgagccaggatcacgccactgcactccagcctgggtgacagagcaagactccgtctcagtaaaaagaaaaaaaagaaaagaaaagcaactggctgcttcctgaatttttgttcacattagatctaaatatgtatagacatatttgcaatataaaatcaaaaaatgtcacttgatggtgatcatttgattttccttctcagtagaatccaggtacaaaggtgagctttgtcaggctgttgctgttctttcatttaattggagcctattttcatacattaaaatatacataggcacttttcttaaagaatatgtgaacaggacatggctaagttatataattgtgaaacaaacatttacctgaattacctgaattattgttctacttttaattccaaagcaacccgaggaaaagtttccaaatattgtaatggatgtgtagtatgtaactgacaaaatatgtgaaagagattttaaacaaaaatagagatgacctggttattcttcacagaattatcttgtttcctttcatctgaacataatggcactatttagccattttcaaaaaagttagattcttgttcatgtggtaatgagtctttcttacaaacattcaatctaaggaattttagctcagttttgaaaagaatataatctagttatgaaaatacaatatatatactatactgaacatcaactattaaatacgtgccttatggcattattctgtaaataataaaatattagatctttacaaatacgttgattaaaagtaatagatcctctatactagaatctagacagtgaaaaccggattcacctctagggagactgcactgtttataagtacctgtgcttatgaacagtattttttcaaaatgctacttttaatggacaaaactaataatagtaataatgaagccttgaggctttttctattctttgaattataactttgaagtttggggaagaaaagtctaaacatcccgacatatttgtcagccaatccttcaagcagaaatgtttgctgaaacacatacttggtttataagcacgtggtttcatgtaagcatgtcaagccattggtgggatatcaagtctatctcatcattgagttcctatttttggatttcaaaagcttcagattcatcggcatatgagccagcatgagaattaataataaaagctgagttgtgttggtgatttatttttcaaaacaaaaaatgacttgcattgttctgctttaagtaaagaattcatatttttcttgaaataaagtgaaataatttgaaaaaataattttagcatttctcaattttaaaataagggcattgattttatagctatatcttacatttgcactgcttacatttgcattgcttatgttatatctaacataagcaatgtggcaaaatcttatcttaaaaatcttcccagttcatgaatttgtcctgtgggataaactctgcttccagtatgcatgggtagatggtgagggctctgccaagacccagtatgcatgggtagatggtgagggctctgctaagatccagtatgcatgggtagatggtgagggctctgccaagacccagtatgcatgagtagatggtgagggctctgccaagacccagtatgcatgagtagatggtgagggctctgccaagatccagtatgcatgggtagacagtgagggctctgcgaagacccagtatgcatgggtagatggtgagggctctgccaagatccagtatgcatgggtagacggtgagggctctgccaagatccagtatgcatgggtagacggtgagggctctgctaagacccagtatgcatgggtagacggtgagggctctgccgagatccagtatgcatgggtagacggtgagggctctactaagacccagtatgcatgggtagatggtgagggctctgccaagacccagtatgcatgggtagatggtgagggctctgccaagatccagtatgcatgggtagatggtgagggctctactaagatccagtatgcatgagtagatggtgagggctctactaagacccagtatgcatgggtagatggtgagggctctactaagatccagtatgcatgggtagatggtgagggctctactaagacccagtatgcatgggtagatggtgagggctctactaagatccagtatgcatgggtagatggtgagggctctgccaagacccagtatgcatgggtagatggtgaggaatctgccaagacacagtatgcatgggtagatggtgagggctctgccaagacccagtatgcatgggtagatggtgagggctctgccaagacccagtatgcatgggtagatggtgagggctctgccaagacccagtatgcatgggtagatggtgagggctctgccaagacccagtatgcatgggtagatggtgagggctctgccaagacccagtatgcatgggtagatggtgagggctctgccaagaaccagtatgcatgggtagatggtgagggctctgccaagacccagtatgcatgggtagacggtgagggctctgccaagacccagtatgcatgagtagacggtgagggctctgccaagacccagtatgcatgggtagacggtgagggctctgccaagacccagtatgcatgtgtagacggtgagggctctgccaagacccagtatgcatgtgtagatggtgagggctctgccaagatccagtatgcatgggtagatggtgagggctctgccaagatccagtatgcatgggtagacggtgagggctctgctaagacccagtatgcatgggtagacggtgagggctctgccaagatccagtatgcataggtagatggtgagggctctactaagacccagtatgcatgggtagatggtgagggctctactaagatccagtatgcatgggtagatggtgagggctctactaagatccagtatgcatgggtagatggtgagggctctgccaagacccagtatgcatgggtagatggtgagggctctgccaagatccagtatgcatgggtagatggtgagggctctactaagatccagtatgcatgggtagatggtgagggctctactaagacccagtatgcatgggtagatggtgagggctctactaagatccagtatgcatgagtagatggtgagggctctactaagacccagtatgcatgggtagatggtgagggctctactaagatccagtatgcatgggtagatggtgagggctctactaagatccagtatgcatgggtagatggtgagggctctgccaagacccagtgtgcatgggtagatggtgagggctctcccaagacccagtatgcatgggtagatggtgagggctctgccaagacccagtatgcatgggtagatggtgagggctctgccaagacccagtatgcatgggtagatggtgagggctcttccaagacccagtatgcatgggtagatggtgagggctctgccaagacccagtatgcatgggtagatggtgagggctctgccaagacccagtatgcatgggtagatggtgagggctctactaagatccagtatgcatgggtagatggtgagggctctgccaagacccagtatgcatgggtagatggtgagggctctactaagatccagtatgcacgggtagacggtgagggctctactaagatgcagttgtttcactgccctattgttgcaatggacttaccttcttttatgatgaataaggacttctcactagtgtctgatgctcttccaaatattgtccttgaaaaaataactactggtggttaatacatttcaactcagagtcatccatatttgtctgtggaagtgtctttgttcttaaattatctcaatgccaactactatgctttactaggaggctgacctctcaaaacatcttgttttcaaaatgcactcattgttactttaaaatgttgttttctttaaatatatgcatgaagaaatgccttatacacatacctacaatatttttaaggatctatttttatttttatattataatagtaaatactttttaaaaatggatttagaaatcaaaagtattttaaatactatttgtgtactgtaaaattataaattactgtcttagtttaaaaaacaaaattgatttagacttctgaaatcaagagtctcaggtgttttttaaatcattttctaccttaccatattattttaaattcctgaaatatgtgttttgctttataataatcatgtttcccataacagtctttctctattttgtttaaaaatacattttctttgataatttagtgcatgggatatttattctaatcacttaaatgtgtaatctataacaatttggtgttccttaaattgaaaatgagattcttatcacagaacattaggttttacacataacaaatgtgaaatgcactttaaaagaagtattggcaggatcaacaaatcatttttaaactatttatattgtgtagctattttgtaggtcttggagaattttacatatattatattttttattcatcagccaaacaaccctaacttctatatgaataatgtactcatttgtcatatataaatgatttcaatcaacatgtctctcaaaaatattttgtgtcatgtttaaaagttttctctgaaaatgttattgaaatcatgtaaattgaaatttattattaaatgaagtctaagatctcatgaccaaaaaaaaaagaaaaaagaaaaaatcctcacatcattattcattcttcaaattagctgaatctagtctcacattattgccgagacacttttctaaagtattttcaagaattagaagatacattttcctgccctggaaataaaaagggaatttaaaataaagaaaaatagaatggaaatctggcgagtaacttaccagtttctgaagcaatagactaaaagaaccagcacctcaaatacaaacgcgttcttctcatgacccccctagactctagggcttagagtgtgggtccgccttcagctttggcgaggccagttctgcagccccactgaggtcaggccgcaccttagaggaggggtggtgggaggaaggggagtgagttggaggctctcagacataaataaccgtctgccacccagaatatattgccgcaggtgcaccaaggcgtggacgaggaagtgtgctgttctgctggtgaacccgcatggaacctttcaggccctctcacgatttttaaagtgacccaaattgaactgaattggtgccacctcccacccatctttcctcaaagcactagaaagacaggtcattaaattaagatcaaatcaggaatgcggtgctttgatgttggaagtgaaacactgagacaacggaagaagggactaacgaaaagaattgtatttatttgtgtattcactgtcaggtcatgtctgtgaagaaagcaaaaccagctctctggcctgtactaggctccgccttgctctggggtcgccggccccgtggccgccccaggacccccagacggcagggtctgcgtccccctagccctgtccgaggcccagggtggccgcgtgcggtctgcgccgccgtggagactgaggggctggacacggcctggccgagggagacggctaccggccactcctggccacctcggagagctcccggccgcctgctggagaccccagcctggatgaggctccggcgatccagggcgaggagagccgcgggctggcggggaaggtggtgcgaggtcgccgcgggcggggagggtgcgccagggcccctctggcctctgcccggagccggcctggccgggagctccccgaggcgacgcgcggttccccagctgctccccggcccagacctcaggtgcgccgggcgctcgggccgggcagggccatggtgggggcgccgtcgcccgcccctgtgctccgggtcgctgggaagacccgcccactccccggtgccccaaggccctgcgaccgcagcgggagggtcggggcagcgagggcaggatgccccaatgccccagcggccgatcccggggcctgcgcgcgttccccgagcctaccccgtcgccagcgcggcgcagccagaccctagggcgctcccagcaccgcggaggtcgggcctccagtcctggaggggtttgctctgtcgccaccctagggttctgcgatcccctcccagcccccgcggggagtcccgggaacaccacgggcacacacacatcagacacgcgcgcacacacagacgcgcgcgctggccgttgctatggagaggccggttaccagccaggctgagggcagcaggtcccctcctccgagccccctcccctccccgtcccttctctccgctgtcttcccctcttcccgccccggctcccgagtcctcctcccgccgtctccggccccccgccccccagcgccacctcccctcccctcctctgtctctgcccagggccgggcctggggtcgccctggagcctggctggggacgccgaggcaccggaggagggtggcggggagggacaggaaccgctaccactcgactctttgcccgagaaggtccctgggagggcatcccgggcgctgggggaacccgagtaccgcttctctctgacctgcccgccgccgcgccgcccccgagccagggtgcgggggtttttgcgggccttgccctgggcaggggggacgagagggccaaggtgatgtaccccgtccccgcctactggaggggttcactcatgggcagaggacgccagtgacgccgcagtttctcgcctctcgcgcccccgccgagccgcaccgggcctcctgcagcccgctcaggcctgcgggaaccatggcccgatgcgaggccacttctttgccctggagctttatgaagcgctctggccttgccctataaatacaaaaataaatgcggaactcagcctgggcctgcagtcagaggaaacggggtccttcggccacttttagacaggggcctgcagcggacggcaccgtactcatatctgtggacaacccccgcctctgagccctgccccctggggctcgcccccaggttttacagaactaggtttgtgagagaaaagcgccaggcaaggccctctgcaccgagcaggtctaggggcagcgccagagtgcaagggaggggaggggagactgtggaagcgccgcctgggcctggcctggggaggtggggggtgtggaggagttggccccggaggggccgggagcgggcgccgcgggcagccgggtgtgcggcgggaggggcgtcgagtggcgcgggccgccgtctccagctgtcccgggcgcagggaacaatggccaggcggtgggagaggggggcctaggagggggccgctggggtttccagaaaaggagaaactaaagagccctccgcagactgtcatctgcgtgtgacaagatctgcgcccccctcttcctttcttctccttgttcctgcagctgtgggcctcggagagcgcattgtacacacagatgttgggtttcagctctccggctctcgccagctccgcgggggcgccgcgcaccggggtgccccaacctgtggctgtggcccggggtccagggcctggggagagagagcatgggcgggaggcgcgggggggaggtgctcagtggtcctagtcgccccgagaccctagctcttctcgcccgctgcgggcctgactgcgccaggggccgggggttatgtgggcaggctcgaacgactgggagcgtggcctgtgattctgctccactcctttcgcccgcagagcggtggtctaggccagaccattgacctgggtagggggaagggcaaggacgcagctcgcacgcctgggttttcaccgccgtctcccttcggcgttttgggctggcggccgacattggcctggaccaaatggtggcaaagtctcaccagttccgcgtctcgcaagacactttctacgcgcatcgggacctaaacactcgggaggaccctggtaaagtgagcagaggggctctcgtctactcgccctgaatcattggcctgcttccatttggaaagggagcaaaaaggcccgaacggcaacactggaaaaggtaactgggaagaacgatatgccgtgcaattttctcttgccaagagtggcgacgcaccccacccacccctcccaggacaaaggtcacagcagagccgcgcgccttgacttttctggccgaggtctctctcccctcggtgctaccctgaacttgcccagtatgaacgatgaaagggagaaacactgaaaagaaagaaaaggcgaaggccctggcttcggcgttgtaccaatgactgacaaagctgatgtccattcatagtctcgggcgggagagggtgtttggagagccgcggccccttagccaattgctgtcagcaacatgtggggggggggggggacatcgctatagcaaccggtggctgggccgcgagccgcgccgccgccggccgggtgcgcgccgggccggatataaggcggggcgcggcggccgcgctggttggtgctacgcgcgcggccggcggccctaccgggaccgtccggagcccgccctgagcccgcccgcgccgcgccccggcccagcgtgcctagcccgggggccgggccggggcggagcacgcggagctgggccgagcggccgcgcagagctccggcgcctgcgggctccgagcccgtgccgccgcgcagccgctgctgctggagcagcgacgcgcggcacctttgtctcctccggccgccctagaagtttgtggtcagaagcggatgaccccgctagtctgtggctccagcgcagggaagcagctggctgtgatgatggcgctgccgctacccgcagctgctgcgccccgaggccgctcggcccggcgcacgcccccacctcctcccgcgcgggcgctgggcgccggcccagctgcaggtaaccaggggtgccgggcggggcgcgggcgctcgtagtgcggttgggtgggccctggaagaggcgagagaggctgggatgggggcggagggagcaggaagggcccacgagagcatcaccaggcgcgtaggtggtggggcgaggaagagagctttcgaaggctggagggcgcgcatgggggctctaacgggcaactagggcgtcggagagctcagttcagggggtctctgcctcgccgcaggactcctgtcaaaggcttgggccggcaggggagagctgcgcctgggatcatccccaagtgggtctagggtgggcctgtgaggaggagcgggcaaagggcagctccttctgagcgcacagatttggagggttggcagctgtcctggcccagcgccccgcagagaccgccccaaggagtctaggacctccgggacttctccccagcgctcttctctcggcctttcgcgttgctccccactccctgcagttccgaccattgcagggtgctgggggtgggggggtgcaggcacggagatgggaggcgtgtgggaaaggaggagggaaggggcgagcagccaggatggagaggcgccagtgtgggcgcattttcctctcagcccattttggggcgctcttcaccctcctcaccagggtccgggagcgcgcctccgagccatgggagtatcccagcgggcggcgaattgcagggaaccgagggggcctgcagggagaggcgttccagaggcaggtggggacgcctctgagaggccatctctcctcccccaaagagaactgcgctttctcagcgcctcccccaccccaggtgaggcggccgcgtgctcgccagagagaaacttgtgactggacccgaagctgttggaacgagggacttcatttccttccttcgtaactacctgtgcagttccgaacactggcctgctccgtggttttagagaagcgttgctccagggaatcgggcgaacccccaagttagagttaaaatctcagcacaattgccttttagggccggagagagtctcccgccctttttggtcctcagtgcgctgagctgggcgctgcgggctggacggctgggagaggggccccgccacagccctgaggacgacgcggttcaagtcaccgacctccgtcctcggacagcggccccggggtcccggacgtggtcccgccccccgagctgcgcgtcccggccggcaccgtggagccacccgcctggagtccggagcgcagggtgtccgaggggtcttcgccaaaccaggctgtccttgcgtcgccgatcccagattttaggacgcgatcgaacaagagaggaagtgaaggtttgtgcggaggagggagctggaagctcttcctttcaccgacacagaggaaagtgccctcccgccccctcccaagcacacccctctgcgctccagagaagacggcggcggtggcggctgcgccgcccgggggctgcgagcgccgggattcacgggtggacgcgggcgtggttggggaccttggtcctccctcgcggccggcgcgctctgtggccaggaggctgggccgcagcaccctccgcgccgggacccctctcctggctctgaatacccgcggctcccgggaacccttggcctttgtgtccggcgctggggcctgatctttatgactcctgtggggatgcggtgaaccggcgaggggggagggacggggaagcgggggagaaagcccaggcaggggacggggccgaacgctgaccctcctttccctcgccctctgctcaaagtcgtgccacagaggggttctgacaagcgacgctaggcgggtcttgggttggggcttctgagtccgggtagaggaggcgaagcggtaacccccccagtcctgaagagggtctggttcttgcggggtggggaggccaggccccgtcccgagaagcacctggtgtggaaggcgcgcgtgcgtccaggcaggcctggggaccaggcgggcgggccaaaaataggggtcaggagccggtgccttaagtgtgatccgctgagtctgagtttgggtgtcatgaaaacgccagcggagagtctgaaagaggctgggggcggctttctcaggggcatccttcccctgctcagcctctgggtccctctctcccaccggaggcaatctgctggttagaattagtttgcacaagggtgcttccccctttggacatcagtatcataaatcttccctgatgtcttaaaacacagtatttctttaaaactgatgttttaggagtgcttaaagatggcaaatagacaatttattgcctttcttgtatattcacttttaagtgtatgcctggaaaaactcaacaaatagcccattttaaaacagtatatcccaacttattttcattaaagtttacatttaagaataatttttccttgaagattcttttcttttgcttttttgggttttttggccacttgaatggcagatttgcaagtacaatttcatctgcacggaggaacaatagctttcagttgcacaaagggcttctcccaccctgaattcagaccgcagtgcctcttgctctgataatagcttctgaaaagattttgtaatgcagagaattaatacatgattatttccgcctgacttctctcatttattagaattctgtggcaaattccaaattaaaagtagttccgttaacagctttaaaaaatacttttaaaatattttaagacaccccttcccccgtgttttcaagttggatcacttgctatggcctgaaaacttaaaatgttcatcagccctaaagtgagtattatattttagtaatgccttttagtaaatttagaatgaaatttcctaataattctaagaggattcatccagcaaaccaaagataaacttgttacagcaactcattaatggtctctaaaactgacttctaagttttaagagaaaaaggtatttataatttagtaatttaaatgcacacaaagataggatgaggctgggactgaaatctgattccttagaaatgatacaaatgaaagcatcaacaatgttagaagtttaacattaactggcaccgagcacctgtatccctacgtctttatgatgcaagcatattttaatactgcacatcgtgactcagagaatgaactgctcctgttaactggttatatcacacaaccttggaaaaggactaaatctggctacccgtcaacacatatttaccataaagttttgtatttgtgtggctgtatcagctctcacaattgagtttgggcataacatgtccttttttcttttcttttaagcttaccacatggacagctaaaaaagttctgaaggcattttcccgtaaatggctcacaagggcatggggtggaagcctcatgcacctccactcaggggcacggtcaaaataatttaaattggtcaggacagtgtctgcagatgctaagttctaagacagctccacaaattgtctctgtggtcatacacttattttgaatcacaacttttgcaatactgtctattctaaatttgaggagttgcaggtgcagacggttgagaggaagaaatatgcgatattgtacttcatcttattctcaagatagatctaacctgggataaaattaacttaatcattcctgattatttttttaaattatactattcctgcctctgagaactcagcactgaagtgtgcctatctgtgcatctcccccacccgggacgcacccctgccgctgtgttaccaggcctccttctccctcctcctcctcctcacttcttctctgttccaaactttcagtcattgagctgccgctgtacagaagggggtgttccgcttttcaaaaacgcctgactgtaaatgtcaaagtcataaatatttaaacataattttctttcaatttcaagtcaagactgataagatgcctctaattagtctgggctctctttggggtccacccgccgtggtgcagccttggggggtcggtgcccatgggggagatggcgctgaggaccaccaaagccacacctgggtcaagactgtgcctcaaactcacttttaaactcatttctttctcttaaaggccatggctagcaggagtttgaagattttttttaactccacaaaaagggagtcaagtcattgtaaagttattggaactcaatcacttagaaaaaaattctttaaatcttcgtttcttccgggattcctaagacctgacttgcagccaacagtttttccctccgcatcaccctcctgctcagcgctgggtgggacacttgaaaccgtcctgggcgtggagggaagacctctttcttcggtttcttctgcggcgcccgcgggcgggtaggaagcgggtttcccagccgggccctgggatccagcgacttctgtgtcaggccggtggaccccagtcggtccctctgtccagcgtcccgcccttccctgcagtaagaccctcctcgccctcagccccggcgctgcccgcggtcacgactccccggctgtccaggtcccgcggccccgcgcggtcgccctccgggcctcccccggcctctcccaggttgcaggaggggcctccttgtggaccggcgcggggaggtgggcctggggcggctcccacccctcctctgctgggacagcgcgggcctaggcagcagggagccgggcgaggttggtggagacaggactccagggcactggggctccttgcttcccctccggggactcctgggacccagcggggacccgggaggagagccaggagctctccaggcaatcgctctccttgacatttttctttgacctttgagtaaatccaagcgcgccaagggaggcctccaaagcaggcccggttccgctcccgcgcgtgcggagcgtgtcgagggtcccggcgacagcaggtgtctgcctccctgggaacagcctcggctggccccgggtccctcctgccgcccgcagaccaggcctcctcctccggcccccgcgcgtcccctgccctcacctggcccgagtgaccgcgggcagcgcctgtgccccttcctcggggagccggagccggcggtcgccctgcgcctcggaaccccacacacccgcgcgcacagcctgggtgccactgccgggtccgccacacgccgtggccccgccgccccctcagaaccagggtggtcaccgcgcgcgtgtgggcctcacggcgcggggcaggaaggttcgggaagtccctgttcccgggcgcagtcatccacgtgagcgcgcggtgtcctcccgacgccggggcagcggggccggggtcgcctccgcgctggggcggatggaggcgcgcgggggccatcggcccggccgggatgaggggtgggagggcggcgggcgccccctccgccggtcgcgccgcttcctttgttgttcttgttccgtcggccaaggccaggcgggacccgcgggaggcgagaggcgaggggcgaggggcggcgaggggcgcaggccgggcccccgggaaaagccctcccgcccaggtatggctccgggggacgcggccccgcaggcgaacatggaccctggggtgggcagaggacccggcccctgtcccggcgccgcttggacccacacgcctctcgcatccggggtcgcggccgctcctccccgcctggggccccccgcgcgctctagggtccctcgcgccggcccaggagggcacagggcggggctgccgcccacccgggagaaccagcgcccgcgcggggaccgaggagaccccggcccgggggaggtggcgcgtggccggcgccttaggtttcgtgaacgggctgtgcccggggaggggcggggaggggcgcgcaggagacccggtgggcggaccccggcggactctggggctgggtcgcgcggctctagagtgacttctttctggaagaggctgtgtgggccggagggaggggggcggaggggaggggaggggaggagaccggggagggggcgcggaccggatctccacgcgaagggcgacccggcggcgagacccagcggtggctgcggggtccggaccaaacggggttcgggccgctcccctggttcccgcccctcctccctctcccggctccctgctcactcccctcccccaccccgcgcctcctctccctctcccccctttccctctccctccccctttccttccctccctctccaaagcctccctccctctccgcggcggctccaccgcctcccgccgctggagaacctcgcggtcctcctccgagccgcgcatccaggcaggaaaatccgggcgtcttttctcatttaacccgcgtttccattaactcagtcccggcaccagctaatccgctgcaccgaaggcaaaaggaggctaattaatgaccagcttttccagtcaagaccggcgataattgctttggtggcctttatgattacaagataaaaacgggcccggcctgacataagaggcactgtgtacgctgggagacgggaggaaatgaagagttgggaggctgaatacggagcagaaaattactaatagaagagagataatgaataggccggccaggcattcatggggaaaaatccattttgttaccacgcgaaattaggtggtggaaaggggtttgctaattgttctcatcttgtagcagccaggaccaaggccgggcgtgctcccccattcactccccgagtcattgtgcagggcgcgcggtctgcggggcggccttcccattttcctgtggcgtccttaattgttgctaatataccttctaatgaagttaatgaggggagagccgtgcaactatttgcacgtggagacaagtgaaatgcaccgaaagggctttctcatattttcaccagccctacccccgccctccaagaagcagtgagaatctgaagggttttcctcgctgagaagtgaagttccaaaggctctgcagctcctttcaaggaaaaatacgtaggtgcataggtggcaagtgttgtggtctgcaccaggccactcctggagagtgactggagtcaggtgggattcgaccagcgctcgcctttcaagacaggtggatccaaatcccctgacctgggagggagaatgttctgtgaagatgcacagagccagtcccacgttcctttgttgctgaagatgtgctggacttggtggctacttgaagctgcagaaggctccgggcctgcccaccctcctccaccgccaagcctggcctccccccagcacccccgacaatcattgtgcaagctctggacaaactgctgtgcccggttagaagaagggatggatactttacttaaggcagcaaattagctgccaaatacgttacataaatttgaaaaacagccaccactgaaggaaaaagtgatgcctctgactgtcctcttgagcacgctgcaatctgcgatgtgctattttcaaatgatttctgcttctcctttgacgggggttgttccgcagggccctcccgttgtggctccagggccagcacagcgtcctgtggggctgagctttccactttcaagttgcatttggagacgtgtgtttttaggaggtcatgctttgtcaggagctaacacacccctctctccttgttctgcagaaaagcaaactcaagttcctgcctcctcaggcggagcaagaagactccaccaagttcatcgcgctcaccctggtctccctcgcctgcatcctgggcgtcctcctggcctctggcctcatctactgcctccgccatagctctcagcacaggctgaaggagaagctctcgggactagggggcgacccaggtgcagatgccactgccgcctaccaggtaagaggagactttttaaaaagtggtatatcggatttatctgttgaacaggcagatgatggcgttcctctctggcccctcctccattcccagcagttgttcctgtatcatagtttggggtcttttatgaggacagtttggaacttctcatcagcattcgtgcaaatacgttgcagccacagttgtgcagctctgtatccgtctgctcttcttggatagcctcgtgttaactctggaagaatgttgttaattagaagtgtggaaaaagtacagtacatgaatgatgtattatctgttatcttagtttggccactactactgaaaagtgccagagttgcgagatcatttggcgtgtaggtgtttgaagatgtctcaaaaatcatcggcttcctcggggtcttctgtgaaaagatcctttgacctgcccagttgccaccctgtgctgttgtccggtccagtgaagcctaacgctgaccaggggaaggtgacccacacgcgtccccatgagggacaccttctctagaggcaccacagacacccctggaaatgagctggaaaccggggaggatgcgaggaaggcaagttcagaccaagtcgggcatttttaaaaaaccacagagtttctggaagttctatggcgcacatttcgtatttagtattgtcctgtaatgaacataggccttcggttttaacagcagcataagcccagaatacttacaccagtcaaggcgtttgattcctttgcatataaaatatcatttaattccgagaagatattcccatctgggaaggtaggatgactccttaaccactgttttaaaagtttggtcagtacatgtgtaagatttcctcattggactggatcctttgttttctctagtcacatgattacagtgtgcaatacgtcttgtaaataattcatcatttttacagtcgtatgtaaagtaaatattattattccatcatcagagttacatgggtgggctctcaagctctctccacaaagcgccctccagcaccataccctcctgctgcctgagctccttggagctagcttttctatactctgtgagctctcaggaccctcccccacataaggaatttacacaatctctatgcttaaaagagattgaccacaagacagcttttcctcccatttcaaaattcctggtattgccattgaatggaggaagcctccagttttctggagagggtcaccagcccggtcaggacgatctttttcttacaaagaaatggcaacttcaaatgtgttgaggctggcatttcagttgcagtgcatagctttgcttcaaagcaaaaggaaaatcacgtttgaagaagcagcctgaaaaaaatgtcacataaactagtaagaatttatccagaaattccattgagcaagaccttcaatgtaggatgccaggtcttcaggccaagtctgtgtcagtacataaataaattatcacaccagttctgttccatgcgtgagagacggaagatcatacaggcagagatttttagaaagcgtggcgccctttgatatactttgaaattcaaatataaaatattgatagaatggaaaggttggacttgcatgcagaaatgactaatttgaaaaaaaaactgcaggttgaaaatgcatacttaggactgagtttgtgataattaacagaaaaaaaaaagccttcccagtgacagctctaattaatagtatctgtaattaaaatcatgcccttccagcaggaaaattgtttgaatttcttggagtgacctttttgctgttcctcctgagggcatggtggttaagttgatattgattttataatgagctccggtttgtttaataagaatctgtaatccagacaataaatgaaatgtgtgcttttcttcaatccagattaataaaaaggaaaaaaaactttttttctttaaaaatgtgatctaggaaaatttggaaatgaaatgagtgtaaagactttctggttggtttagctttgaaatcaccacaaaatgccctttagggaagtactttgattaaagtgggggtttgccccatcacggtggattgtttcccggtgagaaagttctaggtgccgaaccattgtgttgttgtgatttgtgttttggcggagcaggacgcagtagtgaggatgggactgtatgattgttcactttgaagttagctgagtaacgtgtcaaggactcagacaattgcggttacaaggaaaggatatttactttggtaaatgaagcaggtattaattcattaacgtatccatatctcacttgggttttctatcacagccatgagtcccctgtgaagtgtaaaaatctgtttgaaaagttttttaaaatattgcaaacataaaacaaatttcaggaaaggtgtcttctcgcattaatgtatttatttctggctcactgaacctgtgtactttgctgattctataatcacagtgaggttgtggatgataactctcatcactgggttacaaggaaaatggaacaatttgatcttatgctttatttcatggggacatgctggaactactcaattcattgtcttaaagcttctgaaaaataaaaagattattgtgcaaggtaggtgagaggtaggtaacctcggagagagagaatggtaggtggcaatatcataagttttattaatatcagaatatgaagttacactttaaacaaaagaacttgtgttcttacctggggaaaggaaggtcaggagcagaggtgttctgatggagtggaggagacgggtgcgtggaggtggtatcctggggggcactggtggcctcagggtgtagagctgcgtcctccctggggttccaaaaggtgaatcctcatgtcctctgttaaacagcagctgggttagtgtcctggcaaggcacttcccgcgtgacctggggggccctcatgttgccaacctctgctaaagcatttgtccgcctcagccctgataatgcacgcacatcattagtgcttgtacagaaccccccagccccgacccctgtgtgtgtgagtcagagcctgggcttgggaccacagggggcccacgttgtgctcctggggagtaagagagcttttcttaaaatagttttgaagcagtaaggagattgaattactagcttctaatgcaaacaccttcaaacatgtttacctgtttttcctcaaaatagaactatttcatggacagggtcaggatgttagagctttcttcatttacatgagtgtgatatttttgtttgccttacctattggaaaagcaaatcttttttgacagactctcatatttttgacacttaccaggatatcaaccccatcagataatccagccaagtttaatttgctcagactggagcaaaaattgggtgtattaactttcagaataactgaaatatattcttaaaggtcatttgtttaacagactactcgcaccaaacttctccccattgttttagtaaatgttgttttttcttctaaatagataaaacatgatatatttggattaattctgtacttcatgatgtaaaaatccaattttattgacttttattcttttttttcaaattggcatagcctgtcatatatgcatatatgtgtgtatatatatatttatacacacatgtacacacacacacactaaggataatgtgaagacatggaagaattgtgatttttggtaccagtatactttatgcattcttttttcatgtaggtgtcctatttctatggaaggtgattgggtaaaaactgtgccaaaaataagttgttagatgattagaagacattctcctccttttctctcggagtctctttgaatgttgcatccatttccttgaggctttgatcatctttgagcagcaagtttagtattctgccagcccactctcccttccccgacatgagggcagagactcctgcagaattttcagcaagttctcttttgatggtttatttcacaatacccagcaggtttccttgtgtacttggaggcctttggaaccaaacccagaggaaagcatgcatccgggccacggggacctcctgtaaacacagcggctaagtgcacgtctcggtcgctgctgctgctcccattagcaagtgattacaaaggcagtgacagtgtggtggcaattgctgcgatctgagggtgctcagttgactggggctggcgtgtctgcaagtcccaaatgcaccctgacttcttacccccggtgcagaaagctgagttctgacaaagagcacaggtcacgccttggttcattctctggggctttaagagaccgttctttctctaggtgagtttaatcttcaggcattggtgtaatcacgagtaatagaagtaggatgttcacaattaaattggaaaacagtgacttttactgaggtttacttgaccccaccagaagtttttaacaaagccttttcaatcagctctgtatcttagaatggctttcctcactatatatttaaatttccaggtcaaaataatatattttttgcaaaactcaaataagcaaaacctatgctgcttcaaaaatgaagggcaccctgtgaaaactgtgccaaatagtttacaagtataaaaatacaacattaaagatcatttgttatgaaataattatgattagagaacattttattgtaaagtcaagcctgaaaatggaaatttttctaattttataatcctttccaaatgtagctgatagtacagatgtctacagtagaattctcttgaaactttcgagacgtggattcggttttgcagattgtccgggaacagactccaggccccgggagggcaaggccgtgcctccctcctcccatactccatggcggcacagaacttccctggactaactaggaatcagcaaatgctaaatggttgtcacgctggtgccaaatcccatggtttctgatgtgaaggaaatcggaaggaaacctgcagaatttagccaggatgatgagggtaaagggtacgtgtcgtccccagtgtgggaagaacctgtttttgtttgcctgtgtgttcagtatagatcatcagtatgtggggtcagccggcttggtttctgcaggctccatggaatcttctagataccttttcaccatgagtctgaacgtttttctggaaagtgcccctttgaagtgcatttttctcataaatctgaagtgttcacagatgcagtttccaaaagcagtgtacatcctgccgttttgcccaaaatgcttcctcagatacagctcctgagagatagagctcgatcttcagagaacaatgaagtctcgaaaggtggccagagaaacctctaaacataaaacagaagcatgctgctcgttggggtacagcaagccactccccccatcagacagtagtcattagatcagacttaattaaaatcacagagaccacgcagtgagatatttggaaataaaaaaaaaattggaaagtctgagacataaaatgtggagggctgaattctgtggcttcattttggcactaggccattcctatgtttgccttgaccttggtagcttttcacacctgggtatgactcgaataactgcttcctaaggaagccacttcctgctacacacaaggaggggcgcaggaaaggaggtgggggctgcaggcttcttccagacgtgctcaccctgcactccagcagccaaggaagagggctgggccccgggaggaggatgggtgctcacacagcaccaggggaggggcggtgtgcgtggtgtctgtggagcgggtgctgcttcccttaggcttgtgttgtgtaccagtccgcctcacacatttctctgccagaaccagagaacacttccttctcgtcaaagccagggtcgctcctggggtgacccctgcatgcacagcaggtccttccgagcccctgttcctaggcaccccctgtcctcatcagtcacccaccccgtggaaagggaccctgtggaaagggacccaggacaccttccccaggcatctcattatctcccaaccctgttttacaagggggcaaagtcagcagcagataaactgagaggcgccccagcccacagggccagtggcagagctgcactgggcggtccccagctgcgctgtccccactgcagggtgttgaggggctggcccgggcttttctgtcccgtgggtctggacagctcctccaccatcttccctcgtagtgtgaggcactgtgggagatttgggaaaaggtgacatcctttcttttctcggttgatgatttcttggagatgaggagtttgcaatgaaagtgaaccggcggtaaacagcattagtccacgcatcactaggaggtgattcgtgtgaaactgaaatcaaatccttggagatgacagaggaggggctgggccaggtggtgggtggagctcttggcggctggcgggagatggaggcgtggctggggcaggtgctggagccatctgcagggtagggacagacccaagagggtgggcatttgcagggctgccaggaggaactgggctagagggaagaggtcctcccagtcaggccaagagtttagacagggagctggggtgtcgtggaaaggactcggctgcaagttgtgtgccggcccagagaggtcagctctttgagttcgtgacaaggacaaaccctgcagtctgtggcgctccaagggacggtccatggctcggtgtggctgagtgaccccaagaggatcagaagaggcacattctgcctgctttcacccccctccgtttcttccttcttatcttattcccctcttgccacacttttcatcttttaactttttctccaatggtgaaattcatggaagaaaggtgccattgcccttccattccctggggtgcgaggcccagcccctccctcccgaaggccgccttcctcatctatgaactggggcctcctcttgggccgccatgcggatgagggcagccctgtgggtgcgggtgccacgtcagctctgaagcgctgcccgagggtgacttgcccggtctgcagcgactgtcagtgcccgcggggctgggatgggtgttggattcctgcctgctcctcccgtttccagggtacccgtttccgcacacttcctcctcggcatgagctgctcccctcccttagacctgattagagaggcgggacacattttctgaactaaaactgaggacattggtgtctgcaaagcatgcacttccagagaagaaaacagaagcaaagccctgaaacctgggctgctctgcagaattcaagacacttgatggaaggtgttcggagaaggcgcccgggtgagccaacacccgggtgagcccctgtgtggtccggggccctggggggtaaggtcaggtcttggtgcaggtgcagcctcgggcatctgtgctctgaacacctcacctcccagcccaaggggcttcagggctcacatcgaggtgagggctcggcaggagggaagccctggtcaggtgggcccagctcagcgggaaccctgctgcccatggcgggaggcaggctctccgaaggacgcgagccgctgtgaaataaagtgggtgttgggaggagacacttgagggagtaaagggaagtgtaaaaaagtggattaaactgggatttcaaaagaaacagtaggcggtggggaggagattccagcaggcgggtaccaggaggtaggagtgggtgtgagcaagaggcaagtcccacccaaggggcgctgtgcttgaaggctgggtctccccactccctgcctgtagcctctgctctcccggctccccttggggccaccgtccctcgggaggagggcatcgttgttggcaaggagaagaagcctcgggtagctcctggagcctcccccacccagaactgtgcagacccccccggcaggaggagctcggcgtgggaggagacgcccggcagggccggaatctccaggtgacagcctcgtgcacacgacagggtgggactccacaggcgtgtacagaggtacctgcgcggggcctcaccttggggccgagggtcctcaggccgttgctgtaaagcagaccttcttctcagcctctgccttgatgggcacgagagagaatgcgcctctgtggtgaatggcattatctgtggtgaaatgcattagcctgtcaaaaatggcaaagcccagctcttaacacaacacgtacaccggcataaaaggaggcaagacgctgcgcggggtggtgggatgaggaatgatggctggagccgccacggcatgcaggagctgggtgttacaagaggagaaagcttcgggaaaagcaattgcacgtcaaaccgaggaggacccagcagatgaaagtcatttccaaatgtcaaacggggatcacttcgaggacgtggataaggaaggctgatctgccggccgcctccagcaggagtccccccaccctcgcctcctggggaggcctccacaggacaagtccctcgccgcctggctgtctcttctctcccaggcccaagtccccttcggcccggagctctccatggctctctgctctgtgagccccgcctcctccttccctcccctgctgtgttgggggttcattttgccatggctgacacgtgggggtccccagagctgtgattggtgttggcccgagggtcacccctaaggattggacaccttgggtctgggtgggcagacagccttggaacctcgggatagctgaacttggagctgacccagaaggcgttttctcagaaagcttatcgcttctaagggtagaatcccatattctggaacaacggggacagcagagaacttgatcttacatcagagtcggcccagtctgcctttgtgaaggactccccagtgtgaacccggaaacagacaacactgtgaccctaggggagccctgggtgccgggtggggcgggcatggggctcagagaacgcggggagccctgggtgccgcgtggggttcagagtacgtgagaacagaacgtgggagaggaagaaaaaggcaacggcagagggggcctctgtggggcgggagaggagcatggaagggcctgagctcagagagagaggggccaggacagagggggcctctgtggggcgggagaggagcatggaagggcctgagctcagagagagaggggccaggatgcacaagggaaatggaggggcttccaggggcagacagctagctactcctctcccattttttcaggtttatgtggacgtgaggtgggcagagtcaggcatttctgcaggtgtctgaacagcggcttttcctgttccatgggggctgcagaatagtgctcccttcttcatccagccagctgttctgaaactttgttgctcaaaatgtaacgtctccgtggcttttctgctttgggagaattactgatggttaagaatgaaatcttgggactggcacaggggctcacctgtaatcccagcactttgggaggccgaggcaggcagatcacctgaggtcaggaatttgagaccagcctggccaacatggcgaaaccccgtctctattaaaaatacaaaaattagccaggtgtggtggcgtgcacgtgtcatcccagctactcgggaggctgaggcaggaaaattgcttgaacctgggaggcagacgttgcggtgagccgaaatcaaaacttcatctcaaaaaaaaaggatggaacctgggtatgttatttctctattagcaagtacaagagactcactagaaaggtggcaggtgtgaacaagcaccctttcaagattttttaatgtacaggataataatgcagccccagaattgagtgtctgggtctgtgctagtgtgcgcctccaggtacagtgacttgaagaacagatgggaagattcgcagacgattacattagccagtaaagctacatgttttaaaatacataattcactacagagtttgtggaatgtggatttgatatacaggtttaaacttggattgatcttatgccatttaatagctaatcaattaaaagagtttacaagtgataagtgctgggactattctcacattgatgtataactggactgagtacctctgaggagagcggaagctggatttgccctctgggtaggcgtttcgtcgctttcagcttttttggtgaagacgatgatgcaggagagtggacaataacgcaatcttcctggaatggcctttcccgacctggaatcacctttcctggcctgtaaaacgcaccctgaaaccagagatcggatgttcctgagtgggaggaaatacaatgcagattttttttgcaaaacaaaatactaaattggatggaaactggagctggtgtgtgagtttcagaattatttctgtccccatcccagggatttcttattctctaccagattcaaggagaacaaatatacaaattgttaagtgagccccaaacgtgaagctgaaatgtgaaggggaaagtctagaaaacgtgtctgattcttctgagggtggatttccaggctccccttcctcgccccgggcatgcgtctgtcttgctcaggccttcccgttcccagtgggcccctcgcttctccagggggggttttcagacacatcttgagatttcaaatcaaccccaagtgaggcggcagagctgacaccccacgtgcgacccgtggcccctgtaccccagtcagcggtgtcctcgggccggctgctcccagcaccctctgcaaagttcactccccaaaaaccctcacactccctccacgactcgctcacgggttttcctccagggctgctgccccacccgtccccttcttggggtacagcgtagacttttagaaactccccgtacagaccttagggctcagcacccttcggtcagagctgagacctctgagaccgggattcccagcaggcccccagaccctggccttcgggggtctggtaggaagaagctcttcagggcgtccttcaggccttgtgcagttcaggtgtcactcagatcagttttaggtagaataattgggccccagaacgacgtgcagttccgaaaatggagaagcagctgctccagtagccgctccgcccccagcccgcatgcccctgcccttcctttggcttaattaagctgtggtggccaccgaatggaaggatgtgaataccttttgtgtccctgggctgggctcctctgcttctgagcctttgtttgcccggctccctccgttgcaccgccccccctcccactttatccctgcagaccctcccatctgtccagccctgtgcagacccccgtcccctgagcttccatctcagcccggggtggcccgtcccatcccgaacaccagggccctattcatccctacctcccctttatcccttctgccgcctctgcggtgacgtctcgtcaccatccctccagtgtagggtgacttcctcattgtgttggatggaggcaggcctgggtgcagagcgggccttgttgcccacaccagaccagcccgtgtggggacagccttggcttcccaaaggccaggtctgtccaatagacccacagcacccaccggggacctttacatgctcgataagaatgaatcgatacattgaactaagatcttgatgtggtaagagcaggtctgtgggcaggggacggggggcgggggagcatgtaaaccctcttggaaaccatcctgtgcaattctcaggtccagagtcctgcccgcccatggggagtcctccctacgcgctgcaggctgaagatgcgggtgatgacagggatggcacatgaaaatcagcccttattctgagcaaaaagaaaattaggaaggtgcaaaagtttcttgtaaaaaaaacagctgcccgttctctacttccacgtcaggcctgggctgctctgaaggcggatgacttgtttcttactgactggctattttaaattgtctgactatgaaactgaaaagcaaggttcagcctgtggggcctctcaaggctggctttgctcacagaggtcgtgttggatctgtgaactttgaaggcaccactgacttttttggaagcccttagaacttaattgcccggtgagtcatcctccgtgggagccgggaagggagggatttgtctcaccaacggcagtctggctggaggggctttgctgcggtgtgactggggtctcccatgacaacgggaagggttgcaggcatcgtgggttaaaggtgctccctctcacatctaagatgccacctttatggaagcattaaagaccatcacagaagccggtcttagacatgggctgttccagagagaagatgctcattaaaattctgtgtttccttccaatgtctttattttcacaactgtttcctggtttcaatctgatgttatcaggagcagagcaaatgaagaaaatgaatgtctttagtcttaggggagaggcagtccctaagaaaaagggaggcaggaggtcgggtttcagcacgtcggtcactctcggatgcagctgaccgcgggtcccgtgagcccgtacgtgccttctgtgcttcacgtggagcacctgcgtttcccagccacccaccaggggcttcaggagattcaaacacagccctcacctccccagagcaggaagccgcagctgtcggccggcgggggctcgatgcagctgctccagccgtgccccttgctgctcccccagggctgccttggtgtgggacactcggtccctgagcgagccgtgatctggaggccagggatgctgaccagtgtgcaggggctcagcgagggcccctctgcaccacgtagatgctgtgggtacagaaagcagacagaaggacttctgctcttgagtgtgggaggcaggggtatggacgtgaaaataactaggaaacagcacacgcctggatgcccggagcccggcctcgaggttgtgtggggactcgagaaagggctggtgctctgggcgccgcagggatgggggctgagcgagcggagaggccgcttttttcctactgatcttaggctgttccaagactgttccacatttagaagagtgttgaaaattatttttcacttacatgaaacatgtctatatctttaatttttgttttgagaaaacatcttgcgaaatgggaagaactcactccatattgcttggccaacatcgctcatcgtgggctgactcggcttgtttgcccgtgcgtggaaccccttcctgcaggagctgtgcttacagcccctgactgggtgtcgtcgtgtgtcaggagcggggaggggcctgcagagctctgtggccctggcttgggcgctgctgtcaggggcatcctcccctgggtgtgtgtgtgtgtgcgcgtgcaaacacgtgtgtgggttgttcttggtccaagtgtaaaagttacctggacaccaaggagaagccactggaggcggtgggactgtgtcaccagagcagcgttggccacgtgggccatgagccgaggacgtccccggcttagatcacggacaggctcggctgccggggccctgactccgtggcagaagaagggaggctcccctggcattcaggggcggccgtgggccatttgctctccagaagtgagcgtggccctgtgttccctgaggtctcacagggctgccccagatgcacccagaccccggagcaccttgtagcggtgccgatcagagacctagcatggtggagtgtttgtgtaaagtcgctctcctcaacgaaatcattggttactgctcctctgctcccagctggccttgctggcctagcatgtgaggcggttccttctgagtccctctgagttttatgatgaaataaaatcaagtaaaactgtgtcatgatcggggagaggtgattatacaagaaacctttttttctttttttccccactatgacacatgaccccgtttaacaacctggaatatttttccccggccttttccctgcacacgctttctcaacatttcaccttcctgtttagatttcctgtcgtcacgtgccctgcagcctcagtgtcaaactgacagagcgcaggctttttccttaaccgttttacattcgagccacctgtggttgcaccgggccccgcggcttctgctgtgtgttgccctctgagctgaaggccagggccctccccaaacagagccggttcccgttcaccacgttctcttggtgccacgtccagtctggagagtggcctttattcctccccagcagagcccagtgaacccactttttcctgcccagctttgtacgtttaattccttagtgttgtcctgttactagtgattacactctcgaaataaccctaaaaacccaaggctctctgtgcgcacactcgggcaacacggcttcattcagttggctcccggaagcgtgcagagaggttttcctgaaacctttgttgtcctggtcttcttttggcagaattcaagaatgacaggtctcttctctgagtgatttccactctgtaattttctccatcagatgctgagttaagagatgagacatttgccttgtgatgtgtatggatgaatttctgcccccagaatcctcttcagcttattttgcacattgtgttatagagaagtataagatactttgaggactctgcggacacgcccagggccccggcctgggcacagcagaggagcaggcggctctacggcgagcgaggactgtggtgtccgaatgtgccgtgctgaccatggcctcctctgtttgtgtgctcacacctgaggagctgctcagagcacgggaagctttcagggtgggggctctgggtgcagcactgtcctgcggggatggtcccacgtgactctgcccagggcagggtgctggtgtgggcgcttgcagtgccactgggctcacactcacagttccagttggctctggatgtgttggaggcagcaccgagctgcaaaaagatcaatttttcacatttccctgatggagagtttctgcgcctgggtgcggacgcgctgggtttaccgttcctgacaaacgctgccccgtggggagggtgttaggtcgtgaggcactagcatcacattgagttttgcggtggagcatttccatttagggcaacagtggaagacgccaccatcttctttaaaaatgcctagttactctagttttactgagagggaggaggcagggagagggtctcatcagcaggacagagtggccagagggtcatccagtgcggacagccctgggggtctggcctccttggtattgtgtcctggaaggaggccctgccagaggcccccagctcccgtgaggctgtgtggcttctctgtgcccaaatgtagatgcgggcactggcagggggatgcccacacccgtgtaagatcagtgtcccacgggccgagtgtgcaagtcaggctgtgtactcgttgcacccacctgagatcagtgtcccacgggccgagtgtgcaagccaggctgtgtactcgttgcacccacctgagatcagtgtcccacgggccgagtgtgcaagccaggctgtgtactcattgcacacaccagagatcagtgtcccacaggctgagcgtgcaagccaggctgtgtactcattgcacacaccagagatcagtgtcccacaggctgagcgtgcaagccaggctgtgtactcattgcacccaccagagatcagtgtcccacaggctgagcgtgcaagccaggctgtgtactcgttgcacccacctgagatcagtgtcccacgggccgagtgtgcaagtcaggctgtgtactcattgcacacaccagagatcagtgtcccacaggctgagcgtgcaagccaggctgtgtactcattgcacccaccagagatcagtgtcccacaggctgagtgtgcaagccagggctcgtactcatcacacccacctgagatcagtgccgcatgggccaagtgtgcaagtcaggctgtgtacttgttgcacccacctgagatcagtgtcacacgggccgagtctgcaagccaggccttgtactctgtgctccacacacatccaccctcagagtcctcccaacaactctgtggagctgctctgccttcatccccatttcacagattaaaaacacacacgcagcttttggcagcctgtccagtggcacacagccccgggtgatctggacccagagtcctggtcctcagcctctgccttacacggccacaccgtgcagatctcagctctgtcttggcttgctttttttgccaataatggatttcattttctactgtggggttttttttttttctaacacactaatggctctggaatactttcttctcaagaatagaggcacattataatcattgatattttactatggagatgacctgcaaaaccgtgccctttttccattattgcaaatgcgtccttctcactgggaatttgacatgctatccttaataattttcttaataactttctcaacacctaagaggggccagacagctaaaaagctacagagcagctatactgagacgcagggaccttcagagctttccggaaagatgtgagctccatctccagggacaggcattccaaaaatgcaaggcagcatggcacaaaaataaatgacttcccctttgtacctggaattttttttctttttttttttttaattatactttaagttctagggtacatgtgcacaacgtgcaggtttgttacatatgtatacatgtgccatgttggattgctgcacccaccaactcgtcatttacattaggtatttctcctaatgctacccctccccctggcccccagcccctgacaggctgtggtgtgtgatggtccccgccttgtgtccaagtgttctcattgttcacttcccaccgatgagtgagaacatgtggtgtttgattttctgtctttgtgatattttgctgagaatgatggtttccagcttcatccatgtccctgcaaagaacatgaactcatccttttttatggctgcatagtattccatggtgtatatgtgccacattttcttaatccagtctatcattgatggacatttgggttggttccaagtctttactattgtgaatagtgccacaataaacatatgtgtgcatgtgtccttatggtagcatgatttatagtccttttcttagttcacatatatattgttttttcttcgctgctaaagagtatgaattgggaagagaaaagaaaacaggtttcatccacaccctggtgggagtggccccgtgggtgccttcagggccaggcaggcccatgcccagccctcagtgggatggagcctccgtccagctcctcagagtggggagggaattcgcaagtgccgccgacatcgcagctaaatctacaatcaaaagagttatgtggttacatctacctttcttcttcattcatatttaattacctgttggttattgagtcacgcaaatgccacaaggtcttactcatccttacaaactcaaggtcgccaagctgcacacactgggccgctgtggctgaaggtgcatagtcgcggatcataaacagagccatcttcgtgattgttaggctgagtctggatcttaaatagaagattttcctttaagtgaagtggctggaaggattggaccttctgtccggccaagatctgtttgccaaaaatgtgtcagtgcccccaggccaggctgtgcaggggaggcccttgggcccctgcaagcaggcgctgtggaggggcaggtctcggggcttcctgcttggcaccactgccggttaaccccttcagcaggctcgtgtggcccacaggcctcactctggggtgttcaccgtctgaccaggagagttttgttccgggtgaggatgcaccctttgtgtttaccgaggattataaatcagggaaatttcaaaacatgatggggctggcctccagctttctctcagaggaggctcatgttgttgattttgctttataaattatcttttgctcaaataaaatgctctcgagatcatagctctgtatttttggcgggtgtaggcggacagggtcttgctctgtcaccagggttggagtgcattggtgcaatcatagctcactgcagcctcatcctcctgggctcaagtgatcctcccacctcggcctctcaagtagctgggagtacaggtgcacgccaccacacctagctaattatttttttggagatggggtctcactatgttgcccaggctggtctcaaactcctgggctcaagggatcctcccacctacttcccaaagtgctgggattacaggcgtgagccaccacgcccgactaccgttctgtattttaaactcaccacacagaatggtacttagagtattcgtagtggcgatggccatttctgtcactggctgacaggagcccccgctctgtgccctgggcccccacagaagtctgataatgaacgcaggtgatacgggcagcggctgctctcgtctgatggcagttctggtgtgatggcagctgatgctgtaaccttcaactgaggttttaaagaagtatgtgtgccacgctgtccattcagtcatcgcctcagcggtcagcaagctcacgcctccgttcagcaccgtggatgcgactgccttttcaggtgtggatgctacttttcaatgaagagtgaggagtgtggccccctcccccgctgtagccagtcactttctagtcttgggaggggaaaaacagctcccagtggcatctccagtgagcccacactggcagccttgcttagagggttagagtcacctcatgcagggtggaaatgtcccaaattataacctagagcgatttcaaatgctgtgaggtttgtctcgttggcactggctaaaccattactaagtcaagtagcgttctacatttcttattccattctagtaagaagtgtgtttttccttacaaaatttttaaatgttaaggtaaaggactgagaatggacagactatagaatttccattatgaatttggaaactataatcagcctaaaggaccagtgaatgagaccacatgagatgcccctcagtgctttctccagcaagccatgaggcagaatccaggctccttcctggcttcccccacgtctggagattcccaagagtgtccagggaagggtggagagggaggggccggtccccactgtgaggagctctggcaggtggcccagaaaggggccacacagcaaggggaagggacgctggcaggggcaggccacagtgagtgggagaggcagcggccaaacgtcccagcccccgtccttggagggagctggcccgaccccgttccccgtgagcgcagcagactggcgcatttccagctcacttgtgaggaatttctgtttctgtctccagtagatagatgtggctttcttgtgtttatcgccaagggagacaccaggagttgggcctgcagccacgtcttcccaggggcacgtgcaggacggccgacagccagtgccgctgggactccagggtttaacttgtcagtgtgatgtcatcacggtttccacgcgcacagcccttgctcagtgacctcctcgcgggcctggtgcgctgttcgccccttgccacccctgccgtacctgcagggagtcgccgatgcccggggaacttcttcccagcctgggttatggccgggggtggagctcgggctgcagaaagtggcttcgcggccaagcagaatgtggcaaaagcaatgctttgtggatgtcctgagatacggcgtgaggcaggacactcttcagttggtcccatgacagccacactgacttagcaacagctgggttgaatgaggtgtgaacttctgactgaaccgtgctgcgtgaacgtggctgagccgtgaggttaggtgggcggtggatgcaaggccttcccttcagaccctgcatgcacaagaagcacacggtcggcaatgttacttcaagcttgtagacatcgggtacatcccatgtccaaaaagaaggctcgccctggaaaagcacattccgaaagcagtcgcggcatggatgcagagcgctgtgcccgcagcactgcccacccaggaggctgtagggagtggcggccccttctctctcctcctcctccttcctcgccccgtggaagctcttacgcacctccaggccccatgcctgctcacacctccccatctctgcaggtgccattgcggcctagccttggggcctgagcctctcctgcctaaagctttctttgacctcaagttcagggagggtcccctcctcccggccccacggcaccccttcccacgaacgcccaacacgtgctgttgctgtcattcccatcgcttcttgcggtcactcgtgcccagctctgggtggcgtgggagtgctcgggggtcagggcccggcgagtctgacccagcctggctcagcctggtgttcctggcaccctgtgcagtgctgactcggcaagggaccatagcaaacctgattttgaataaactaataatcatcgtagtaggaacagcaaataatcacctggtgtgtgtcaggcacaggcccaaagcctcactctaagcatgttatcttatttaatcctcccagcggtgaagtcggtaccattatcaccacttcacagatggggaaactgaggcacacagagattagtgttttcccaaggccacacagtcagtaagacctgaagcccagattcaaaatcaggccctctgactgcaggtgctatgagtgaatgagtcaatgactgccctggacgtcaaggaaaagaaccaaagttaggtctgtttttgcagttctcatcctgctcctctgaagacatacctgttttctgggtcctggtttctaggaggcgtccatggtggccccgttgcctctgtctcagggcagctttgtggaggtgcagagactctcctaagtggcaggttcccccagagccttcagaaaagcctgcgctggtgatgtgagggaaacatggctggtgcctccggggagccacgtcctgcccatcgtagtgtccagggaagtaggacgcgtctctcacctgcccccaggctcaggggcagcatggggggcttcagccccagacacctcctccacccaggacccggcttccccaccatcccgttcctccctgcaggccattcctggccttatcactgccaacctcctccacccaggacccggcttccccatcatcccattcctccctgcaggccattcccggccttatcgctgctcagatgtttgcctgagccacttgctgaatagaaacttggtagcggtgggttcagagcggagcagcgccgggctagagcacccgcccccgttcccaggcggaagcccgcagggagagcgccttcgggcaagagcagcgtccccggccgcgcgttgccttgctgtgggcacacccttctcccacggcagcgtctccctctgcacaggcgaagagctgccgccacgggtctccagcattctgcgccaagctttcgggggcttcctctctgccagggacatttttcttggatctttatcgcagtttccctcctttgaaaaagttaagaccttcaagaagaccctgcgctgcgcagtgacgcgagaccactggtgagagccgcgggtccccgctgagaggcaccgaaccctgggtctccctcaccgtgcaccagcactgagccactgggcactgagccacccgccggaggaggcgatgtcggcttgtccagctctaaattctgcgactttggcccggtgcagtggctcacgcctgtaatcccaacactttgcgaggccaaggcgggtggatcacctaaggtcaggagttcaagatcagcctggccaacgtggtgaagcccgtctctactaaaaatacaaaaattagctgggtgtggtggtgcacgcctataattccagctactcgggaggctgaggcagcagaatcgcttgaacccgggaggcggaggctgcagtgagctgagattacaccactgcactccagcctgggcgacagagcgagactctgtctcataataatagtaataataaattctgtaacttcttcagaaatatctttacatttgccaagccgtcaagagtttggctctggcttagagaacggccctaacttctattcactaatacgtctctcttactcatgaatgcttgaggctttctctgtagctgcctccatgctaagcactgaatatacaggaaaccatctattttaatcttcacagtaactataggattatctccatttataaagtgaaaaaataggcttagagacctttagaggttttcccaagttcacatgaaaagtttgtggttgtttgctattggtgactttgggagaaaaataaatacaataaaaacggaagtttgtggtgcagcagggacctcagtcctgtggggcctcttggtggcttcaccctccatggcactcaggaaataacagagctcagacctcactgtagctctcccatgggtggcaaatcacaggatgggcatggaactagcttgattttttatttttatgtgagtaaatctccagcgtttcaaatcctcttccccagagggtcacattctcggaccctctgggttccctgagctgtagctgttctcatgctttggttggacgttatttttctggagaaattgtgtgaagagatagaagttacttcagaaacatttctcagtgtgcttttcccccacgtcaagcaaaattcatgtgcacaattgagaaataaatgagatgtatactcaggttggttactggtatcatctaccttattaaaatcatccctcattgggtggatcacctcaggtcaggagttcgagaccagcctggccaatatggtgaaaccctgtctctactaaaaatagaaaaattagccgggcgtggtggcaggcgcctgtaatcccagctaatcaggggagtgaggcaggagaatcgtttgaacccaggaggtggaggctgcagtgagccgagatcgtgcctctccactccagcctgggagacagagtgaggctccatatcaaaaataaaaataaaaataaaaaataaagaattatcctttgtggggttttttttgtttgtttattttgctttgtttttgagattctgagaaaacgtgggtggatttttttaaacacactcactattttaaaactgtctataaactaacaagtacctgaagatgtatgggaaagaaggaactggaactctcccttttcttagagaccccttaccctcaccagaggcccttggtaaagtccaccttcccctgtgcgtctctgcccggtccccatagtcatcccccccgccccccccatccctgtgaccatcctcccacccctgtccctgcggctatccacctcccgcccagtccccccagccatcccccccatccccgcggccgtcccccccttccccacagtcgtccccccccatccccgcagtcgtccccccccagtccccggggtcatccccccccgtccccgcagtcatcctcccagtccccgcggtcatcctccttgtccccagctgctctcacaggggctgcaggctcctggagagtgggggccgcagggccccttcccacagcacctgtatctcgctatgagtccgaagcagagagcccgggagcatgaattgctcatcccagagagccaggtggagggaaatgttttctagatggtgtggtgccggtgggcttggcagacatctttaaagccaaggaagccggcagcccggggtgaagggagaatggacacaaggaagccggcaccccggggtgaagggagaagggacacatggagtgtttcctgagctttggcgattgccttggggagtgcaaggcctttgacgcacacggctgtggggagcgagtgggtggcttggcctcccccggacaccaccaaaatgaaaccaaggcagcagcagcccacgaggttccccggagcctttctttttctcacgaatgcattttcacctcttctgttgagctccagttctcttataaactttttctgggtatcatttcactttgcagactcagggtacaggtatattttcatcaggcaataggacgggctatcctaacacagtggttagaacactttcaaaacgagattgttggtcagacgtcaggggggcacccaggctgcaccctgaaggtgagcggcagcagcggggtcccggcgtgttctgagcacctgaggctgcgtggccgtgtcctgcctgcaggcgggtcccatacggccgggcaggtgctcgggatgcccaccgcgtgtgtggttgagctttgcctggggaaggagggtcgaagaccctgcagtgatccctcagaagctgtcttggggtgtaatgttgagagtttcctttaaatacgggaacttctgctttggtgtctactcagcagcacaggcctttctccctcccctgtgccttctgtctcccgcacggctccatttgccttctcttgcatgggctcttggacattgctttggaaagagaaagaaacgtcagaatgaggttcttcttttttctgcagactctttgattgtggtaccagtttctgtatctcagtccacagtgcaaaccgcccccggcctcccctgtggcttatattctgatagaatgagaagccacccaacgaaggctactgtggcgttatcccagaatattccacgttgatgacagaggaggatccagtggatgctttcttgaatctataggagtgagtgtttgtggcgtgtgcagtgtgtgtgtgtctgtgatgtgtgtatgtgtgtgtggtgtgtgtgtctgtgacgtgtgtgtggtgtgtgtgtgtctgttacatatgtgtgtggtgtgtgtgtgtggtgtgtctgcgatgtgtgtggtgtgtgtgtgtctgtgatgtgtgtggtgtgtgtgtgtggtgtgtgtgtatatgtgtgatgtgtgtggtgtgtgtggtgtatgtgtgtgtatatgtgtgatgtgtgtggtgtgtgtggcgtttgtgtgtgtatatgtgtgatgtgtgtggtgtgtgtggtgtatgtgtgtgtatatgtgtgatgtgtgtggtgtgtgtgtggggtgtatgtgtgtgtatatgtgtgatgtgtgtggtgtgtgtgtggggtgtatgtgtgtgtatatgtgtgatgtgtgtggtgtgtgtgtgtatatgtgtgatgtgtgtggtgtgtgtgtggtgtatgtgtgtgtatatgtgtgatgtgtgtggtgtgtgtgtggtgtgtgtgtatatgtgtgatgtgtgtggtttgtgtggtgtatgtgtgtgtatatgtgatgtgtgtggtgtgtgtggtgtatgtgtgtgtatatgtgtgatgtgtgtggtgtgtgtgtgtggcgtatgtgtgtgtatatgtgtgatgtgtgtggtgtgtgtgtggcgtttgtgtgtgtatatgtgtgatgtgtgtggtgtgtgtggtgtatgtgtgtgtatatgtgtgatgtgtgtggtgtgtgtgtgtatatgtgtgatgtgtgtggtgtgtgtgtggtgtatgtgtgtgtatatgtgtgatgtgtgtggtgtgtgtgtgtggcgtatgtgtgtgtatatgtgtgatgtgtgtggtgtgtgtgtggcatatgtgtgtgtatatgtgatgtgtgtggtgtgtgtgtgtggcgtatgtgtgtgtatatgtgtgatgtgtgtggtgtgtgtgtgtggcgtatgtgtgtgtatatgtgtgacgtgtgtggtgtgtgtggtgtatgtgtgtgtatatgtgtgatgtgtgtggtgtgtgtgtggcgtatgtgtgtgtatatgtgtgatgtgtgtggtgtgtgtggtgtatgtgtgtgtatatgtgtgatgtgtgtggtgtgtgtgtgtggcgtgtgtgtgtgtatatgtgtgatgtgtgtggtgtgtgtggtgtatgtgtgtatatatgtgtgatgtgtgtgtgtgtgtggtgtgtgtgtgtatatgtgtgtgtgtatgtgtgtttgtattctcagattctgagagcaaggcctctcttttcctgcacaagcctgaagtcttctcgggtcaccgtgctgggcgcgtgctttggggtgcgttgaccgtcatgttgcgctggcctgccctggggtaaactctcgcctgcctgaaccttggatcttagcaggagaaggggttgtgccacgtgggtgccgtggccctcgtcctgctgggtgtccccaatgccactaaccccctgctcttcctccccctgtcctgcaggagctgtgccgccagcgtatggccacgcggccaccagaccgacctgagggcccgcacacgtcacgcatcagcagcgtctcatcccagttcagcgacgggccgatccccagcccctccgcacgcagcagcgcctcatcctggtccgaggagcctgtgcagtccaacatggacatctccaccggccacatgatcctggtaagcccagtctttgcactccctgccacacaaacaccagggccctccttcctcggcccctgcaacacccagcatctgcgcccgctgaccctcggggactgggcgatgatggctgcaccctgcccgctgcagaggctgacaggcagggctctttctgcagggagtcttcttaatttagataaacaagaatatttacttcctgagatctttgccgtgcttctgcctggaacgtgcagcccccacacacagtccctggtgtgtaagagtgagcacccgctatttagttttcagtggaatacacgtctgttagtgcctaccatgtgcgctgccgttttgggcctctgactcggaagcagctgctgtctccttggcactcaaggccagcaagcgtcatttgggtaaataaatgtcactgctgtgacagcaaggcaggaggaggtgtgggctgggtgctcggctcttcacaggagccttcctggtggcgccggccagaggctcacggcgacgcggcttcagcggccttttccagggtcctcgctggagtgatcacgcgtgtgtggccgtgcattgccactccatacataatgaatgtccgggtgttattaggacagctgtcaatagcgcagcacgtcctgctggctgcctcctggatctccaggccgtaggcgtcgtcctggtgggtgaccgtgcctggctgtgctgtttcccgcactggagacggagcctctggggtgaaagggcagagcctgttacgctgcttggccgaagcagcggctgcacttacgggtcagggaaacattcttcgccgtacca[450 bp omitted]acccgggagcagacagctcgtggagttcactcggcagacctgtcatcgactttggcagaacctcctcccttgatggactgtggttttgttactttagatctgacttttctgaggctgttttgacatttgtcccttttagaaaaggagcagagaccaggagttcatatttgtgatgagatttggtattagggccaaacccatcagccaaagacattcatctgacaggtcagccaagaggagagccgcttagcgagctctcattgtgttctgatatttccacatttcaaggtgcttgagtaacaatttgatgatatctcaagctctattggtacctggaaatactgtatttctcagagaattgtgtttggcattcacatatgtaatggcagctctgacagcaagcaccacttctgctggaatgcctaaaccgcaaggacagactcagcctccacctggcggaaaccctgcaaagcctgactccagacaccctgttggggggtcatcgagggccacacaccgtgacggggtcctgtttcggaacgcgtctcaccaccgcccacaactgcagggccgaaacgagaaacacactcaggccaagtatgagtccggctgacttagactctgtgcgtacagattgtaaactcagggaaactggatcttcctcatcaaccaatgctgttttgaaaatgaatgttactgagatatttccctgactccacgatgccagcaggtgctggtgggagtcagggtgggtgtggggagcggcgggcacagtgtggagttggggagggtgtggggagcggcgggcatggtgtggaattggggtgggtgtggggagtggtgggcatcgtgcggagtcggggtgggagtgggaagcggcaggcgtcgtgtggagttggggtgggtgtggggagaggtgggcatcgtgcggagtcggggtgggtgtggggagtggcgggcagtgtggagttggggtgggtgtggggagcggcgggcatggtgtggagtcggggtgggtgtggggagcggcgggcatcgtgtggagttggggtgggtgtggggagaggcgggcgtcgtgtggagtcggggtgggtgtggggagcggcgggcatggtgtggagtcggggtgggtgtggggagcagcgggcatcgtgtgcagttggggtgggtgtggggagagacgggcgtcatgtggagttggggtgggtgtggggatcagcgggcatcgtgtggagtcggggtgggtgtggggagtggcgggcgtcgtgtgcagttggggtgggtgtggggagcagcgggcatcgtgtggagtccagcaaccaagtgggccagacgtgggccttggaccctggcgtctcctctcactcagcagttctgattttccttcctctgagctcactttacaagtgcattcccgtgccctctcagccatgcggggtctcctggtgggcatgtccctggtacaggagcagagaggcacagactcacgccacaggtgagctccaggtagacctcttcccaggactcacacaggtagccttttaggctcggaagctacagccaatctcggggcactgaccgccaccctccctggcacacacaggctgtagaaagcacatgcaggttggtgccgcaggaacgcatcagagtcgccgaccttccgactcatcacagctacaaggcagccaattccgtggtgatccagcagcccagccctctgtgcgcaaagcctcgtttccgccagacacccaaccggccacctcagtgcccctcacctgaggatggcaggatggtcagataagccacagagattcccagcgacatgttcctgacatgcagccactcctggggcacgttggacaaaacgtggcatctgaaccccacgatccgatgaaataaacagcagaggttggtgatgtctggaggccaagctagatgtgaggagccccagcaggtgggagaggccggctgcaccgtctggggggcaggctcagcaccaagagcggagactttctgtgacaaaggacacatgtggcagggtggaggctgcacactgccccggagcccagaccttcaggcggggctggcctggctgtggccccacaggaagggcctcctggccccgagagccccctcccgccctggggcactctacccactggagctcacgctgctgctttctgcacagaggctgggattccgtgctggagacccggagtaacagaactctagaaatgagcactccatctagagaggggagcatacaacactcttataaaggagacaggccagggtgtgagagaaggaggcttccctgggagacaggaggcggcaggtgcctgccccgatggggggatccatggggctgtgcagccactgggtgtcaccaggaagaggctggtgtctcaggactgcagggagggacttagttacctggtcaaggtgtcccagcaggtggaacaagagggagagcacacgtctcagggacccccggggaaggggccacatgaaagcctgatgggaaggggcaggggtgggcaggtcattggggcagccgctgggtcccccgctctgccatgacagcaggtggtcaggtctagatgtggagcacagattctgggctccatcagcaaggtgtcagagctgagacgctttgctgttgcaggtgctgtgtcccaggacagacctccaaccttcttctcccctgtgagacgggcttgatggcagtgcctttcccctggggttcctgtgagggtaaaaccgggtgagcatctgagatgccgcccatcctgagacctcacctgtgccgaaggtgcgtcgggctggagaggaaggggttgtgctgaaggaacagagcccggcggggcctttgcttggtagggtttgggcctctgggcctgcattctctacactctgcctgatccctgtctctgggctttgattctggtttttgtgttgctttgccttcattttcttagaaaggtcctttaaaaattccagttttcttctgggatgaactaaggagaaagggctttatttgcagggaaaacccagcccagaatgtcacttgttcctggaaaatgggcctcccaggcgcagggaaggtgcagtccgtgcccctgccttggactgtctggaagaagctgagtcgaggctcacctgcgggtgaatggagcactcagaggagggagaggcaggaaggaaacacttccatcaagaaaccggtacatttctctggaaacggccgaaaggcaacacggagatgctcactcagagcaaggctcgggactctgaaaagcaaggacgtgatgaaggcgacttcgcaggacggttatcaaagcggctgcgtgttaatcatctgcggggacgtggcttctcaagaaatcctgtcacatccttttgtaagataaagaatcatcgagttttttcaagatctgtttccctatcactttgctttcagaagggtgacatttctgcctggctggctctgagtgaggaggtggagaagagtgtcaccgtcccgatgtgactaattacgcctgagtcggccgggagccaccgcgtccacctttaaaggctagagaacgttttttggagagtggggatgttaagaaaaaagttggcttcatacttctccattcgacttaaataatatagaacttaacttgggaaagccgtgctgagtaagtgcttttcagaatccatcctcttgagtgttgaagatgaggatatggacagtgatctttgagttcgctcatccttggagagtcctgaggcactgagggcacaggagctgtgagtaggcccatttcacagatgacgacattaaaaccaagcgcagtgacagagacgtgaaaaacgaaaagttaggcattgcaggaagtgaccaaagatttcccatgatcacagaaaacaggaaagttcatgaattttgctgaggagggagggggtgctgccagcctgtggagtcgcgccgcaccttccgcagatttgcctgtggggtttctgaactcccagcgtgagacgcgtgatgcgtgtctgtgctggcgaccaacagatgccggcacaagctgtgacctcctcagacccacacggctcacggcctctgaacttcggccctcctgcctgcctggagtcttccctgggcccgtcgtgtctctgcctgtgcaccttgagagatctctgtctctcattgtttgatcttgtcaggctccaggcttcttagttcttagcgataagtcaccgaaccaggagggcctcgcgaaaccatgccagatgtccctgcccaaggctgcaagtcaccagctgcagcagaaaggggctggggtcccctgcaccccacgccaccagtgccggggccttggcaggcgctcccctggccccagtccctccaccttcagacccagtgccctgtatttctggaagattccattccatcgttcccacgtggttgacgggcacagatggctgctctcccaggatgaggggcactgggccaccgagaatttcactctggggccacgcggctgggctggccgttctcgctctggctcgggtgctggcgcggaggcctgatgagtaaaccaggccgcagggcgaactctccagctttgtggggcctgcgttcacagacacggcaggccgttgctgctgtctggacgatgccggctttgtggcgcacatttggaggagcctatttttgcaggaaagctgtttctcaccattgaggactgcgtggcataggcaaggcctgcacatggaggggtacatagtccccccttcccagcacggcgggtgggggtgtgccctgccctgatggggagcccctgcgggggatgtctctctccggcgggcaggtttgggaagccttcacgccacacaggaccaggcacggagccccatgaccagagacggcattaaaccagcagggaaggggaaagctggggcaagaggcagagccaggagaggaggagcgtccaggtgccatagtagccggctctggagaccccgagacttcccagcctcactcctgcgggcctggggagctcctttgagagccatttacgcgtccaccgagttcagtgcacagtgaatgggtccgacccaccgagttcagtgcacgctggatgggtccaacccaccgagttcagtgcacactggatgggtccgacccaccgagttcagtgcacgctggatgggtccgacccaccgagttcagtgcaccctgggtgggtccaacccaccgagttcagtgcacagtgaatgggtccgacccaccgagttcagtgcacgctggatgggtccgacccaccaagttcagtgcacactggatgggtctgacccaccgagttcagtgcacagtgaatgggtccgacccaccgagttcagtgcacagtgaatgggtccgacccaccgagttcagtgcacgctggatgggtccgacccaccgagttcagtgcacagtgaatggatcggacccaccgagttcagtgcacagtgaatgggtccgacccaccgagttcagtgcacgctggatgggtccgacccaccgagttcagtgcacagtgaatgggtccgacccaccgagttcagtgcacagtggatgggtccgacccaccgagttcagtgcacgctagatgggtctgacccaccgagttcagtgcacagtgaaagggtctgacccaccgagttcagtgcacgctggatgggtccgacccaccgagttcagtgcacgctggatgggtctgacccactgagttcagtgcacagtgaatgggtccgacccaccaagttcagtgcacgctggatgggtccgacccaccgagttcagtgcacagtgaatgggtccaacccaccgagttcagtgcacgctggatgggtctgacccaccgagttcagtgcacagcgaatgggtccgacccaccgagttcagtgcacgctggatgggtccgacccaccgagttcagtgcacagtgaatgggtccgacccaccgagttcagtgcacagtgaatgggtctgacccaccgagttcagtgcacgctggatgggtccaacccaccgagttcagtgcacagtgaatggatccgacccaccgagttcagtgcacagtggatgggtccgacccaccgagttcagtgcacactggatgggtctgacccaccaagttcagtgcacagtgaaagggtccaacccaccgagttcagtgcacgctggatgggtccgacccaccgagttcagtgcacgctggatgggtccgacccaccgagttcagtgcacgctggatgggtctgacccaccgagttcagtgcacagtgaatgggtccgacccaccgagttcagtgcacactggatgggtccgacccaccgagttcagtgcacagtgaatgggtctgacccaccgagttcagtgcacagtgaaagggtctgacccaccgagttcagtgcatgctggatgggtccaacccaccgagttcagtgcacgctggatgggtccgacccaccgagttcagtgcatgctggatgggtctgacccaccgagttcagtgcacagtgaaagggtctgacccaccgagttcagtgcacgctggatgggtccgacccaccgagttcagtgcacgctggatgggtccgacccaccgagttcagtgcacagtgaatgggtccgacccaccgagttcagtgcacagtgaatgggtccgacccaccgagttcagtgcacactggatgggtctgacccaccgagttcagtgcacagtgaatgggtccgacccaccgagttcagtgcacgctggatgggtccaacccaccgagttcagtgcatgctggatgggtccgacccaccgagttcagtgcacgctggatgggtccgacccaccgagttcagtgcacagtgaatgggtccaacccaccgagttcagtgcacgctggatgggtccgacccaccgagttcagtgcacagcgaatgggtccgacccaccgagttcagtgcacgctggatgggtctgacccaccgagttcagtgcacagcgaatgggtccgacccaccgagttcagtgcacactggatgggtctgacccaccgagttcagtgcacgctgcatgggtctgacccaccgagttcagtgcacgctggatgggtctgacccaccgagttcagtgcacagtgaatgggtccgacccaccaagttcagtgcatgctggatgggtctgacccaccgagttcagtgcacagtgaatgggtccgacccaccaagttcagtgcatgctggatgggtctgacccaccgagttcagtgcacagtgaatgggtccgacccaccgagttcagtgcacgctggatgggtccgacccactgagttcagtgcacagtgaatgggtccgacccaccgagttcagtgcacagtgaatgggtccgacccaccgagttcagtgcacactggatgggtctgacccaccgagttcagtgcacagtgaatgggtccgacccaccgagttcagtgcacgctggatgggtccaacccaccgagttcagtgcatgctggatgggtccgacccaccgagttcagtgcacgctggatgggtccgacccaccgagttcagtgcacagtgaatgggtccaacccaccgagttcagtgcacgctggatgggtccgacccaccgagttcagtgcacagcgaatgggtccgacccaccgagttcagtgcacgctggatgggtccgacccaccgagttcagtgcacagcgaatgggtccgacccaccgagttcagtgcacactggatgggtctgacccaccgagttcagtgcacgctgcatgggtctgacccaccgagttcagtgcacgctggatgggtctgacccaccgagttcagtgcacagtgaatgggtccgacccaccaagttcagtgcatgctggatgggtctgacccaccgagttcagtgcacagtgaatgggtccgacccaccaagttcagtgcatgctggatgggtctgacccaccgagttcagtgcacagtgaatgggtccgacccaccgagttcagtgcacgctggatgggtccgacccaccgagttcagtgcacagtgaatgggtccgacccaccgagttcagtgcacagtgaatgggtccaacccaccgagttcagtgcaccctggatgggtctgacccaccgagttcagtgcacactggatgggtctgacccaccgagttcggtgcacagtgaatgggtccgacccactgagttcggtgcacgctggatgggtctgacctcccagtggctgccatggcctttgggcccggtgcagacccaagtatccgtcctcacaccctaacttgcttgaggggacgttctagagcctcccgtgtccatgcagccacccaagccacagctcctgcttgacgctcctgggactctgttctgtacctgagactctcacagggcccggtaccagtgggacccagcctcccctgtgcaagggcctcccctgggtgggaggacatgggctgttaattagacccgggttcattagacaggtgtgttaggctgttgtcacactgctatacagaaatacctgaggctgggtaattcataaagaaaagaggttgaattggctcagggttctgtaggctgtacaggaagcatggtggcctctgctcctggggaggcctcaggaagtatccagtcatggcggaaggcaaaggggagccaagacgtcacatggcaggtgcaggagggagagaacagatggggagtgccgcacacttttaacaacaccatctcaggaaagcctgctcactatcctgaggacagcgccaaggggatggtctaaaccacccatgagaaaccaccctgtgacccagccacttcccaccaggccccacctccagccctggggctacatttcaacatgagactggccaggacacagatccaaaccacatcacaaggccatgcggaggcagcgcctactgtgtgcctggcaaacagttggcattcagtcagtgatcagcaggatccctggttctgctactttggggttttggggtacaggctccactctcttccctgaaaggaggcccttcatctgctaatctctaaactgaaagattttagcccttacgtcttgcacctttttcaaaagcagctttacagtgacctaagctctaaactcgtggttttctttgtcatattgtaccaaggggtgggactgtgtcccagcaagcaagtcccgggctggtttggtctgggacgtgcttcatgaagacattacagccactcggcatcattgtggggaaggtaaccacggcaggggtgcccacccacaccgggactctggggcccagccccctccccagggccagccggtgctgctgtggtcatgtggtgcgtaaacagcagctcctcacatgacgccgctctcaggagagggccctgcatgagtgtgtacagcccggccccaccctcctaacagccatatgttctcctgttattggacgcacagaaatttactgtctcctagtaagggcaatgtaggcaatttcaaacttttgccactccagactacacggaccatgtgaaatgtgagtttttagaagccagatcctgagtcatcgcggatgcttattgtttattttgatagatactgccacattccctgcaataatctttgccaagatggcgtccccctagtgccatagacatggtacctctgtcccaggtctcccagcctcaggtatcagcgaacctttgaactttgccgctggtaggtgggaagggctgcatccaagtggttttcacttctgtttctctggcttgcgtgagactgagcatactttctcatgtttgggagccgtttatggttccttccaagagtggttttggacacagtcctcatggcagcaaggccagcagcctcgaaagcctgccaagtgcaagtgtggcacgtccacgcaacatcaatcacaggtgctgtcacggaaatggacgtggcagtgaaactgttctgctcctgttcgtctcctccgtgtccgtcatcacagccacagtcacctctgagagaggcagtgatatcgattaattagggcaaagtttaggaagaccaaggagaaagagaaagccctctgagagttcttgtcctgtccagatgtatgtgaccaggtgagaaaggagccggctgggtagctcgggcccgtgtggttcccacgggtggaaatcgtgcataggattgtagctcagagcagacagtgctgctgcttttgttttgttttcttttgttttttgtttttttttttttgttttttgagatggagtttcactcttgttgcccaggctggagtgcaatggtgtgatctcggctcactgcaacctctgcctctcgggttcaagtgattctcctgcctcagccttccgagtaactggaattataggcgttagccaccacgcctggctaattttgtatttttagtagagtcggggtttctccatgttggtcaggctgatctcaaactcctgacctcgtgatccgcctgcctcagcctcccaaagtgctgggattacaggcatgagccaccgcgcccagccagagtgctgctttaattgatgaagcaagaatggggctcctgggagaggcgtatgctggctatgtgaggtctgtggacctccaggggcctgccctggcctgctggggctgccgtgacgacatccctcaggctgggcagctgaaaccacagcagtgtcttcctcacagtttcggaggccagaagtctacaatgcaggcagggcttgttcctcctgaggtctctctccgtggctggcagatgacatctttttcctgtgtcctcccagaacctttcgtctgtgggagcacatcctgctctgtcttctcaggacctcactcagattggtctggggccaaccccagtggcctcattttaactccatcatctctgtaaaggccccacctgcaaatgaggttatgttgcggggtaacctggaggggattagggaggcagcacatggattctagggaatggttcagcccgtaacagggaccgacgcctgatgcacaccagtgttttctggtagcttgtagcgcatgagaggcccctggtcttccagccacagtcccacgggggaagctccagtctccccgcactggtgagctgagcgtgcggcgagcactatgaggctggccggtgtctgggccctgggctgtcacctgccacagcccggactgccgtctatctgctgcacgagttggtgacgaaccttcgaggcctgacggagaggctggtgagccactttagacaccaccactttctagagctcagctcacacttcctggctggagcctggccgcctgctcccacctcctttactgtgggtgcgggtgtctgcagggggtccttgggaagggcgcagacagaggctggaggcagcagcggctgtgcaaggaacaggggctccgtcgggggagcagtcacagccactggttctggatttccctgggatgcccgggccgtgggtgtgcccgtcctgcagcagctgtgccttggtcagcggccatcacggccttcccctgcagcccccacacctccgccacagtgccccttgcagcgctctgtggatagttgggttgtgacacaggcagagagtgtcccttccatgatccgcctttattgagggtgtggaactctatttttttgtgggagggggagtgatttgactttttattttttaaaaatctgatttgctgcttaaaatgctagagccatgctagtgctttatttttcagtctctccaagttttcaatatgttgtcttttctgccttgagcacttaatgtttaaaggaaaaattctctgaccccaatctgaccagtccctgctgccatgctggccccagcgagacaagtggctgagtctataggaagagtttgtaccatctttagtatgacagatggtgggttatgtcccaacaaacccatcgtaagttgaaagtgcatttttgacttaatgatattttcaactccaaagaggtttatcctgccatagccccatcataagcggggactacctgtatatttacgacctggtttgattggatgtttgggctccagagaaggtgggtgatggtccagagagtctgcgggagaaagaggtaagctgctgtgatgcagcttggcctttggctgccggggcgattggcttaggtaaatggcacccactgtcccgcagccctgcgttttagctgcttttttttttttttttttttttttttttttgctgtttcttgacttggtagacccttcttatagtgtgtgaatggggcatgatagaagaagtggaatcaagcatccaactcatacttgttgaattaaattgggtaaccaaacattaaacttggtaaaagttaacaggtccacgaattaacggttgtgggaggaaacacttgaagctggtgcataaagtcaggtctggaaagtgctcattcgtgcagcgttttctgagcacccagtgacggacggagacgtccacaggctgctcgggaactcatggaaacttcctggagaaacccgaggcgaggaggcgagaccagaggccgcctccatctggtctgtccagtgactcctgcatctgcaggtttatagacagcatcagaggaattgaatcacagcagttcagggcctggatggagttatctgattctttgtgtaaatgtgtaaacctaacacgagtttaataaaatgcagcttttgaaattccacaagcagttcagaaatgagctggcgtcaggtgggctctgcttaccttcatgtcctcagcacggctcctgggcagaggaccatggggatgctgggtgtgaaggaggccagcagtctggctcctaagaggcttacagccaatttggggcaaaagggggtgaagggctggagaaacactagacattgccacacaccaagctgcattcttttgctagaagacgtctctgtccttgacgggagtgtcgggcgtggcaggggggctacagaggagacttgaggtggacatttgagaccaggttttggtcggtgaagacagctgtgttgggcaggtggcatgcagaggagggaacagcacagctccatcaggaagcagagggcagttcacagaattggagttcacggtggaaggagcagaagatgagctcagcctggactcgagtgaacaccttgagccagacgtcaggtagctttgtgcgtccacatgtggagtggtgcttgactccacatgtaattgttgtgacttcttgaacccgaaaagtcgacattattcacttatttgtgtacgtttgcagaaggtgggagcacttaggatgcatgagccagggactgagtgggtcctgacttgtcactagtgttttctcttctggagcaagaggacagtgatcttggaaagacaggaagatttggtgctgcagtgaaaagatggtgccacgtccagagtctggcttcccagtgtgacatctgggccagcattacatcctgtgaactctggcttccccttccacaaaatatggctggttacaaaactcatgcaaccatactgccgtaaagaaaaataatgacgcccactgtgggaaaatctcctaacatactgcagagtattgcagtgacgtttctaaaattatagaaaccatgttgccaagtaagtttttctttaaaaaagctaatctctcactcactcagtgtttggcctgtgtacatctcattctttgccttacatatgccctgcattttctgagttgtattttgttgcagcatcctctcctgccttctgtgggaatgaatgggttttctttattccctctctcccccttggctagttcagcagttatactttagtaattatcctgatacttttaataaccatgcttggcttaacaatatctggagttcacatttctgccctcctcacaaataaacccaggacctgagacacagacctcagctacctccctctgacacatacagtattgttcagtatttcagttgtgccttgtctttgtatcctgaaatcaaccgtttgttttactagctttcatagtcagcatttgttcagaccgactctcattttatgaggttcccctctccccccatcaccattccttttactgctcaattcttcattttgggtaaaactaccttttttctgaaagatatccttctttcagtcttttattgggaaagtttccttctctttgtctgaaaatgtctttgatcctcacacttgcataacagattagccaagggtcaagttctatttctttttcttttattaccttgaaaccctgttctcttgtctctggtgcccctgcacttgagaagactgtctgttgctggtcggatggtggttcctttgtgtgccagctctagctccttcctgatcgctatgtctgatggtggttcctttgtgggccgctccttcctgattaacctttactgttttggagtttccttgtgtcctgtcttggtaaggacttattttatttttaatttttgctccaaacttactgtgattcctgaatctgagaattcctttctccagctaatcctaaaaaattataaaccatatataatttacatttgactctcttccattctcccctctaatggaaataagttgtaccttcttattcccatgtcccttaaatccctttcctattttctctatctttctgtcctgcattccagggaatttcctcagatctgtcttccaacatacagtgtttctcttcagcagtgtctaacctgtaatccatgcattgtagttataatgttaaagagtatggttttcacttgaagttctattttgttctttttcagatcaacctgctgggttgttcttttcttaaattgttggttcctactttaacaccttcaatcatgatcaatgcattatccgatggtttctaacacgtttattaaggtctcatgggtctaagcctgctctttgatgtttgctgatttgctcatggtagtttgttgtctggtgggttctataattccagattataagctcctcattggtggggctttagttctagttttgtatggccctgttctgagagtattaacctcaagagagcttttgccagacacactaggctgtcattaaactgagactatcttcatgtcaattcctcacccagatcactcatgtgtttgagcctcaattctggatgaggcccatgtttcaagcgtcttcccattttgagtccatatggtgacagacgagattcctgtggtgtgagcacacccatttgctaagggtgtggttgttgagggtcctgtgttatgtggggggctcgggtccagctctctacctccagcaaggcagggttttccctgctggccccacatgggcagcaaagtccaagaccctgattttagatgtagggaatcctgtcgcctgccttccacccagggcttgagcggcttcaggccgcacatcccccattccagtttcactttctccttcagcttggattcctggggatttcccttaattctgtgaaaggctgactgtgccatttgtccagcattctacgtgtctgtggaggaagacacttcaggttatctccttcttcatatcactggaaacacacatgccatgcaaattacacaaaggaaaacagtgcagaggccgcactgtgcttcatctcacatcacattgacaattgcctccaagaaccaactgtgtgttctccctaataaagaaagatagctgggcacagtggcttacacctgtaaccccaacactttgggaggccaaggcgggcagatcacttgaggtcaggagttcaagaccagcctggccaacaggcgaaaccccatctctaccagaaatacaaaacttagctagatttggtggcgcatgcctataatcccagctactcaggaggctgaggcaggagaatcacttgaacccaggaggcagaggttgcagtgagccgagatcacaccactgcactccagcatgggccacagagcaagactctgtcaaaaaaaaaaaaagaaagaaagaaggaaagaaagacatcctaccgatggctgtctagagtcaaagatgagcaggtaatgatcacattccgccgggtttccacactcacctttctgtaagcagtcaaagggatcgctgtgtccagaatgctctgcctctgggagtgctgatgggccaaggtctgcagcaggtgagcagcgagtgggccctgacggctaatgctgatggccttagggaagtccaggtggtccacgtggctgagtgacgacaaggcagctgcagggagggacagatgagaagtcccagcaagaagagtgaccccgatcatccactcccacctcaccctccaaaccctgggaatgccagcgggcatgtcatttggtccccatgccgtgtgactggcactgagctgggaaaagatgtaaaatatctctgatagtctcacctctaactcttcaccctgaaaagtgaaaacactgtttgacatatcagctctctgttctcttctcctccaaactcctcgtttcaaagcaattggaagaggagtggtgaccagtcaacacttggtaattgtggttgactatggaagcctgaatgttctcttcccttcaccaacattttagaaatttcactgctcacaggaaggtctggaaggtggaggaggtagactgagccctccaggctcagttccttgtgagcacgtttggttggtgaagagctggatattaactttgtctcgcacatagactgacccctccaagctccgttccttgtgagcacgtttggttggtgaagagctggacaataactttgtctcgcacatagactgaccccttcaagatccattccttgtgatcacgtttggttggtgaagagctggatattaactttgtctcagacaagcaagtctttctggtatttttggtgccatcaccttgtcagttgttttgttccccttttcttgtattattgctcatgtgcatatagcctgtgggttttaggaagtgaagcatcaaaacattctactttcagtgagcacctttagaacttcggcattttcaaataaggtgctatagaattcagtgtttctcctctgcttatggaagaagacatgcatgtctccatcactgtcctaagtaacctttacagcacttgctggaactctttattcttcctaaaaacttcatcagaaaatcgtaatgagtacatcgttggcacagaatagagaatgctgctgctaagaaaagacctgctacttgggagcgggagaagctgtctatgcgttgcctggcaaccgcccctcctcatccttcttctgaaaggtctccctgttagaaccactgtcgtcatcagtggagtaaaaatggtcccctctgggctgcttctcctgggtcgggtgccagcaaaggagtctggtctctgagagaatctgatcataccgttttggccatatgggctttgtaggtgaccatcagggtggggagaggtgggtgcatgaccacttaaacaaatgggtctgctgccacacaaagcatagaaatcgtgatacgaaacggcttttgaagggatcttacggaaaccgccactccccaggctgctggaggctggtgtggatgttgctgctgagccaccccgattcccccacccagggctgcttgtcacagagctgggatgacaggggctgctgttcactttagagattctgctcttctcctagaatatgttagtgtggtaggagacctcttcagggcttagttacgtaaaggttgcatttcatgaactgttttctttctcttgcaccctcttttcctatgatctgtttggaatccaaggttggttttcagctgaattttgcacactaatggaatttttaagtaactcatggcttaaactatatttcatatgtcaaagggatatgttcgaagctagagtcaaattcttttctcattgaataaggaatgtgtattgatttatattaataaaaaaatgttgtagaacaaatatttgcaaatacatttgttcatattgttcaaataagttataaaaagtaaacagaaatatagttttttccaacttcctttttctggttataatattccgatttctcttcctcatcaaaggcttagaagatatttactttctttgtaaaggttagcattggtttctgtgttaaactatctatagttaaactttgattatccaaatggaatgagaggatttaattattgctaagcagagaggtttaaaatggacgggaaaagaattgggggagtttaatctgtttagaatgattgagcattatctcttcatcttccacgccatttctccaaagttctccagtgttttccattcatctataaaggtgatgaccgcagatcctggtataaagaagacacctgaatagtaaactttgtgtttgataaatagccatttcaggaatttgaaataccatgggtaaatatttgaaacttctaaaaggcagaaatcagtagaaatatatgggtagacattttaaacttctaaaaggcagaaatcagtagaaatattataagactgaattaatttttcattagacttgttttaatcgaagtagctgcagtctggtattaaaatcatcacactgtcaattgttgttgttgttttttttaactgtctgtagaccaaaattacaagaagaagagaaacacacaaaggatatttggtaaaggcaggtggtcttgatgaataatgttcctttcattaacatatttcccttattaactgtgtaattaattgtacatagccaagggaagctatggaaattgcattttgagatgtatcaaagctgacttatgcttcagacttccatgcaatttaccattaatgaagccagagatggaagcctcaaatctataattattacttactgtttgaatgacaagcaaagaattttatcagcagagttttaaatgaaaggggattagcagctaatgttgaaattgttaatctttcttatgaaaataattttgaagaaaatgttttagtggaaagagagggttggggaagtatttgccattaaaatagcgatttcctgatacttcatgtgactttgtctacatttgacagcagggtgcaaatatttttgaaagtgaatgaatattttatagggtccagagctgctcatgcattctgggaatggattatgcaatagttccaaatgtcctggctggggtgagagactgtaagctagccagaggaaagagctgaggctaagaaaataaaatataggagaaaattatagaaaatccaaatatcctggctggggtgagagtctgtaagctagccagagaaaacagctaaggctaagaaaataaaatataggagaaaattctagaaaatccagatatcctggctggggtgagagtctgtaagctagccagagaaaagagctgaggcgaagacaataaaatataggagaaaattctagaaaaatgaaaattggtttattgtcccagatctgtacccttctccccctctgattgttcacttgattttagatggtgaatgacaaatattggtgaagaaaatcattccatgaaacactggtaaccatttgtccgaaacgccttcatggcagcactgccgtggctcagtacattgcacctgcacttccaaagtgaaggtgactgttacctgaaacccatgtgcctggcacacatgaccagccttggacacaagaggcctttgatcagaaactgggaggcactcccacattcccacaatgaaattccgtgggtgcctgtaccctgagttcatccaacacatggttactgatcatgtagggtgtaccaggctatgtcagacgttagagacaccatgaagagcaaacagttagcttatggggagtgcctaacgcacacctgccatttacatctttgtcctcatgattcttcccactgaaccaatggcactgactcaatatacgtggcgttggctggttagagcccgtgtcgctgtggacaggagaaaggacgtccagggagatggaccagtgtgccgtccttcacgtgtgttctggacttaacgtcacactcgagacatgctggctggtcagaacatctgggacctggaggcctgttaggttctttagaaagttctgggctcctcccacacgcggtgtccaaggacaacaggcaggtgaccacgtccactgcagatgtgcagttttcatctcttaaaaattctggttttctcaaacttgctgtctccctggtttcagtttgaaatggatttaatgggctagaacccctgtcagcctacgtcagcctgtgaatctttcacagaattgttttgtgttctttggaaagcagttcatgattgcaggagtcatttaataactggagcccggggggtctggaagaggtcgtacggcccctctgacctgtgggggataattcactcccaggaccatgcccggtcgcgatgcattgacaacgcagccctgtgtgcacacaggcacccggatgccttggtctgtgtttcaggagttgcctcatctgtggacaagcacatcacggcgtcccaggttaggttagtgattcggttgtctttacattttaaatttggggtttagctatgggcagttaattttctatggtactttgagcaaacttactttgacgaaagctgaatagtgccattcaatatctgaatgtcttgcccatgtaacaaaagcatgaaggctattggaaatatcagagttgtggatagaatttttcaggtttttatccagactgttaacttcaggtaacttaagggtaggtatgaccttgcttctcagatcaaatcattagggtctttccttgctgtggttctgtgaggggtgaagagtttaaacaatgacaaaatattttgcaagctaaagagctgaagacaacttaggtgtgtgaggaagggcaggtcagatgagcagacgggaatcctaggacgtgttgcctgcaggacgcggtgcaccctgcccagttctctcattcgcccgcctccactgctgttccccacgcgctgttccccatgccacagccactgcctgctcttccatggtgggctgcagcagtcctgacttgcatcctgcactgccacctgggaaccagggtggtcttccaaaagcgccaccatcaaccaccatcacaagcatctttggcttaaaactcatgaaagcttcccgtggctcttaaaataaactgctgagtccttgcaggccaacagctcctggtctgccggacaccgttgccctcacatccattccttctctgcagccccgaccttccctcctcccggagtggccacgccctcctgccctgggctccagccttcactgcccttccctgtaggaccccacccccactcaggccctgcccaggtccttagcatcggggactcggcccatggctctgagagtttacccttcagaggggccccctcagtgccatcccaggtgcaccccgtccccacacccaggctctgcgtcgtgactcttgtccgcatcttcttactactcactgttgtctgaaatcactttttaaagctgtgtttatctacttgcagatggtctgccctccagctaaagaaattaatgaggccaggcgttgtagctcatgcctataatcccagtactgtgggaggccaaggcaggcagatcacccgaggtcaggagtttgagcccagcccggccaacatggtaaaaccctgtctctactaaaaatacaaaaatttcgttttcgtatgatggtttgcacctgtagtcctagctacttgggaggctgaggcaggaggattgcttgaacccaggaggtggaggttacagtgagctgagatcataccactgcactccagcctgggcaacagagtgagactctgtctcaaaaaaaaaaaaaagaaaagaaaagaaactaaagaaatgagccacatgaggacagggtctttggccagctaactactgtgctcccgaacctaggtcatccctggcttataggacgtgcttaatcaaactggatgactgaagggacagatgactagaccaccacaacatcggcaggaatccgacagaaatgacagcagctcttagccctctgtcccaaaaccagatgaggcattcacatttcacttagaatgccaagcagacctcttttgccctaaatttaaatattaatagctgtacatttatggaaaacatagtataattctctgaattattttccattgcttataagcattcatctctgtattttacctatgttcacataaccttaatttttaagatgttaaataagataataagattcataaaattgttcatttaaaattctttgcgcttctctgagaatgacagcctgaaatacaaagtgatgcctctgtcatcatccccattattaaacagcttctttcttagtctttctgcaggtgacccctgtcaccccctcctacgcacactccctaatatgatatcttgctaaaaaatgcccaacgtaaaacaatccatcaatcgtatgaaagaacaagactttcccctacttagtaagagtaggtggtaaggaaaaaattacttatctttttaagtttattaattagaacatttctagaacacaatgtgttcactattaacatcttccattggggtttttgttgttaagtctttatcaaattgtcatatttttctgtaaatgtgtaacagaagtttagtggaagtcataaactgaaatcgaggatcaccaggcgttggtgcaccaggccacctttccacgcatcgcaggtcttcatgcagtccttctagaggtgaggcagagactgggccggctgtggactccaggaagtaccctgcaggtcacctgggcattgtgtaagaactcctttgtcagtgtgatttcttacaactctggactttgttatcgatttggaacatcaaaagccaaattataataaaaatacactaattaaagtttctactcaatcaagatagagccagttttcatgtcctcttaacacaccactttgcaaagagttaaccttcctttccctttgctcttcggaaagtacgtaaggtctgtgatcatgtcccagtgcctctattagaggcaaggaatctgtcctcttacagtgtttttctaacaggactttgaaaaaagcatgtcattttcttgacagccttatctgaagggcattcttaattctctctttttttttttttttttgagacggagtctcgctctgtcgcccaggctggagtgcagtggcacaatctcggctcactgcaagctccgcctcccgggttcacgccgttctcctgcctcagcctcctgtgtagctgggactacaggtgcccaccaccacgcctggctaattttttgtatttttagcagagacggggtttcaccgtgttagccaggatggactcgatctcctgacctcgtgatccacccgcctcggcctcccaaagtgctgggattacaggcgcccgccaccacgcctggctaattttttgtatttttagtagagacagggtttcaccgtgttagccaggatggtctcgatctcctgacctcgtgatccgcccgcctcagcctcccaaagtgctgggattcttaattctcagtgagtgaatttatttttcaatgatgaaaaagttttaaataaagcagatagttcagtagcgttcccggtctcaaaaccaacacgcaccacacgttgtttccccttctacgctttgttcctgccgctgctacttcaccttctccacccgaactgcataccaactggggactttctccggaagattccattttgaagtatttgaacttttctccactaccttaatggtttataattttctgttactccacagtttgattggtaacaaggcaaagaatggaaatggatttctaagtcacattaagacgcagggagaacagttttcaagggtctctgggcttgccagagattctaggtggtcctcagaataggtcagctggagacaaaactctcagagaaagagcttggaataaatggcattaattcacatccatcagggaagccagttgtggtgcccacaggaggaggcttttgccagtttcatctgtgttgaccacttcccagttccctgcggtaagggaagcatatgacttactgcagatacgtgtgggaatgcctcctccttacaaacaagttgtcaggaaagcagtttttaaaatgtgatcaaaagcgagaagaccccatgaatggtctttcacacactcttgttaattccttgggtcccatttctacttctttttggctttgtacggatgacccagaggctgaattccaaaaccgtgtgtttgcttctcccgagcaaactccaccctggcatgcaggcacacttcgagttggctgccatgggcctgtgccttttggtaatgtgtgcatatctgccctgcatctcaagttgcttgtttggagagccggaacaatgcctgtttcagctgttgagtaagacccgtaattccatggcaagtcaaaggtgctgccgtgacgggcacacggtgtgttagaggagcgggatggtgaagaagccggttcactccctgccgcctcacgttgtgggcattgctttctgagagtgagatggcaagttgaatatggtcgtatgggtcgggattcctgtttcaggaagagctttcttaaactaagaaatagtgaaactatcttctgatcctttaaccattatctgttcttctttgtgttcacatgtactactttgaatttctaattttaaatattttaacattcctgctgcataatattaacaaataatatttaaaatatgccagatgcagcaatctacagacaataaaataccttctcatcaagggtttgctgctcccgaagcccccatagctgtgtgtgctgagccaggacaatcaacctcatcgaacttctcctttcatcttttcacagttttgcttggaattcaattgtcctacttttggaattcaaaaatttaacatgaatatttcccgttcatgtattaatgaagacaggtgactgtgtttatttttaaagaaagaaaaggtcatcatttccccaagtggcagtggaagcagcttagtccttgcttttaaaagcattactctaacttgtgacttcaacacacaaacctgtggtctcgtcacaagaaggaaaatgtaaagggattctattattcgttttaacaaaaggtttgattgtaatgttcagtaaattaaagggcattgtgctgcaataggcgccattgtagaaaagagaagtatagccttcccagtaatgactgggttccccaaagcccagctttctttaacacgccttgttctacagtgggaagaagtctccactgctggcagcatcgttgtaggaacgaagtttcaccaggacagtttccactcgtcccatatccgaagacccacggagtgatgatgggcgcctccagtcatccgtggggactcactttccactgcacgagtggtttgattgatgagaaataatgccagatggaccggcttttgctcatttttaaatagtccactgagttttaggagtccttaggactccttaggagttttagtattgcatggtgggagtttattctcattattatttttaataataataataaatcatcttgcacctctcagtatctcacttcttcattgttacagccaacagatagatgccaaaataacctaatttctgtgactctgaatggagctgaaatagcactgacctgctccagcctttcttctgcctccccatgggttctgcggtgtctttggcagcagggtctgcaggaacaggtgaatcagcattggctgacccaggatcccagtgcctgtggacgggattcacatggaaccacatctggaccctttacaagtctccagatgcactaccccagtactcagaggtggcagctgcacttcctcctggtgccaacaggaaggcgagcatgtttcgtgtgagcgggtcctgcatcagatgcacacgggatgctggtgtgctcttcccaccggagaaattgtccttgttaactagcagtttagtgtcacatagtctcttaaacaggcatttcctaggatttcctctcctgaagacaggccatgaaatatttccctcttcaaaaaagaagtgaacagaagagagtggacatgttgtatttccttaaacaagaggataagagtctccccagaaccgcagtgcagccacagagcgtgggagggaactcaggagtctttccagtaccctcttcctctactgaaacactgagaccgtcccgcaccccatccccgggcacacaccttctactgtgtctcccatattcacgcatcacccctcaaaacctccttgggaacatagactctggctctcccctgtgagctgtgatgaccaggttacgaaggggtgcacccgtggggctcagtcagatggcctgacttgccggaaggctccacgccaaaaagtagctgtgggagggacccacaccgttctgtgtaagactgttaagaactctatcaacacaaagtccagtgccttcccagtgtgttcatgtgcgttcctgttccacagaagctcctttccatgttcatctctgcgagtgacagggtggttcctctcctgaagagaaggtgctcttgcaatcgttaacagacactgttgtgttctggactgtctgtgctccgtgttcctagaaatcagccccttgacctcaaggtgttgaccatttgaccggaagacggtgctgacgacatttgtgctatgtaatacattgtgaacacattctccctcaaagtgttcatggcaatcacacttttgttacacaaattttggggttctgtgtataatgattccattaaatgtggaagccagttggtttgcctgacacatggaggctgtttcctccaaaacccgtctagcagcacccagtcttgtgacccagtgactgtccttaatgctccaaccctaaatggtctcgtaggatgagctagaaaacaccatgagacagggactggcaggatggattcagaaacgggagaaggatgacaggggaaaccttagattgagttcatatctctaacaaagtagattatgtgagcgctgatggtgtcattctcaaagggtgagaacgcgaaaaagaatgcagccacatcttcagctgctgtggtgtggatgtcgtgtgctctgggatctacgtcagatagtgaatgttggcaacacccttgggaaacccacttcctgagtccccgtagctttctccatgaatggtttgatctaggaattcactcttccacaagcacatcatgtctaggccctcaggaagtatgagaatttgagaaggttggagacaccttttcactcagggcttatctagaaacagcttaagtaaaattcccttaatggagtttaaaaatatgaaaatgtcagactgagttctcccagccaagagcccttcaaaacccaaaattatagagcaagcagctctaaaagacgaaagacacacctccaaacgcttcctaaggatcagggaacagacagcaactccaacttccctaagcacttcagcctgcatcgactgagattcaccaccaattcttcgctccctgttttcactcttcatggatttcctgatgtgagcacgcattgtggtgcaatcccgccttcactggctcactccctctggtattgtcagcctcagtcagctcattctagagctttcttcataaagcttcaactcagaggcactgacggagagcccagagcaaggagctgtgtgaagtgggacacggtgtgagaaggggtccctgaccaccaggagctcacgccccggaggagacccagctgcaggtgcggtgcacactggtgcctggaggccactgagaaggctccaggggagatggagcaccccacctgggacctggactgtggagaatgagggagatgtgaaaaaaggagaagagttgtggaggagacttgtagagaagagctctctgaactgttgcccttccaaatttatacgactgctgttaggttcaggttgttacaggaacactcaatgagctgacacctgtctgtcatgagttacagtgatgtttgctgggcaaccccagaaaggaagatggcagcaaggtcatgtatagtaaaacattccaagttccttatgctcctttttggagaagttcttccaagtttcagaagattcaaaggcagtgttttggatgcccatcatcaaaataaaatgtttacctataatataaatcacttgtagagatttccagattatgcattattattccacagatattggctgagtgcttgctgcctgtgctgagcagctgaaacacagtccctgccctaaaaaaattaatctcatgagaagaatcagagcttgaaacccacagttaaagcaacaggaagaatgtgacgaatgccacagagacgtatgtttgaagtagtaactgtttgatgtggggggtgggttatagggaagaaagatcatggggtggggtaggtaatgggcatgtcctgaccggactcctggaggaggaagtgttgtctgaactgcaccttgaagtctgggtcggttcattacagaaaaatcagcacaaaatgtagagaaggatggcggtggggacggggcaaaggctgagaagcagtcttatgggatagaaagtatcagattagtaaaaggaaattcagaaaaaggacaatgctagtctaggcacccttggtaatttttttaaataggttatattttgcaccagaaacgccaacctggtcgttcagtgaaaaagcaactggaaaggggaagcgatggtaagaagatcagcgagaaggctgcagtgacgggccaggagaaaacccacagggcatttcagaggccaggctcaggctttggtgctgccactggctgctgggggctgtggaccaattgcttaccttctctaggccttggtttccttatctgtaagatgtgagcctcatctctgcattttttcactttaaagcagtaaattgtattctgttgaggatgtccaaagctgaaatgaaggtactcagcactgggggaaaaggttgccttacagtttgctgtgggccctggggttattcgttgccattctgcttatcttcattttcttttcttttctacatatgctatttatgtaacaaaagttgcagtgccttaagaaactaagccgtcccaccaccacactctctcacacatgcactcatctataaaataaaagaatttaaatgtcaaggttttttttctgagctaacttttttatgatttttttccatttattggggtacaggtggtatttagttacatgaataagttctttagtggtgatttgtgagattttggtgacatatcacctgagcagtatacactgcaccatatttgttaatcttttatccctcgcccccctccttctcctcccctcaagtccccaaagtccattgtatctttcttatgcctctgcatcctcatagcttagctcccacatattagtgagaacatatggttgggttttccattcctgagttacttaacttggaagaatagtctccagtctcatccgggtcactgcaaatgctgttaattcattcctttttatggctgtgtagtattccatcatatgtatgtaccacagtttccttatcctctcattgattgataagcatttgggtttgttccacaattttatagctgtgaattgtgctgctataaacatgcatgtgcaagtatatttttcgtataatgacatcttttcctctaggtaaatacccagtagtgggattgccggatcatatggtatttctacttttagttctttaacaaatctccacactgttttctatagtggctgtactagtttacattcccatcagcagcgaagaagtgttccctgttcactgcatccacaccaacatctactgtttattgattttttggttatggccattcttgcaggaggaaggtggtattgcattgtggttttgatatgcatttccctgatcattagtgatgttgagcattttttcatatgtctgttggtcatttgtatatcttcttttgagaattgtctattcatgtccttagcccactttttgataggattgtgtttttttttcttactgatttgtttgcttaaatgtcagttttaaaaacacctatagctaaatgcccactaccagggaaaagccacaaatactgtttaaattacatgttaatttcctaataattccagaagacgtctgagtagagttgctatacttgtccaagttcacatgcaggatgaccacagtatagacggcccccaacttatgatggtttgactttacagtgcagaagcaacacgcattaaatagaaactgaacttcaagtacccatgcaaccattctgttactcactttcagttcagtgttcaatgaatcatgtaagatattcaacactttatcctcagtaggctttgtgtgagatgggtttgcccagcagcagaggaaggtaggtattctgagcatgtgtaaggcaggctaggctcagctgtgacactcagtaggttacctgtgttcaatgcactttttttttttttgagacggagtttcactctggtcacccagactggagtgcaatgatgcgatctcggttcactgcaacatccgcttcccaggttcaagcgattctcctgcctcagtctcccgagtagttgggcttagaggcgcccgccaccatgcccgactaatttttgtatttttagtagagacaaggtttcaccatgttggccaggctggtctcgaactcctggcctcaggtgatccacccgcctcagccttccaaagtgctaggattataggcgtgagccaccgagcccggcctcaatgcactttcaacttaagaagttcttgggccataacccatcataagtaggggagcatctgtactaagctcccgtggtaccttttggttttgctttcattgtttaaaacattactttgctatgaaggcctagcttccccacagactcacagatgaaaagcatcttatctacaagccatgaaagagaaaaaagactcctaagatgtagttgggggatatttcatcagtttaatatcacaaaggatgtttcataaaaaatattgatagaagaatacagaacagatcaaattgaaatgagcagaacgggacaaacacagcccactggagtggcgtgtgcagagagatgtcagctctatctcagttttaatagagtcacgtgcctctgcagatgacttcattctccgtgaaaaaacatcgcgtcagtatctacctcttcctccctcctaccacccaaccttgggccacacaggctcagtttatatttttgccataaatttagaaattcaagagaacttagagtgtaattttgcttcctatagttaagataaatgtgagaatttaaatagctgtagtttatacgaattaagataatatccagtgcctcttttgcagataatattttcgattggattaaacctgctagggttcatcattttagaacccatcatgttttactgaaggaagcccatttgtttgtgatggattttatgaaaagagcatttttcaaagaaaagctaggacccagaatgattttgccaggaaccattttcgacctacctatttgtagaactctacgtaagcccaacttgagaaaagtagccacagaaacagactgggactatcctttcaccataactatcaacctcccagcttccctcacacaccagatttgggctagatgagctggtcagtattttcacaaaacttaaatattatatcatccaaaaatgtttttcctattagggtaactttggtacaaaaatatgaatttgatgttccataatgattgtctcaaaagaaagaatgtgtagcatttcctagattgagccatttgaattttgcctaatttcacaactcgagacatctctgtggggtgcttcttccatgcacaaggaaaccacgaggcttcctgggtgtcggggctggtgacgggagtagatgaactcgttcgctttggctcagagcagccctgatgtttctgttcctggcgcaggtgtgctcccaaggctcaaggtgtggtgggggaaaagcgttcgctgcgtggagcaggcagtcggtgcggcttctcaacggcactggagtccctctgcttttcccaactagctcaagcagggccatggtgggggtgacagtgacaacctgggacctcccaacagacggccttagagtgcccaccctgagccaggcgattgtccctcaccaccacacccacccagatgcgggggtgtcgcgcaaacagcacaggtgcccgatgcacctgctcccgtgtgagctgggccagcacagcagggtgtgtgtttgctgcatgggttcaggttggctgtggtcaaaacttccactagacggcacgatgacctgagattcccgcctcgccgtgtccagccctccctccctctgtgtctctttctctacctgtctcctggaacgggccccagtgggcagggagggaccatcccagctcctcggatcaatcgaaggggatgtcagggggtgggcagaaggtgagaagggcttggaccccgggcctgacattggaatgcgtggccgctttgcagcaaaggaccatgtgtacacatgcatgctttattttctcgtgtggacacacttggaacctgtgtctacacatgacacacagtaccttgcaaatccacaagcagagtgacagcagacgaggccgtcacttcctgtggtgccatagtgcagctgggtttggtcctttgaaatgttctttcttaaaatcagggcttgttctcaacggtacagatgaataagaaccgagtgggctgtgctggcggcatgggggtttttgtggaagggaattttcaggaggcctttgtttccttgtctactcatagtaatgctcaacgacaagcaccagaaaaattaagatcgaaacagccaagggttaaaatatttgcttccatccatttgtgtttgtttcatgctagaagctgtcccgcattttgcacagatcagagcagcccagtctctcaactgcatcacacccagtgggttcagaaacgtgcgccggttttaagaaaaatgacttccatgcaagcagaaatgggcacgcggagcagccccaccgagagcttggtctgagctccctggccctgtcgttaaagcatgtgataattgttgtcatctcagcggtaaactgattcccaaacaccggagtttatatttacatatgtaaaatgtgtgttaacaatgcacatatttcacttaacggttgcatggtatgatatgcattgtgcaccgtagcacaacgtcgcaccatggcccaggctcgtgagcaaggtgggcatggcccacgcggcgagtgcaaaggcctccgctgccttttgtgcatctgccggtctgggctcaccacctaggtgcgctcctgaccctgtgtttccctttcagtcctacatggaggaccacctgaagaacaagaaccggctggagaaggagtgggaagcgctgtgcgcctaccaggcggagcccaacagctcgttcgtggcccagagggaggagaacgtgcccaagaaccgctccctggccgtgctgacctgtacgtaccagccccgggggcaggaagcctgggttacgggcggtggaaactggccgtgctgacctgtacataccaggcccgagggcaggaggccagggttccgggcggaggaaactggccgtgctgacctgtgtgtaccagccccggggacgggaggcctgggttacaggcagtggaaactagccgtgctgacctgtacataccagcaccgggggcgggaggactgggttacaggagggggaaactggccgtgctgacctgtacataccagccccgggggcaggtggccagggtgacaggagggggaaactggccatgctgacctgtacataccagtcccgggggcaggaggcctgggttacaggcgggggaaactggccatgctgacctgtacataccagtcccgggggcaggaggcctgggttacaggcgggggaaactggccatgctgacctgtgtgtaccagtccccggggagggaggcctgggttacaggcgggggaaacagccccatcctgagggtctgcaaagccctccgcttctccttcccggcaccccccgcctgcagcagacttgccccctctgggaaggccctcctgggaatctcccctctgcgatgccatccccagcccaaccaacaaggaaccagtgtcttcctttcctccagcacgggcctggggacatctgcaccccagtgagcatcagctctattgttctctgtcaccgagtgacttgagacatgttcctgaacctcttggagcctccacgtcacatctgtaattggggtcacgctgtcgtccttgaagtattactgctgtaagggttagacgaggtcattagcatagcaccggtacgtcgcaggcacacaatcaacagtggttgcttttacagcatctttaactttacaattatttccacaaactgagcacctactacctagctagggatcactgccagaaaatggaaatataagccagcagttctccgagtgactctcgtggactggaagagacaccgcctcgtgttcccacagcacgggaggcactaagctgcttacaagatgaggagggcaaggactgcccggcgctggcgtccacctcactcatcctctatgtgtatagcaggttccaatgaaggttccacactttgattggttataaacccacccgccaggaggaagggggtcctagatatgttcctgaccagagtttcagggggaagtagatactcacaacgttgagtgatgaatgataaatgacagtgtgggtagagtttcttagttactctcctgaggaccctaagacaaggcccttgcgcatgtctctgatgcaacagagggagcttcgtcagctcacacttcgagagcaccactcggccacactcactttcagctcagcatcaggcgggaccagtgtcccctgtggccgaggccgtctctccgtcactgtgtccctgcctcaacccttcggagccggtcaagggatcagactggtgtccctgagacaccgcctgtccccgtaccagcagcacagccccccacgccagggagaggcactgcccttgccctccttccagccctcaggaagtgttacaggtcagaacagtgagaagctggaatcttgttttgcttcagaaactaacctggggcactgcagacctgtgtaaaatcccattcacccagctgggtgcacgcttcttgctacccatttagtgttcagaccagtttctatgaggtctgagggttttaaccctaaagagatctaaaaacagaagctgtgtgatttataaattttatatttagaagaaaagcaaaatacaatacatcccattagccaactaacagatatttactaagcaccggccctgtgtcgggggctactaacaggctctgggggcctggccactgtcctcagagaggagcagcctgggggaggagagggcggggagtgaagccggtgtggtaggacaagtgagggtggtggtgagcgggtatcctgctgagtcctgagtggagaatggttcgtggtaaatagccatgcagtaagcgtgcattatatgtctctgtgtgtctggtcatttacttagattgtgaggtgtttcatggtaaatattcatctgacagcacgccctccccaaagacagcccggagcgtggcagaaacgacctgccgatggggttttcctcccgtgtgccctgcagccttctgggctctgtctgtacagtgtggatgggggggttgggggcgagggacctagtgatggtgaagtggtccgtgctcagatgggacacaggcagcctccccaggtagcagccggtgccaacagggtggccacatgtggatgggcgcctgatgttctcatggggatcaggacagccctgcccattctgagccaggtgacgggtgagggggaaagcacctccctcccgagactcgcactggagccagaaagaagctgcctgcacctcctcccagggttctcccgacccatgtgccagggtgtgaagacacagcactgcccttcagggttgagaggccaccagggaagacagagaacggcaagttcacctcctgggagaaccctagatagaaatattttcatgaacacataggtttattctgagcaaacttgtattacctactttcttctccatactcttggccatcttgcttttgggaaggagatcttgtcctccgggagacagtggcttggcaaaagctctcgctgttgccaggccccagagagatggccgcctcctccatcttcactcctgcctcacctgcggccgctgcgctcttcacaggacacaactggctccaaaacagccacacacggtccaggaggactggcttccctgtggctctgtggcttggaaggcccatgctgcgctgtcatggtggggggacggcactcgagctgggctccatgctgtcctctgtgtcgcgatggaagcgagtctgcatgctgggcatgcactatcctctgtgcagggttggaagcatgagtactcggccacgctgtcctctgttagggatggaaccttcaagtcctccctctgcacctgccgctcccaccgcgtcctttccgcgtgctcaccgggaactcccaggtctatggaaagggtcctcgggaccacccctcccttctctcatgccccgccttccccatggagcacttccctgggtcattcttccacccaggagatggacacagtcgcccgacttcccagatgcaccctgatcggaatgagcccccaaaggagaaggaaacacacattatgcaatgcttggctggcaccatgctaggtctagttgtattatctcagaagtttaaagaacttaacatgcattttctgttttttgaatgtttaaaaaagaattatgcagcatttcgcttgtctgcatttcagatgaagaacagggatatgatactattttggtgccatatcctaaacaaaaaagtatttttggctctatgttgtaataacgagagagagagagagaaccaggacaaacaatgcagagagacaagacagagacaacgaagagctgaaggctcagggacaggaagacagcaaggaggagagtcatgtggggttcacatctcccagcttctgagggcattgctgctggaggaccacagctgcctcacagccagaggcgcggctgtgggcatctcccaggcccttgccttgcagcgtggtccagtgaggcagaggcccagctgatcaccgttcccaggagtcagggtcaccacactggccctgcgctgcagctgcttgagcagcatcctaaccatggcatcactggggcatcgtgagccagcatcccccgtgctctgcgctgcagctgcgtgaacagcgtcctaaccacagcatcactggggcatcgtgagccagcgtcgcccgtgctctgcgctgcagctgcgtgaacggcgtcctaaccacggcatcactggggcatcgtgagccagcgtcgcccgtgctctgcgctgcagctgcgtgaacggcgtcctaaccacggcatcactggggcatcgtgagccagcgtcccccgtgctctgcgctgcagctgcgtgaacggcgtcctaaccacggcatcactggggcatcgtgagccagcgtcccccgtgctctgcgctgcagctgcgtgagcagtgtcctaaccacggcatcactggggcatcgtgagccagcgtcccccatgcccgtggatgtgccacctctggtcctcacaagaaacccccccacttggccgacaagaactttggggtttagagcccgcccgtcagagctgaaatccagactccccagtgccatcctcataggctgtcttgggctcacctgagattgtgcgtgtgtgttgggaaaatccatgtccatttcaaacttctacagaagtatttgaaacatgtacaagggctgaagcactttggctaagcatagctttccttagaatactcagaaaacaatttatttctaaataaacctttggtttagtttttttttttttctctcccaaaactctaaacagagtcccctaagaggaatattttgccttggttacttctgagtgaccaaaagttatcatgatttgcttttaaagatgaatacgtgggtgattctcctaactctgatgattaagccagggttttctttttccttccatagaaaaaggttctgggcatatatgtcacctcgccaagaaagttgctggagagagactcccagcctggctgccttcccttcaccccttttgatctcagtgccagccgactctgccctaggatttgggaaggctgtcggtttgttggtgttggaaagaaaatatcccagcaaattctgtgtgggcctttttctttgctacctcacaggcagaagctgttctgggcagctgttctgccagagactgaggattcttttttaggaagagatctacagagtccttctcattaggctacttctcgaagggaaagattgtctaaaagcatcatctctgaactacaactgcaagtgcaccttccgtgagctcttcaggacctccagtgcaaagaaacagtgccggtggggttgtcaggagccacgttgatactccacacagttcagctgctcaaagttcagattttagatcctctttgctctctttcttaaaactgaaccgataggttggtaagatgtctggcctggtgtggcatggctacccgtccttctcacatcctccttccgattccgcttacagaatcttcgtgtggggagggtctcacagtgtggggcgagcctggccttcggggtggcagcagccgggctcaccgtctcctgggcgccctgtttcccgtgacttggaagacctaccctccagaggggccccaggccacggtgtgcttcttcctggatcaggcctcccactttatccaccagaagttacgttcatcctgccaggtgcacatctcagcgccggctgattctgaggccgaacccactaacatccagagtcttttccttaaggtcttcggtggagcccagggcctcgcgcaccccccaccccccgttggtgacagtcaagtttaacaggagaatcgagccttgtgttcatctcctgtaaccgattctcgttcagcctccagagcttgtggttcctgagtcactgcgtcacctccctctcagctcggcaccatctgctcgttttataaacatgtttttcacgtcgtcaagtcattgataaaaacacattccgcaggaccagtgctgagccaatcctcccccgtgacgcggatccaccgcgggacttcccaggcgctggttccagggctgagattgtttccacggcccggccttgcgatggggtcaccccagccgtccccaggtcccgagcatattggcaaaggctcatcagatgtttccacgtgaggctcggggctaaacacctccttttcatcctcgaaacagccctgagattcacacagggacagagctggggctgaaggaggttagggagcccaaggtcagcggctccccggagagtgcagcctacactaccccagcgcagacccagccgcaacccacgcacaccgctcttgcagggccctctctggagcagaagtgtggctggcttagcatgacttcctcccccactttttattacaagagttttaaacactcaagtggaaggggtagcgtggcatcgcctgcacacccaccacccacgctggccagccgcccagtgttggccgtattagcgtgacctgcgagcacttcatttattttctggctggacgacttcaagtaagtatcaggcgtcatgacgtccaaatactttagcctgcctgcaggtcctaaatacaagggccttctcctaggtagctgcagccccgttataactaagaaaattaacaacaatccctcagtgccctctaacacccagctgtgcccatctgcccaggctttggagacagcagatgagcaggtgaaaccacagaattgcatttccccatagtcctggaggccggaggctgcggtccaggatgtggcagggctggccgtgtccgaggccctccctggggcttgcaggtgctgtctgtaactaagggtcccctttgtttaaggacagcagacccactgcactaggccccccctcaggacctcaccttcacttactggcctctctagaggccctgtctccaaacatggccacactccgcagtcctgggggttggggtcgtcacacaggggcatcagggcacagctcagcccacagcgccattgctatcacacactcccagggactcccgccgctttctctacaacacggtctgttatctgttgtctgttttgttttttccaccaggatgcagtcaagattcatcattgcattttgggttttgtgtctctttcgtctttttaattttgaaacagctgtccctgactttttttcctgatatgaatggtacctaataaagctgttcttttagtgaccactttcccattccaaacaatcacagactctccatgtggaagtctgtagggaactctgcaagcccacgagaagctcacctgcccccttccagaacccccgtttcccaagaacccggagtgtacaggtctccacgatgctgtaggaacatgaccagcctgctctgcgaccttgccacgggccacagacttcaaaccctgccttggccctgagctccaccctggccctcccctgtcctcccccttcctcccctgtcttccccctcctctccgtcctcctttttcctcctcccacctctttcatggttccctgtgttctgattggccggttgagcagtcctgctgcagaacgatgctttccaaggcatcccgttgcttgtggtcttccaccagcaagaatgtggaggccagccctgtgagctcacagagtcacagttgtgacgggagggtcgcccctggccatgtggcctgtaaggggctcgaggagtccggatagcagcgccgaggtctgctcgtggtgagagaccccgagtcccggcacactgtgggggggccgcaggacggcggcccggggtgccctcgggacccctgcgctccgagactcgaggactacgcgacaaacggcagttcaggctgccgcgggtgcaggtttgctcatccacggccgccgggttagggagacgattctggcacgttccaggcaggccggtgtcgggagagggtccctgcgtgtgggagacggaggcggcggggtcggctggagaaccggggaaggaacgcggcggcctcctcccgcgggaagaggcccaagccgggctcgccctgcggctcagcgaggagcccgccctgccggcttctgaggacgcgccccggaccctgctctcctgggcctgaggtgacacgttctgtcgattgaggccccgaggtttgcggaagtctctggccgcagccgcgggaggcgcaacacgctgaggctgcgcgacgtggggcccgcccggacccgcctccgcccgtgtctccccgcagccgtctctgccagaactatcggaagagaccggaactgttggttttgtgtctgtgagaagagcagcactgggaataagtcacctgctgagctgacagcggaaacgaaggacaagcggagtcgcctagcgccgtcgctgcttagcccagaaaacggcctcgtcagcgccctcgacctgtttgcggaccgcttcaggagctgaaggaaccaccgaggttctgcggctgaggcgggaggcgggactggagacggggccgggcctgtccctccggatgcggggggcgctgccctgttcagccgcagggctctccctgcctcctcctccggccacccaggccggaagcaccccggcccctcctcagggactctccctgtcagtgagatcaaccctccggagctgctgtgtcttcacggagccgcagacccgggcggggaggcggggccttcggctgccgtggggtgtggggggccctgccctggccggggtgtgccgccggagctgctcccacccgcttccccgcttcaccccagcgcctctgtggatgccctttgaccgcgacccctcccgtgcggcggaagtgagttgctcccgcgagctgtttgggcgttttccacacctgcccatcagttacgcctctagggagctaatgtgtaggttcccgccgaatttcctcccttacttttccagacgcgcctgcttggcacagtctgccctgcgccccgtgctgtggggtcagaggtcactgccttctgcggctcccctggcagccccaagaccgtcggtcacaggtgcagcttctgcccccgatccacaaaacgggcgttaatctcaggcagcacagccacaagccagagctgttcttctggtgataccctgtgtcctggtgataaggcgtgtgagctgccccctgctcctagtttcagctccttggaggcgccccccagccgtttgtgtctctgtcttgccgccgccacactcatctgcgctgctcgcacagacgagattcgtcatcagtgtcgatggacggcctctcggtggagccgtgcagacagcgtggccctgcctgtctgatatctgtgctcctgttacagcaaactgttctagttcctgcgagaaagtcgccaccagcgcacacagccacgcctcgctgtgtgtctggagctggtctctgggttgcccacactccacaactgcaggctggctccaggcggcgctttctccgtgcaggcaccaggtgctgctcagggcatgggaagccaaacccaggtcgctccaggtgctctgggcctggagggctgcagggacagagcgccagggatgggcagtgtatgtggccaaagcaggctgtctcccattccggaggccagaaatggaggtcagggtgtcagcagggctggcttctctggaggcctcgctcctcagcacgaccacggctgtcttcgtcttcacacgggcgctctccctccgcgtgtccccagcatgactgcggctgtcttcgtcttcacacgggcgctctccctccgcgtgtccccagcatgactgcggctgtcttcgtcttcacacgggcgctctccctccgcgtgtccccagcatgactgcggctgtcttcgtcttcacacgggcgcgctccctccgcgtgtccccagcatgaccgcggctgtcttcgtcttcacacgggcgctctccctcccgtgtgggtgtgcagagtccttcttcctaacagcacgccagtcatattgcattagggccgcccaaatgccctccgctcgcttacctctgtaaagaccctatttccaaataaggtcatgttcccagggctgggactccagtgtgtctttttgggggagggtacgcagctcaaccctgggacctggtgcctccaagtcagctcagtgactgggcgggcgctgcctggccacggcaacccccacacacctttggcgtctgttccccctgcattctgcccccgcatagccctgcctggggagttccttctacacagatgcctgagatgagactagtgtgggttaaaatcgcttcaggtatgggaatcccccagggcttgaggctccttctagtccacctgccccaggtcacctgcccaacatgcttccgatcccattggggggcgactttctgagagatctgtctgtgggggatgccagtgaaaccatttaagacatgagacactaaaccagccttgtgaccatgccatttggggccactgttgctcctctgggacctgcttttgacgcgtccagtgtggaagccggacaccagcctcgcgctcggttattcagctcagcggtgagcagcgtgcctcctgagtggtgggtggggcaggtctcattttcatgaccatctctggatgtagcagggctttctggatatgagccccagcctgtcccagtctgcccagatgcagcattgtatgctgagctgcggaggccctgaatgacactcagctgactttcctaaatgttcgatgagctttatagcttgagctgagcatttcccaaaggcatagttggaagcagaatgtctgcctgctgactaaggacaggagcgtgtgggaggaagaggacctgccccttcagaatgcgttctgtcatcacgctgttgctggtcttcaagtgcccaggtctgcaaagaatcaagcccatgtagcttctcagagtattgaaacaaacgtggtccgatcatttattcctttgcctcaactatgacaagttcaaaggcctttctgtgtgtgagccgctgggatccctaagcagcactgacggcccttgctgacggccagcagccccgggatgtgcctttgcagccctcagacctcgatggacaccataaactcggagcaggagcttgtgggtgctggtgccaactgtggagcacatcccggaacatgttctctgctggagtcaggactccctctaggagcaagacaccggctccacctctccacaggccacaccatcaacatgaagaagagggcctcctgccagcataaatgactgagcctaaaccttcacagaaagcagaggcagttggagagcccgagagaacacctgagacccctgagtggaaggaaccccattgccgagttccgtgaggcccctgggaggagggaaccccattgccaagttccgtgaggcccctggactcagcagtggcttcacagatggcctcacgcatcctccaaacagcagcaccgtggagcccatgtgctggtgggaggcagattcttggccctgcagagcagcttcctgagtgtggacagcaagccaggaggcctgggggaatgccgtcctcagggatctgtgtagcaagacgatgttccgggcagaggagtcttccacacgctttcctcagatgcagtggggtgggcacgggaggttctagatcatgattaatgactataccgccgcgtcctctagcatgcttagctgggccatctcccaaggctctttgccatagtaataatcaacaagaaattgtgggatgtgtctcttctgttggcatctatgaaaaatcgctccatatgttctgccaccacggggcagcaagaacacgctttgccagcttggctgacctgcgcagttgggtgcgtgtccaccgtcatctcagccttgctcctcattgcttgctgcgtgccatttaccacaacagtgctgtgagttgtatgttatcatcctgcattctccgaacactgaacagtttacccaggatcgcccgctggcaagcagtggggctgggagtcaaaccctgtgctcccctgtggaccacgaggccgtggccacgtgaatcgttccatccttatgagtcttagtttcttcagcctaaaacgggaaagtagtccctgttctgtccgtggtccaggatggccactgggtccaggatgagagaagaggatctaatccgtgaaaatatggaacatctgagaaatttgaaatactctttttttttatatttaaaaaaaaatttttttgagacagagtttcactcttgttgtccaggctggagtgcaatggcacagtctcagctcactgcaacctctgcctcccgggttcaagcaattctcctgcctcagcctcccaagtagctgggattacagccgcccaccaccacgcctggctaatttttgtatttttagtagagacgtggttttgccactttggccagactggtctcgaactcctgacctcaggtgatccacccacctcagcctcccaaagtactgggattataggtgtgagccaccgcggccggcctgaaatattgttgaacaaggcactaacgcatgataaacacagtaaagggtcagaaaaggaacgtgcacagtgggttaatttaacccaatgacattaactcagttatagggccaggtgaaggaagactctacgtgagttcccacattttcctggcctctcagtaaattctcagactacggttttgatagagcacacccgttcttaatggaaacatgagccccaggctgttatgaattctcaccctgtggttcccgccattgctctgtgttgcctccccagggaggtctgatatttcatttgacaacagaagggagcagccttcagttccccgagcacaggccagggctgattgcgcgtgggcctgccctggcttcatctccagcctggggttggccttgagaggccccaggccacctgcttcccttcacttcatagaacacgaagacccctccacaggcctcgcacgtcaaggaaactgccctttaggggactcgggaactggatggcatcatcctatttgctctcaaaacatctcataaaaagtaagagaatcacaaaatagagattcgccaggcacatgaactctccgcacgaggaacggttgccgccccctgcaggaatcagagtccgccctcctccacagcctgcagcgtcccttggccctcccaggatggctccaagcatttcccggaggttccaaatgaccccatattacaaacacaatgattttgctggccaggcacagtggctcatgcctgtaatcccagcactttgggaggccgaggcaggtggatcatctgaggtcaggagtttgagaccaccctggccaacatggtgaagccctgtctctactaaaaatacaaaaattagccatgtgcagtggtgcgtgcctgtagtcccagctactcgggaggctgaggcaggagaatcacttgaacccgagaggtggaggttgcagtgatccaatattgtgccactgcacttgagcttgggtgacggagcaagaccctgtctctttaaaaaaaagacttcgctggtaatttcaaaagcaatatgttgacacaaaatcaaatatgcgatcaggaagtaggagctctccgaagtcatggaagccgggtccttgactcagtgccatctttaaagggtgacctcgggggaaatgaattcggctaaaacaattttccaccaagaagcccatggattgtccacttgccagcagggctcaggtgcccatggcagattccccctctgccatcgagaggagagggccgggctcgtagaatgcatgtctaactccccaggactcccgagctagggaagcattttcttaattttccaatgagaaaatccagctggcacttgtctgctgagtccaatggcagtggccactttccccgtggcctgttgctcacagggcctggcagcagggacccctcagctgaggaggagctcccagcacgctgccctgatgcctcctctgccctccgtagaggccaggccactggtctcagggtgccgtgggcaccatcaaagcacgagaccaagccaggtcaaaagcctgagggctccaggctgcgctgcctgttccctgccctgctccctcctgaccctgctcttggtaatgccttctcagacacgtaagaacggtccgcagttgctggtctcacaagtgcctaaaggtggctgtgctgaaaatgaggcagggccctagaggcccctggaagcagccagaagcccctgcttttattcccacgctctgtgtgggctgcagcaccgggcccagcccagcacctctgaccacagcctcatctctggctgcggtgtctgtgtggccccactgtgaaactgggtttctggaatcaatgtttggagtagtgtgtgtggggtgttcagatgtcagagtcaaccagtttttttctgatgatttgtattacaatttcctgccactgccaattttcactctccaagaactaatttgtgcaggagctaaaagccattgagtccctgggatttttgcatcattcacaccttcgttcagagctgatgggatgacttgcagcttcatgacattcctgaggcattcagctgcatagagcatgtgcgtatgtacacatgcattcttctcctctctctagatgttttatcttatcccatcttgtcacccctgaaagaggctgacattcctacctgaaggaaggtgtcaggacagcatccaacctggagtgtattgatctctagtgcacagtactttcctagttcaatcagttaaaacactcactaagttttccaagccctaggatttgttgttttaaaaactgtaagtaaaatctccaagaaaaatgaaagaattgcgtagagaagcagagtccgtgcagcttcaccaccaccacactgctccatgattggggccacttccttctggtgccagcgcccacaggaggtgcgcagcgagtttggagtttggccacaggtccagaggggacccacggccaccaagcactggcctccgagggctccagcgagggtgcttttgttttctcagaaaagatggaaattggtgttgtgtgcagcaccaagaggttttccctgggacaaacggcagcagagccgagatgttgttgcttccagatttcagccagggatggcagtgacaggccctctggagtggccactaccatcacaccagctgcagcagggaggcgtaacctgggcatcctgttccacgcggcaggcaggaccccacccccacccccacgctggggaggagctacagctgcccaaaccgtagctgcagacccaggcagccctgcacacttaggcacccaggaagaagatccttgcccctgcaggaagtgcctgttcctgctacctggattctccctgctgttggcacccatgctgatcttggagcaaagtcagggctgagcccgggcgctgtcacagcccagcaggtgtgacactctgggcagtgctgacacaccagccccctgccacctcagccccctctggactttgggcaccaacaagcatgggagggaagccgaaggagggctgagggcagctcagctctggcctgcaggtgccccttggcacaaacagcctgggtgccatgaatggcagcaggagacagagattcctgggcaaaagggggcaggtcctccatgaagcaccaccttcaggccagggagggtttgaaggctgggggctgggctgcaagtcctgtggatcagagtgggaactcatggtgccttttccaggcctgcccacggccactcgtgggccaatcagcatgtacttcctcccctctgaggcccataaatgccccaggcatagccagagctgggcagacatggggatgaccagctgcagagaggagctacccactccagagcctcccctttgctaggagctgaacactcatcgggaccccctggctgcagaaaggagctgccccctgtgggagactgagctgttctattgctcgataaacccctcttcatcttgctcatcctccacttgtctccatacctcattcttcctggtcgcagaacaagaactcaggacctgtcgaatggtggggctagaagagctgtagcacaaacagggctgagacatgccccctgctcgccacactgtgggtgaagagaaggagagaacagctgtagcccttcagggagcccagacctgggagctcccggagctaggcctgtgactccatctttgggaccctgtggttcctggtatctccaaacttccaggagctaccatgttcctcagtgtcaaccatggaagctgcttgcagtgtgtctggtctggccgcagcctcacagagagcccgcacccatgctggcacctggagctgcccaccctgctgcagcacccagcgtgcctgactggtgtggccagaccccgtgctcctcacacacccctcgccactccatgcctgactcgcccttggcaggcatgggacccaggctggtagtgtgagccaaacgtggcctgccaggcccagcctgagcaaaacttgggcaaaggcgccaccggccacagagatttctggccagaaaaacaccaccccaaagatcctgtaacacaaagcgcaccttgcagagagaaggaagcggccacacaccagggagttgggaggtgcaggaggggctcttgcggcttccactcctctgtgagctctgcttgtcgaagtttctaaaaacagagcaaagaggagggcggccacagcaagcaggatgggggttatcccagaaccaaagccaagacagctctcatatcacacacgtcacaagtgcctactgtccccccgctgcgcccggcttcagcagccgtcaggttactctgtctgtccgagcgagtttttatgccagtctccaccagtacatttttcctccatttcctctttatctgcattttatttgtctcttactctccttttaaaactaaattccagtaatcttgaggacttaactgttcattgactatgaaactttctattttgaaacgcgggcgattgcttaacgttcatatttctgtttacctgctgtgtgttgccaagtgtgtctgtgatttaaaggccagcatggtataaaattctgcagaggaacccctgaccttggtgtgtgaactccacgtgggggaaaacaccaggatatctccattctgctgagcgggagctttgtgccagttccccacatgccgttcgtctgcctcccacctggaggatcacaaacggaggggaggatgggagcaggaacattggaaaccacattcagaagggtgtgagcagagtcctgggagaggatgcgggtgggccctggagcccgggcaggggtcccacactgctgggctataggccctggaggctgtttgggagtcccacactgctgtgtgatggaccctggaggctgggcaggggtcctgtgctgctgggtggggggccctggaggccaagtgggggtctcacactgctgggtgggccaatgttcctctgacccctgcactgtgtccttgcagatgaccactcccgggtcctgctgaaggcggagaacagccacagccactcagactacatcaacgctagccccatcgtaagtgcactgccgggacaggggccccaggctttcccttgggtggcacggacgcggcaaatcacgtgggaaggttctcgggggaaatcacgtccccacccagctcagcgtctctgcggtggacagggccgactctgcccattgggctcccgccactcccctgttccttcaccagcggggctgtttatgagccgtgtgggtcccggctcacgctgggcggtgggttccgtgacttgtagaacatccagcaatggtgactggacagtttcctgactagaagacatggcttttaggagaggttcgtagtgggtgccgttcctctttcctggagctacacattccctgtatattcatggggcatggggacatgaggcctcagtctacgctttttgtaacaatcagtggcttggaggcaggtccagaatttcaggttcgttttcctgaagtatttccagtgaatgggaccctgtttcttatgaaagagaccgtttgctggctgttcctccccctgggatagacgcaggtgcagtggagatcgggctgtcctgtgtttctggggacgagtgtggtggcagctcctgtgccgtgagttatgagtccctgtggcctgtggtccctcacttcccaggggctcctctcagcccatgctagacgcggctctcaccctatttaactctgggcatcccccttccctgtcatgacctgtcgggggagcagggctgaatggggaggtttgcagccctcccagagtgagcagaggagggagagatatgagcatggagagggctgaagccacaggctggggacactcggactgggtgttcagatgagcagtgatggtggcaggtggcgggggcgggatgggacactgtccagggccggggctttggagacctggcggatggcactttaaaccagtggtggagaggctggggctccatgcagatttatggcggacactggttgtcatgtttccccctttaaacagctcttctcaattctggtcttcagggaaggatgaggacatctcactaaaattccaaatttgcctttaatcaaacatggtgcctgcaggatgcaatgctgttctagggctgagtgagacggggcaggtgatcgaggcacaaatcgcaccctacggtgtcccaaagtttctttgctcgtccatagggagctttggatgaaagtattggcccaactgcctgcaggccacggccactgatggcggacagtgctcagctctcggctctgctgatctcagcagccactgatggtggagggtgctcagctctcggctctgctggtctcagcggccactgatgacggacggtgctcagctctcagctctgctggtctcagtggccactgatggcagatggcgctcagctctcagctctgctggtctcagcggtcactgatggtggagggtgctcagctctcagctctgctggtctcagtggccactgatggcagacagtgctcagctctcggctctgctggtctcggcggccactgatggcagacggtgctcagctctcggctctgctggtctcagcggccactgatggcggacggtgctcagctctcggctctgctggtctcagcggccactgatggtggagggtgctcagctctcggctctgctggtctcagcacacctgtgggataaagcacgctgggaagatgtccacatgcctgagccagtcccgttttcccgcaattcgtggcccacacagtgagcatgttcagctttgagagactgaattcaaagtgaagaactggcctagtgtacttggtctacaccacctgaacccaggtttctgtttatgtgttcattcttaagaaggaatcacttccttccttccagcagaggttgactcccaagcttggttccgtgtgggtttcaaagatcctcattcatcttccttaataagatgtgatgcacatagtatttttctgtcatcaattctaattcaaaaacatcaaaccaaagcctcgctgatgtgccagcctctcacttgatgaacagaacgtgcgttctggtaaagccaggtgtgcgcgcctggattccgttcctgtactatgtgcagcagagttggcaacacgaaaccgtccgaaggaaaagaaaagccatgttgaggtcccttttccctgagatgaaccatttgatgaagccagaatgaggaataaagccgtgattcacaagcctaaaagacgagagttcagcgttgcagctgggcccactctcccccactcgatgggttccaacttgcagatgtctgcgctattccaggccacagccaagccccagcgtgggcagcagtgcccagtgcagcaactgtgtcgagctggaaacggtggacagctttcatcccatgtgggaaccagagggggtgtgtgtttgggggatgaattcctgcacattcatgcaactccctctccaggccttactgggcaggagcttgggtgagaaggcaaggccaggagggagaagtaattttatggtacattttgtgtctttcctttatttcataccacaattcttttttttttccaaatttgggttgtaagaatgaagcagaagaaatcgatggtgcctcttctttatgaaatagctgaaggtacaatgataattaccttcctagcagcagctgaatgaaaagctcacaattacagcaaaggaaggccctggctgtgcaggataaaactatgataattacatctgtcatatttgtacttagtcctcattacatttcagggaaggcatccagtggtaaataatgtgcaatctttgcttttaaatcagaggtcatgaaagtcaatgggaattctgttttccctcgtaggttgtctgagagagaaacccatgagctacatttaaaacagcctgattattactgaggacaccaagttgaggaatggtgttcacgcaacagcccactcaaacacagcacacaagctttattaccaggacaactctgaaactcccagtgacgtgtaaaaactagcttaattcttcatttcactgtctattaagggagaaaaaaacatcatttaaagttttaattcagaatgcatttaactatgtagggacagagtggcttttcagaaaaagaagagaggttggatgttctgactagcataagaaattggccaaatatgggaatcacttcagttatttacaaccaaaattctgtgtataataatggtttatattcagtattttacttaagtaaatctcaactcctaagaatacgatataaaaatatttcaagttcaaaagtcaatctgctgactgggtgcagtggctcatgcctgtaatcccagcactttgggaggccaaggcaggcgaatcacttgagttcagaagtttaagaccagcctggccaatatggtgaaaccccatctctactaaaaacacagaaactagccaggcatggtggtgcatacctgtaatcccagctgaggcagaagaaacatttgaacccaggagggagaggttgcagtgagccgagatcatgccaccacactccagcctggggtaaagaacaagaccctgtctcaaaaaaaacaagtcaatctcccattgattactgaagctacaatttcccaataaattcccatattaagccttagtatttggaaaagagacttgagaagtcaaatggtggttttcaagaaagcgtttcatgcaatttgctttaaatgttaggaaaggcaggtggagatgtgggcaggtggagatgtgggcaggtggagaggtaggcaggtggagaggtgggcaggtggagaggtgggcaggtggagaggtgggcaggtggagaggtgggcaggtggagaggtaggcaggtggagatgtgggcaggtggagaggtgggcaggtggagaggtgggcaggtggagaggggcaggtggagatgtgggcaggtggagaggtaggcaggtggagaggtgggcaggtggagaggtgggcaggtggagaggtgggcaggtggagaggtgggcaggtggagaggtgggcaggtggagaggtaggcaggtggagatgtgggcaggtggagaggtgggcaggtggagaggtgggcaggtggagaggggcaggtggagaggtgggcaggtggagaggtgggcaggtggagaggtgggcaggtggagaggtgggcaggtagaaatacctacagatgaggtgtgtgcttattctctgtgcaagatttcagagtaaagacgtgacacccatgcccttccccaaagctggccagatcctcttaagatgttaaggtcacagctgccagaggccggggctggtttgggagcagaaactggcgttcccttcacctgccccgcagtgggtgcctctgccaccatggaggctgttgaggactgcaggacacagtccagtggtcctgacatgctgagtgcttcatttctaaaatgagctttgtttggaatattggggaaattgtggctaagtttttcatgcagattagggtttctaaagatacttgtttagtaattatcctctgatagcataaggcacatcactaggccatctttacactgtgtattcagagagacagaggaacacacctcactagcatcctagttcatatgacatcttcataagaatcagtcaaccaagggataacagagtcaacacagacaaatgggctttatttttattttaaaaaagtaagccaggcgcagtggcttatgcctgtaatcccagcactttgggaggccaaagcaggcagattgcctgaggtcaggagttcgagaccagcctggccaatatggtgaaaccccatctctactaaaaatacaaaaagtagctgggtgtggtggcacacgcctgtaatcccagccactctggaggctgaggcaggagaatcgcttgaacccaggaggcagaggttgcagtgagccaagattgcaccactgcactccagcatggatgacagggtgaggctccatctcaaaaaaaaaaaaaagtaaaaacagaattatactgttaattgtacttgccttctggctgttgattttcatgaagtcacttggagtgagtcacactggattctctgtggtaccggcctctctaggcgggatgtgttgctgcagaagcccctgtctggggagaaagcgctcagaaatgaccgcacctcgccattcagatgcttggccccgcacaccactggaggacacagcagctctgtgcttgaggaagcagcatccttccttccttctgtggttcactgaggacagcatggacgcgtgttcacgggccgcagaccgcctgacagcttggcgttcacctaataaatttacaggttttcacggacagtttcgggatgaccaacaccaggacacacacatacacacagacgagtctgcacatgcacgtgcactggaatccagagctaaaggacacttagaaaccgcatcatccaagctcctcactccctgagctcacccaccatacagatatggagactgaggcccggagacgccgacgtccaagctcctcactccctgagctcacccaccatacagatatggagactgaggcccggagacgccgacgtccaagctcctcactccctgagctcacccaccatacagatacggagactgaggcctggagatatgacaggccttttcccacagccgggcagtttgtgtcgggaacataacagtcatacaaataaaaagtatgttgcaatgaaatggaaagtcatgagtaggaggcgaagggtaagaatgaagaccggaggaagccagagtaggtgccgtgtgatcgctgggtggggaagacagagggacacacacccaccatgtccggttgtcacgcagatgccctcattggaaaaagcaatgttagtagaaactcacttgatttcctccacagccacttatcctgcccgaaaaccttaaatgtagtaaaatctctgtgtggccagttaagtatttgcttgacttttcctcgaagcctgcgtgagaccacaaggaggctgcctgtggcctttgcagttgctgcttccacaaaatccttctgcccagaataattttctgttcaacagaatgtgcctggaattaaatgaatgtaattgtctcctgaattattgtgaaaccgatgacacatgtcaccactcggatcatcatgctgttcccgccttcccagtggcccccacaggacggcaggtgggcgggagggaggtgaggccggtccccactcagtctgcacagcccacacttcctgttcagccatccccctcccagcaccctgactgtatttgctcctgtcttaggcattggagcaggtgatgggtgtgtggactttaggacaccttaacaactcagacctaaatcaacagtcaccttatcgaccctcctgcaaccctgtccagcattttactttcaatcacctatttctcattttgaaagcaactaaatgtgctagtttgaacatgcttacaattttaaaatgtgttgctgtagaaattgctctgggcaaaaaaaaaaacacacacacacacatttcagaaggaggcggggctttccttttcatgcattactatttgcaaggaagagacaggggtctctgtaaatagctgtcacccccaacaaatgcatatttcaaaaaatcaaaacttatttctgctaagcatttttctactgaaacattctaattggggctttcagcgacggtaacataattttacctgtattgtgtgtgttgtggcgaatttcaaaacgaggtccagttttaattacgaatcactaaatcagatgcacaaaaagcttttctccctgcttccccccagcccccggctagcgtcaccgtgttgttctgtgagaataacttacatctgttcctttatgctcgcccctcttttatggtgaacataattataaggtgcatttggtgccttcttttgtgctgacagccatcatctctggggctggtgacggctgcacggggactcactggctcgctgttaaagaaaacgtgccccacgtcagcttcccaaatgcagcagcacttaaggtagcaccggggccaccactgatgtcctcgtgcgttggcttaaaattgcatagggttaaaatttgctcatttttcactgtgttgagaaatgttttcttaataattaccttgaaatctgaacattgtaaatctcgaatcaaaccctgatagcaaaagagtccattttagtcctagacacaatagaagaaaggactgtgcgtcagatgcacaagcggctgcctccccaaggtgaggttcccccagcgcagcatccggctctccgggggtcggtctctgcagatgcttctgggaggtgtggggaggagctggtgagccctggggatgatagtgatgtcctggtatcttcgtgtcctttgcagggtggcctgggcttgccctctggaagacagaaccacctccatctgacgcccctcagcaatgtgctcaaatctcgcttgcctctcaaggctttgtcctcaagttcttttttctgtgcttaatcttcgaaataaatgtaataattatggtcttctaagccaaccttctcccattggagctagcaagatgcgttcggacaaactggggagccggagagcccacacctgccctctttgtttctggtccctgcctggtggggaaacagaacaggaggccactcccagcaaggcccttccgccccggctctgccacagacccaggcccaggctgaccggctgtgcctgtgccccctttccaggatacacaaaaacaagcccccacacacaacgagttaactccagcagggaagcagcaggtagcgctagttcgttctcccaggacgctggcaagtttgtccatgaggcctggaggaaccctgttcacactctccattgagagcttggagctcagcctcaccccagccagccctgtggctctagcaagaggctcgttctcctgaacacagggcagcctgggtgggctccgtggccaggaagctctggggtcacttgcaggctggaaagctcatccatgtcatggggtcgcacctgctgagtgggctaacaacggctgcctgccctccttgggctactggtcttcatttctgttgatgctgctcttagaacctcaacctcaggtataaggaaagcatttcagacgcagtggttcaggctcaaggctcgggacagctgggtccctacctgtgccgggtgctcgtttgaatcaacaaagggcaagttgtgtgttgctcagttcaggagatgccacctttccctcttcctgaacccaggctctgcttcctggcttcctaacctccaggctccctaacctctgggctccctaacttccgggcttcctaaccaccaggcttcctaacctcctggcttcctaacctccgggcttcctaaacaccaggcttcctaacctcctggcttcctaacctccaggcttcctaacctcctggcttcctaaccttctggcttcctaacctccgggcttcctaaacaccaggcttcctaacctcctggcttcctaacccccaggtttcctaacctccgggtttcttaacgtcctggcttcctaacctccgggtttcctaaccttctggcttcctaacctccaggcttcctaacctccaggcttcctaatctcctggctaaccgctgtggtgtggtcttgtctctgcagatggatcacgacccgaggaaccccgcgtacatcgccacccagggaccgctgcccgccaccgtggctgacttttggcaggtgaacatttttaaattaaaatctctctttctgaaaagaagatctcaataactgggtcacgaatcatgtcttgaatctgattaggccaatcaaacttcttacaaatgctcatcaaatgttacttatatcagaatttcagtctgttcatattttttattatcaatcttttgttttccaaaacttgagtatgaaaaaattccctttgagagatttaatgctttcaagatcattacttttaagccactttacatttgcattttataaaacagcgaggataaagttagtaagtcattccatgttattgaaatgtgcctgttgtccatggcgttgttatgatggcggtcacagcaggacccaagtacatcctctgtcatcctctcctggagtcctgtagggcatctgaaggccaggccgtgcttctctactcgacgcaagcccaggtcacacagatgaaggcacagacgtgagggctgacgtgaatgtcaaacatcagcaaatagagcaacatgcagagggcaggtggggtcttccttctccagctgcccccgggtctcccctcaccagccacgtgacaaagctgaataggaatgggttctggaacctggaacgtggccgtgagttaccgcaggagcacaggcaccggccgcgtgtcgggcacaccagccaaccccgagcctggcagagaggagctcctaaggagagtcgagctggggacgaaggtgggaagcgacgcgtcacccatgcggcagaatccaggcagggaggtgcctgtcgcagcagtgacgctgggatcaggctgcagcctcctggcgatccacagcccgggcctcctggtgatccaaagcccgggcctcctggcgatccacagcccgggcgcctgtgcagcactggggtgagacatttcctgatgtcgctgtgcaccggagttggtaaattcacttctgccccaggctcttcctattccctttacttccctttcctggctttcccgtcagcctcgcgtgactccgattacaggaaggggagcctcctctctctgcccttgagaacagtctctgcagggctttccagaaaagtctggaacagatccgggtttccgagggcctccgagcacccttgcatggtgagcatttgaatcctcaggtgccatcatcccattttatgggcaaggcacatgggtattggagagatggcatcacttacccaggacagctcggatgacgccaggatctgaaacacatcggtatgacctcctgccctttgtgtctgcctgtgtcttcacactattgaaaataaataaataaaactaaactgcatctctgtgtgacgttgttgaagcttgtaatcccggcatggcacggcgaacctgtggcacttggatggttttgggggcacttgggctccctacttgtcacagctggggagtcgcccagcccggtgagaacatgcctttcccagagaagatggcaccctggggcccatcgtctcaggagtttcgtggtaggaaggtctttgcatggcacacacctgccttcctgaaacatggacccatccgtcccagcgctgcccttagaatggagccccagggcccttccagggatgccccctgctgtgcacgctcaccccggcttctcagggaaaaggacagagtgttcagaattggagggcgggcagagaatacccacggagtcctaataccactggagttttcatccacctcaacccattacccaaaatgtgcttatttgtgtggcatggggtgcccccaaatatgtgttctttcatttttatgagcccttgggcccccacagcccaacatcaacttcatctcctcacctgtgcaagacttctctgtccagcaaagccacagggtctggagggcatccacactcaatgaccacgatgatgcccacatccaccctctgttcagcaggtgccacatccacccaccatcctgtgtgaaggctctcggtgtccacgcgcaacaaccatgatgatgcccacatccaccctcggttcagtaggtgccacatccaccctccgtcctgtgtgaaggctctcggtgtccatgctcaacgaccacgatgatgcccacatccactctcagttcagcaggtgccacatccaccctccatcctgcgtgaagcctctcggcatccacactcaacgaccacgatgatgcccacatccaccctccattcagcaggtgccacatccaccctccgtcctgcgtgaagcctctcggcatccacactcaatgaccacgatgatgcccacatccaccctccattcagcaggtgccacatccaccctccgtcctgcgtgaagcctcttggcatccacactcaacgaccacgatgatgcccacatccaccctccattcagcaggtgccacatccaccctccgtcctgtgtgaaggctctcggcatccacgctcaacgaccacaatgatgcccacatccaccctcggttcagtaggtgccacgtccaccctccgtcatgtgtgaagcctctcggcatccatgctcaacgaccacgatgatgcccacatccaccctcggttcagcaggtgccacatccaccctctgtcctgtgtgaaggctcttggcgtccatgctcaacgaccacgatgatgcccacatccacccttggttcagcaggtgccacatccaccctccgtcctgtgtgaagcctctcggcgtccacactcaacgaccacgatgatgcccacatccaacctccgttcagcaggtgccacatccaccctccatcctgtgtgaaggctctcggtgtccacactcaacgaccacgatgatgcccacatccaacctccgttcagcaggtgctgggtcctacatgaagctctcacatgctgacctgtagtctctgtggtccgtgagactcagaggctcatagcgtgcccagattcctgtggctagtgaatagaaggcgtgaaccatttttcttactgtttattatggatagttgcaattgttggaggcaattcatttgatcagtgtttacatcttatgggctattttagagtgataatcaaggagcatatattcttgaaattgaaatgatgcatctctgtatgaaataagtagagacaaattttaaagcaaggtgaaatgcaagataattttgagacacatctcggacagcaggtatcaggtggttccaggaaaccccagcgtccctcaacctggtcacagcttttctaagacaagagctcatggccagtagcctcagccctcccaggatgttctcgagcatgccagccgagcagagcctctgagaaattgtgaactaaagaaactcgcttcattttgctccctgcagacgtccctgaccacgacgtcattgcttccacgtcatccttcaacctggggatccctctgtgcagaacacaggagctgcccaccatcgatgccataaatccacacagagcaggatggaggagagttgcttcctagcacagtcacatttgcctgggaggcctctaaaccgtgtgttttagaatgtcagcatctctcaggcgttgttcttcattgaatacttaccagtaagccccaagattgacattcttaaaaattcaaagttagggttctctttgccctctctggcttagcagaacgcaggcagaggaagaacacctgtctttaaaacctcccacggaaggcagaacttttccaaacccacggtaacgtgtatttttaaggacaaaggtggatttgaaatgcgaagttggtgatgacgaagtcaacaggctgagttggagtgaccgtctcctcctgcatccccattctggaccattctcagatgctgaccaaggatcgggacacagactgaaggttatggatcatcccaaagcaccttccttttatctccggctgttgatgctgatctgaagctcctccttggggcaggtccacaggtgtttcttctctgtcggtaatcagcaaattccaggaagaaagtgtgagcgtgagaaaggccgtgatgggaaagatggccgtgtctgccccaggcccgtgcactccttgggggattcgaagtgtccccctcatctctgcctccctgtcacacagcttttccccaccgtggatttatgtcagggtccaaatttccctcctcttctaaggatgtcagtcattggactgagagctcatcctagcctgtgtgacctcaccttaacttgaccacatatgcaaagaccctatttccaaataagaccacattcatgggttccaggtggacatggatttgggggtacatgattctacccagtacaatggctaagaagaaaaaagaccttttccaagcagctaattggcacccacatgacatggtgatgggtcaggagtccgtttggaggtcactgggctgctgggaggcagaggagccaggagggccccaagttcctcagcaagaaatgctgtacaggggcccatgggtccagaaggggggagcctggaagacgggttcaggggaagtcccctcggtgagcatggggcatcgaggtcactccatgctcaccagcctctcccccagcatggcaccgcgaggccccatcagctccccgtcccgcagggcccacagcacctctgtccgtgctgcgtccctgagcagagcccagaacgtgcacgaaaatccacggagggtcaccactcactgcacacatggtgctttcctgcagtgaaccagctctatatggacactggatgcatttcaagaatttgatttccaaaatttgacttacatcaagaaattcctaaaaataaattcattacctaaaggaagatgtaccccaaattaattccttgtctgtgagtgctctccaaatcattcggctgaattcctggtccttactccagctcagaggggtctgtggaagtctgagttacagttcagaaatcagtgttactagtaagtagtaaactggcctagaaataaaacatccctcaaggaaagaatacccattttggggtgagggtgtcattttgtcatataaactttttttttaaagtgtggaacaattttaaaggaagaatggaaagaaaacttaagtatgggccaatcttgtgctacattatttgaagtcatatcaagatcttaggaagaaacatgtccaccgtcctctctgctggtcattctgggatgatatctggaatatgatgttccttctgcaatcataaattcaaaaagggtgctgacattcaaaacacaacagaaaaagaagccagagagtttggtggaaacagccggggtggtgagagttttgaaaatcactgcaggaggcagaaaaagccgtcctcggcatagagcaccacccacaagctccctcttcatccacgccgccgctgtcagcccagacgtcacaaggaaacttggcctcggctggcgtctggacttggtggtgcgtaaaactttctttttaaaatcctaattttctttttaaatcctaaactttctttttaaaatcctaatttaaatctgaagaagggttaagaatattctaataaattttaaattaggaacacgagtttggctgtgaggttttactgttttgttcaatgcttctaaataaggagtcttaacacctcatacccatccgttgacacccccaggcgttgagctctggttgctgtcaacaagccgcttagggaggaggctgaatatcaggaaggaagacgagaggaggaggcaggtctccatggtccactcctggatccctgcggctttgggtacctgtcagatagcctttctctagaaagcctttctctagaaagtgtattttaatctgcaaagacgcctcccacctgccaaatggggccaccttgagtgaaagacacgcacccattggaggggacattcgagtccagtgggcataaggaaagggggctgggggaagaaaggaagtcccatttactgagctcttcaatgccaggccctgggcaggcacttcccatatgggatctcatttggccgagccattgaccctgcgatgaagccatcgtgagcctcccatcattccacctcatggggtccccggaggcgtcagattcatagaagcctagtatgaatctagggggtagtagccaggggctcagggaggggacagtgcagaggggcttgatggtgacagggcttccatttgggaagatgagaatgctctgaagagcgtggtgacggtgacggttgtagaacggtgggaaggcccttactgccgctgcactgtgcacttacaaacggtaaattatatgttaggtatcttttactacaattaaaatagagatatacagagtgagcccaattctacccaggatgaagctgtggcccagagagccataaggacccacccagatccacacagctggtgggaggcaaagcccattctagacccagacatgtgtagtgccagggtgtctcttcagcatacacactcctcacagataaagaaggcacagtgacatgaagacgtctctataaacagaaaagagagatccggcagcagtgacctcggcatttccagagtaggtgttgtttacaaaaatacacgtgtgcagagtctcaaggcgcagaatatgtgaaagtcaaagtcctcagagacaggagataaagtgacgctttctccaggtgccgagacttccccacggggaagcaaggtctgcaccttcccggggacgtggccccacagtgcgtccccagcccagtcatgtcctggtgcacagggcagctgtcgcagagaagcccccgcaggcaggactgtagctggatcacagagaagcccctgcgggcaggactgtagctgtaagattaggactgccggggaggcaggggaggggccgcgggcatcgatattccatcacggaccacctccctactgcctgcacctgctgcgccaccttctaccacaccctgtgctacgcggctcgagtcaaccgaagggagttggccacccgccatcccccctttcctatttttagaaagagctgcagaattatgtgctcttcttccagagagagcttctgtgtgtcaccaccaaacactggctgtgcccaggagatacacaacagctgtttctaaaccagaaatgtaggcagcatagtctgtcaccatcaggtgcggagtggatgtctgcagatgtgacatggaaagccagggccctggagcccaggcacagggacagccaccacgggagcccaggcacggggacagccaccgcgggagcccaggcacggggacagccaccgcgggagcccaggcacggggacagccaccgcgggagcccaggcacggggacagccaccgcgggagcccaggcacggggacagccaccttgggaacccaggcatggggagagccaccacgggagcccaggcatggggacagccaccgtgggaactggctccctgtatgggaggctcagccaagaggacaactccaaagttcagccttgcctctcctgtctgatgaacaggctgcctttcaggacagagtcagacacgaaacagctctcctggcccccagagagagcacaaagcgctcgctgaagtcagcaggtgtcccactggcatcggatgtgtgttgactcttattgcacatcaacattttaccaagaaaaaggtgcactttcaatttctagtttctgctttctaaaagtattctgtgatgaagcctcagctggggggatatgttttctcatttccaaattgataggcttgatgtaaatacagctttttattatttggcatctgtagatcatagttcttactatggttaagaaaaaatcctgaacttggaactgtggaagacccaaagaatttaacggtgtttccttccaactgcctgccagccaccggtgacaaggccgaggtgcaggagaatgacagttgacagctgactgtcaccgtgcagggccgcccaccacccggcaccagtggctcgtctgcctgtctgcctgtttgtctgcctgtctgtctgcctgtctcgctgtctgcctgtctgcctgtgtgtcttgtctctgtctgcctgcctgtcttgtctctatctgcctgtcttgtctgtctgcctgcctgtctgcctgtctgcctgcctgtgtatctgcctgtctgctgtgtcagctactgcactagtccaggcaggggtgggtgggaagatggcaggcctggattccacaccatgcactgtctctgggcagcttccttgatcagcccaggatgaccactgcaggcatcaccatcagcaccaccagcaaccaaacctcagagcatccagagatgaccctggcctggccccggtggaggggatggtcctacaccacctaatttttaaaaacatttaaatcctccaaagatggcatccgctcagcccgagctggttcacggcccccagctactcacaactgttttaatgttccctcggcatgtgggaggcagggccctgagtgtcccggacagaccgagtgtccaacagcggggaccctgagcatccaggacagacccagcatccagcagcggggcccctgagtctccaggacaggcccagtgtccagtagcagggggccctgagtctccaggacagacgtggcgtccagcagcgggggccctgagtctccaggacatacccagcatccagcagcaggggccctgagtctccaggacagacccggtgtctggcagcctctcctttctcgtcagatgtgtccagcctgggaccacggtgtctgctctgggtccttggttaccttaagtggtctggctccaaaagcatgagaatgtcccccagtccctgcagctccctagtgtgggtgaagactcagcttgctcatcatcctgttccaccccctggacagtgactggtgcgagagggaaccgtctgtggatctcactgactctggagtgaagggagagtcaggaggttagcggggggaaatgacttcagaggctgctacgtcacagatgggttgattttaaggcacgttacttgattaaagggaagcatgagagttgtgttaattcttaggaattaacatgagagttgtgttcattcttaatttcttaggaaaaacttgatttttcatttccatgattgataagtactttaaccacatgcctgagactttccaggacattgttatatttcaaaggtttggtcttgctggatttttttctattcataaattcacgaacctttaaaggtgaaagaaactgtttctcacgttgccttatctaaattttgggtttgaaacctatgacctcaaagcttgtccatggttctgcctgggacagtgcaaagatggtcggtcagtctctcgccgcacacatgcggaatttaaaatgggactcaagtagaaaggacaggtccggctttcctttctgactgattcttactgctccagctgagaacagcaggctctgctgctcctgtgtgtgattggttcccagcctccggccagctcctcccatccccactcctcctcccctcttcctcttcctcttcctctcttgcttcacaactggatctgatgcatttatgtcaggtcctgatcttgaaaaggaaaggccgcccagtgcagcagctccccgcaaggagaccaggcgcatatttaaccgggaacgtgagcacaggcagaggccacagggagtctcagtgacgcctgtgccaggtgacttcctgtgcgggtccaatgcctgatcacaaaggcacccacggtggtcacacaaaggccgggtggagaggaagtccagtgtgtgagtgcattcccaccgtgggaacccctatgcggcaggatggccacaccaagccacacggggtctgcttgcacacaagcaggctgagtccttcccggagaacacagacccgactttggtggagtggcaagtcctcattctgaggcttccccttcctcctgggcagcaatactgctggtgttctgaggcttccccttcctcctgggcggcaatactgctggtggaaaagtcccagaggttgctgcagctgctcctcagccctgggatggggctacaaggcagcacaggcgtcgatctgatagcggcacaggggggttcctcccgctgccccctcatcagcctttccatcagcactgctgacgtgtgtgtgggctacgtcacctcatcgtgtcatccctaaatgaatcccacactgagatatttgtttactaaaaaaaagccaggtaggtgcaccatgagctggtcatggacggcatcacgaaggttttgtcaccctgcgttgggttatattaccgtgtccaaatgtgcgtgctgtggcctggagcctgtgactctctcggaaccagagccgcaaagcctgaagcttcatttcttaggactgtcctctgggcagggtgagagcagagctgaaggtttcccctgcaaaagatgtcacacacactatttcttcctctttaatctgtctcagaccacacagtttaacttccaggcatcggtgagctcctaaggagtgaaatacgagtgttttcccattaactgactcctcatccttttaaatttagctgcatcttctttataagtctaaacctctgttcagcccacgagaggacgctcacaacagaaatgagcagaaatgagctgtgcagcagaattgcgtgggccccgcacctgctctggaggaaatgcatcttcatggcaaccgcttcagcgggatgcagttaccatgcttgtttttttaaaaactgaacacttgtctgtacatttaagcaagtcctggaggacttctgccatgcaagcctttgataacattttctttcggttatctttttttttacataaatatccaaacggcctcttagaaatgtgaattgttttcaatgaagcatctgttagatgccatggagggtagaaaaggtaactggactaggatggagtctttaaagagatgatagtctggtagaggaaagacatacgggctaaagacaagactaacacaggcaggaagggactcatcacaaaagatctaagtagaaggaggagaagctttcctcctgaaggggcccagggatgttttgtagagaaaatggcctggcgtttcactatttcagttttttgttttgtttttcagagatgggatctcactatgttgcccaggctggtcctgaactcctgggctcaaatgatcctcccacccacctcagcctcccaactagctgggactacaggttcacaccaccacatccagctccagtgtttcactatttcagattgatcatcttcccttaaatcaggtctctgtggggcttcaggagagcttattttaagagtgtgtgtgtgtgtgtgtgtgtgtgtgtgtgtgtgtgtgtgtgtgtgtgtgtttgagacagagtctcgctctgtcacccaggctggcgtgcagtggcatgatctcagctcactgcaacctctgccttccaggcacaagcagttctcctgcctcagcctcctgagtagctgggattacagcacccaccaacacacctggctaattttctatttttagtaaagacagggttttgccatgttggcgaggctagtctcgaactcctgacctcaagtgattcgcctgccttggcctcccaaagtgctgggattagaggtgcgagcccctgtgcccggtcgagttgtttttaattgtaaatgtttaaggtgtacagcctgatgttctgacacacgcagacatcgtgaatgatgaccacagtcaagctaatgaatacacgtctcctcgcgtagttaccgtttctttgtgtgtggtgaagcacctgaagcctactctcctggcaaatctctgtgcccaacactcttattaactacagtcaccatgctgaatgccaggtctccagaattcagctgtcctctactggaagttactacctttggatcaattgctccccattccaccctcagccccaggccctggcagccccccttctactctgtccctgagttcgtcctttttaggtgccacatgtgagtgagatcatggggtgcctgtccttctgtgtccggcttatttcaatttaacgtcgtgtcctccaggttcatccatgttgtcaaaaatgacaggagttcattctttcttaaggctgaataatatttcattgtgtatataccacattttctttagccattatccattgacagacatgtgggttgttccaaatcttgtttattgtgaatagttctgcaataaacaaaggggtgctgatgtcccttccacacactgattttatttcctttgggtctatacccagaagtgggattgctggatcacacagtggttctgtgtaattgtttgaggctctccatactggttttattgttttttttgttttgttttttttttttgaggtggagttttgctcttgttacccaggctggagtgcaatgacacggtctcggctcactgcaacctccgcctcctaggttcaagaggttctcctgcctcagcctcctgagtagctgggattacaggtgcatgccacgatacccggctaatttttgtatttttagtagagatggtgtttcaccatgttggtcaggctggtctcgaactcctgacctcgtgatccacctgcctcggcctcccaaagtgctgggattacaggtgtgagccaccgtgcctggccctccatactgttttctgtaaaggctgccctcactcacattgctaccgtatagtgtgtaaggttccgtctcttccacatcctctccaacacttgccatccccctcttttcggtggcagccatcccaacaggcacgaggtgccagtgcgctgtggttttgatttgcatttccctgatggctgatgacattcagccccttttcacatacgtgcgggccatttgtctgtcttctttggagaaatgtgtgctcagatcccttgcccatttttagttgggtcatttgtttttttgtttgtttgctaattaaatacttagcactcaaaaaggacctagagtgaagaggccctgtgttcctctccatcggtgttgataggaagcgtaggcggggtggccattgttccacgcctgtgggtgatttgatgggtgaagaagagagtgaggttgcagcggatgcatctcttgctagggctgacatcacaaggtgctgcaaactcgttgttttaaaacaacaggagggcatcccctcgcagttctggagcctggtagtctgagatccaggtgtgagcagggccacgctctccgaagcctgtgggggaagatcctcacggcctctgcagtgtcccgtggccgcctgccatgaggggtgtggcgtgggtggccacaacactccatctctgcctgtctgcgcgtggccgctctccgtgtctgtgccttctcgaggtgtctccctcttcttctaaagacacagtcacgttggattgggacccaccctcagctcagttgcatctgcaaagatcctgtttccaaataaggccacattcatagataccagggattaggacgtcaatataagctgtggggaggacagcgttgaacctgtaacaaacaacaatatggtttttaaatctacagtcagtaaacttactcagttgggtcaaataacagccgaagtctgcacttcttgttccttgggtcactgtccgaatcactgaatttctccacttgctgctgctgaacagctgtcaggagacctcacagcaagctgctgtgtccctgccgggcgcgtcgagatggctcaggttcacagagcctggcagcaggctttaacccctgtgtttggtggtctctgagaaccactgggctgaccacttccattccttctggaatcataaacagcaaagcgcaacattgctcccctccccaccccaggcccacagagctggcacagctagagccttcaagggggatgctgaggcctggggacgctgcactggagaagaagtatgtaaaactggggagtatcagttttcctccaaagcgtggtgccagccgttcacactcgggatccagcacttgcggctcattttcagtccatgttggtgactttggttcgatccagggatggtggtgcaagtgctgggatgtgcaggggctcaggtgtgcaggtgctggtgtgtgcaggtgctggtgtgtccaggtgctcgggtgtgcaggtgctggagtgtgcaggggctcgggtgtgcaggtgctggggtgtgcagggggtgtgcaggtgctggggtgtgcaggtgctggggtgtgcaggggctcgggtgtgcaggtgctggggtgtgcaggggctgcggtgtgcaggtgctggggtgtgcaggggctggggtgtgcaggggctcgggtgtgcaggtgccacggtgtggaggtgctggggtgtgcaggtgctggggtgtgcaggggctggggtgtgcaggggctcgggtgtgcaggtgctggggtgtgcaggtgctggggtgtgcaggtgctggggtgtgcaggggctcgggtgtgcaggtgctggggtgtgcaggtgctggggtgtgcaggtgctggtgtgtccaggtgctggagtgtggaggggctcgggtgtccaggtgctggggtgtgcaggggctcgggtgttcaggggctcgggtgtgcaggtgctggggtgtgcaggggctggggtgtgcaggggctggggtgtgcaggtgctggggtgtgcaggggctcggatgtgcaggtgctcagatgtgcaggggctcggctcgggtgtgcaggtgctggggtgtgcaggtgccacggtgtgcaggtgctgtggtgtgcaggtgctgcggtgtgcaggtgctggggtgtgcaggtgctggggtgtgcaggtactcggctgtgcaggtggccatgggggccgtgttctcttacccttcaccaaacaggaagtgccagtaatggtcatttctggaattcaggcatacagttttgtaaactgcgcattccaatgaactgcattaagattaaataaggatcctgggtcattatttacttcctgaaagagacagttttagatttctcaaagatttgtgacacaaaccaatgttaacttgattaagtctgaaaaatcctgtatccaaatgaggtcacattcacaggtgccaggggttagcacttccgtatttcacctgtcagcaaagaccaagtcaatgagaaagaaaatagtgaaacttctccccgattagaaattgaaccttactcgactgggatttttactgattctgcattcataccaaaatccaaattaactttttgcgatgtattctgaggttatctggtcaggcgcgctgttgaaggctggaaacagatggagaaatgccatagttttcctcctcgattgagttgctttgtaccgattcaaaggaacacaagataatgtaatcagttccatgaacagcttgtaatattggtacccaattgggctgcctatttgtttgatttagtaaattcccctctctgcttttatacacagtgacctaaaaagaaatattattccccagagcgcctttgggattgcttgtttaaattaagtttcatttggatttaatcttaaccaaatcttcagagagccgggaaggcgccccataatgaagggcggacgcgagagccaatgagtgcggcttccaggccgtccgggtccccccagtcgacggggctctgtaatgtcacacttgggtggcacggagccgagtgccggatgattagtttatggtctagatcattgtatttttattacactcataaaatctgtgtttctcctcattttcgtaatggcttccatgagcttctccaccttctgaaggcacattaaattgttatgtgatggaagaaccgatttggaggagcaggtttgaaagcctgaaaagcctggcgtaagaaacatgttttgaattctcatcttgttgtcggatgggcactaaggaaagagaaagtgcacaaatttgagcataattcttatttatttgtgggcgttttgtaaatacttcagttggttccattggcttccgatgtaaatgttacacagtgaggtgccttgaggatattgactatttcagccccgtgagaacataaatcaatattaaaaaaggaaaatgtcgtgtttgtgtctgatttttaaaatataaatgtggaattcagtaacatgcgctacgatgacagcattttatatttgggatatgagggtttttaaaataacaaggtcttaattggattttgtgtctgtttttaaaagaaatagaaactgtcttggataccaaatttacatctaaatgcagttgcttataaacatttctgccaagttaatgtaacccattgcagaaaaagcagacccctcttcactctataatttcatatgctaataaaaatctacaaatgccacatcagtgtgccccacaggattagtggttttgggtagttaggctgtaaatgttaagatgtgggtttacagccacaagtagccagttgtgtttgcaaagaaacgaggtcagaggactttgtgtctttgtaatttctgtgggtttaaatgtgcttttgtttattgtgtttcaatgtggctaataggaattagtaaatcaatttggtatttgctttaatctgaatagtgttgccatatttcggtataaacaaatgaaattgcagcagtgcagtactgctttccgtgaagtactttgaaaagaagcctttcggaggctgcttctgacaggacagcagcttcacgaagcaaaacgtttctctaggtgagcaaaatgatgctagccaccagcaagtgagggtgtcggcaccgcctcgagaagtgctggctgttatgtgtggcgttgtagaaagtttcctttacagatcagaagttggaaaaccacacagctgaacctacacctgaggaagctctaaatggcatgggataaatttgcggggttttttaatatttcgtggaacatgcaaactatgggccagtgcattcagagatgctcaggcagctgcggagtaaacatgtctgatgaaaatgaaataaatgtcctgtgaatggaataaatttggactgtgcttccgagtgcagtaattacacatgtcacgcggtgatgagacagtcacaccgcggccacgggccttctttgtccgcagatggtgtgggagagcggctgcgtggtgatcgtcatgctgacacccctcgcggagaacggcgtccggcagtgctaccactactggccggatgaaggctccaatctctaccacatctatgaggtactccgaccagagccacccagggcaggacccaccagccggacgaggacgggccctgctcctcctccgaatgggattcgttagggccccccagggccgcatgcagggaggctcagcgcaccccatgttcaggggatggaggctgagccacccccgagggccgcatgcagggaggctcagcgcaccccatgttcaggggacggaggctgagtcacccccgagggccgcatgcccgtgtggatggttcacacggctgtgtgctcatgaaccagaccctgggagtgtggtgtggtttttatcttttagatttttctaaatccaaatgataacagagtagaaaaaacattcgcctcacagcgtggtcccggtcccatataacaagcctttaagtggggtccgtttttaagaaaacctggcgcccatccttgatgccagtgcctgagccgtgtggcctccccgtggctctgcttggagtttcgtggctggatcatgtgacctttttatttgaggataacctgctcaccagtttatttatctggctggattttctgcccccatcaagaatgaactaaataaacgtgggtgattaagccagcactagaatgcatgctttgattctgtttggcattaaatgagtgagaatgccaaagctccacagcaggaagcgagttagaggctcaagtgtgaaccttaaaccacacagctgtggccttggggttcctgcagaaacgcttaggcccggaagtgcctgcgctggggttcacatcagcgcgactccgtgagccttttgcttttcctgctctagacccgggtgtgcgcagctgcgacggagtctcacttagagtggaaccactgagcagaacatgtagtcgtgtcgctgcttttgttgaaaagtgtaatttttctctggttcctttttttgagggtttatgtaacatggacatgcaaaagacagaaagtaggatagttttggattgtaaccttttaaaaaattatttgacgctcaagcccctaaataacactaagcacacacacccgcacggagctaacttcagtgcgttaacactgggaaggtgggagggggccgcgaagccgagggaacccacctgcgctgtaaaatgtgccctcttcgcagcgcccccttctctggtcagacgtggccctgggttcctcagtgcctgaggttcggttcacaatgtccacacctgtctctgtcccctccctccgctcctccctgccaggtgaacctggtctccgagcacatctggtgtgaggacttcctggtgaggagcttctatctgaagaacctgcagaccaacgagacgcgcaccgtgacgcagttccacttcctgagttggtatgaccgaggagtcccttcctcctcaaggtccctcctggacttccgcaggtatgacgcgcggcccgccggcagggcagtgcgcgctgagcgcgcggcacaggggagcgaggcttcggtgctcctgagacgcccctggcgccgagggccgcgtctgtgtcggcgccgcaggggggaggggaagggaagcgagaggcgggaagactccgttaacggcacgtgttaatcgtgagcgattttctagcttcagaggtattaaaatgtgagggggaataggcatcttcgaactgtggaaatagggccattatttttgataaggttcttcagttgacaaagagcctaaagtgtatgtgccacaggatattgatgcataaagctcggatgttcagttggattctcatctggctgcatgggatgaaagaggtagcgagcgcaggcccagataccaccctgcgtgatcttgcagggaagcccggagacacttagcccgtggctgtctgtatttttagggctattttgaaactgaccctctttaaaaaattcagttttttgttcattgctccagtcagccagtcacccaatacgttgtctggtttgagagtgtatttactgaactgttgaagtgaatgctagactctgtcttacaggaagaaattgacaatgaaaaaaaagcagcatttaagaccacagctttgattgtggtaaacagtcggtccgcattggctaggtggtggtgcttagtgaataaaccaccacaaggaaaatgaaattgtcaaaagcatcagtgacgaagctctaaattgtatagaatatgtcttacatttaactgatcagaagtctacctattgaggaaaagagacaaatatccaaacaaggagaataagaagaaaaaatgcatttgaatccaatgccatgccccactatcataaagtgacttgattcttaacagttactcattctcgagtctacagttatgtaactggagggaggttaacgagacaaagattgtcataaagaagcgatttttgaattctctgtggaattcttgaatttgtgtattacagattctgaagcttattatgattcaatttattttgccttttagtctacattgaaaagcaaaatgcagttttttgtaatttgaatcaatagaaatcaatcaagagcctctgcaaggagacacttgaatctggtgtcacagccacaacacacactcagtggcccctgcctgccgtcacctcccctggggacgcagagcgtagatccagagtcctgagtacatcctaaaacaactactgtacacggctccttcctcacccacgctaatttcctggccattatgtacattctgtcaatacggatttatttctaaagacatactatgtagaaatcttacataatttcctgaaatagagtcttcaaaaaacagtcattcctggcaaaatggatgtaactacaaagacggcaattcatcttaacaccccgtctttgcgttcatccagtgtgtttgcacgtatatgcatatgggcacgttgctatgtccatatccatatatggacgggaacatgtacatcaccgaccctcagtgtttatgattcatcaccaagaaaaattggattcccaaatttcccttgctccagggtctgaggagatacagcctaagaaggtttttgttaaattcaaaagctaatgaacccccagacacggttttgaaagccacgtcagagtagaaagcttttcttgcctgccttacctggcaccgcccagcgtttcggccaaggccacctttcatgtgttatctggacagtgggtttgagcgaacacattctcagaaagcttcacacttagacaagcattgccggtggctggttttctgtataaaatagccaccccgatttcagcgacaggaaaggtgagaccccttctgaagacaccggccatcttcatgctgcagcgtttcttatctttgaacaatagacgacgcgttctcactctggcctggcgcgttcgccaggcaccgagatgtgtgattaaatatttctggagcccagagggagcgcatttacactttaaagagaaactgctaagagataattagcatcacatgtgagggctttgctttaaaaactctctctctctctctctctctcattattactctctcccttcttgctgtgtgcaatggtgctcactaacgctgctcacggtaaaacggacaaacccttaccttgccagctaattagcggtggccagtgtcatttttgtgatgttgcagctagtaatatgagcccagttgcatagtcacaaaagtgatcattggaaactgtgactgtactgcaggggcgatgtggaaagccccttttctgagcctctaacgacctctgaccttgcttgctggtgctttgcatgacggtgcgctctcgcccggtgacccctgggttggtttgtatcactaatcgttctttctcagtgaattcctgttgtggaagtttctatgataccaacttttcttactgttggagaccttttgctcactgattctttgttctgatggagtcaaatgagacggctgtgtcaccttcctgaataactcgtggtctacatcttgggtcaaccggatgaactcttgtgttcaatatgtcgtggttttcctctctatttgtgatgctttgcgtgtaataatacaactgcatgatcctttgtaaataaagtcctcagccatgccacaccctgtatctacactgcacatgtccttgactgcccgtgggtttttgtaaataggttgagcacaaggtgggggctggtacggatatgaaaattacagcgaaaccttcccaaggccaccaggcacaacatgtcagagaaaatggtatcttccgtatactgtgagatagagacaggagtttcgggagtggggaagcaggttgaggccatcgtagccacaaattcactggctaggagcatttcccagccaagggggttattactgcattttgccaaagcaggagctgaccagctatccatgagccaccgctgtctactgacttcttatgctggcctttcctcaaaccagcacactttcttaaagggtatctggtttggggtttggggtttggtttgttttactgtcccttttttgggtgtacttggtctcatgaggaaaaaatgagcaacccctggtgactggtgggtgtggacccagaagctgagcttagtctctgcgtagagtggaccacgaggtgtgaaacacagcaggaagctggaggagcagaactgaggtcattcccatttgcaagattcagaggctgagccatggccagtaaactcctctgccaaaggcaaaaggcctttcaaagcaaagccactcaccatttggtctgatagttgagcctgcttgattctacacgtgcacacgtgtgcacatacgtgctcacgtcacacacatgcgtgcagtctcatgcacacacacatggtctttactgagctggagggcttcccacccccatgctggggtgcacccctgaggcctggtatccattctgtcatcaggagccctcgatgctttacagcctgagtcaggaatggaaaattgtagaagtagacataagtgggtctgttttccaacctctttattctccagggaccaagaatgttcaaggcactctggcatacaagtgctgttgcctctaaggagttcaccattgccttccccgcctctccccaaagccttcgcaccactgtgtgccccggaaaaacaacaacaaacacctctaacagaaacggtgacacggccctggaggccgttgctggttgtgcctgtgtctgagcccgcccatttttgggcatcagcctcgtgtttcacagaccagagggcagcacagatcaagtgcgtcctggctaggctgtggccgcggcccatctgcaggtgggcacgccgagtccagtccctgcaactgctccttcagctcccgtggtgccctccagactgggcattcacactcccatcagaagggccttgttctggtaactcctcagggaataggaagagaggaggagaaagctctgtggtttgggctccgccgtattcaagcatccctcccctcatgctcactggacactcacctcccctctccttccacagccaccctgcccctcctggcttcaaaggtttgtagcaaagcaccggttgatggaatgtttactttccacggactctttggtgctggataggcaaggctttgcaaagaaacgtgacattttcccattgatggtccatacttccatttttcttaatttgtttcttgtaggagttcacgcagcacattgtagaacactctccttcacacatgctttattccaataacccgaggttccgcctttaattttacttattcagaaatagttcactgacaactttaatggacttcataaacatgtttcattgtttcactgaattaaaaaaaaacacctggatttacacagtgaattttaaatcagtcctctgttttgatttaggggttggttatgaaatcttaaatatatgctcatttctaatttttacaacttctgatctaaactctgcacaatgaagttgtttgtatactcaaagttataagcatggaagggacttgtcttggacttcatagaggtttctccgtaatttagatatccttaccaaaagctgacgggtcacaaatgcccttgaagatgctgtttttagacagtatggaaataacagttttcaatatgatgtctggactaagaaattttgagcataaattgcaaaactcaaaaattttagtgaagaatcaagatgtagtgtaacaaaaggtcaagtcaacataagcagaaacagaaagaggagagcctgcaggggtgggacgggcaggacaggccgggagtccactggttcaaagcctggcacccctccttggaagaagaaagcagtgtagaggtgtaacattggttttaaagctccgattaataacgtcatgttgagaagaagaataaatgtttgatattatgcgtatgatttttattttctccgtcaaaacaagcgattgcaaaatgatttcaaacacacagaccttgcgctttgttttaatagttgttttggataacgcaaagtcttagtacacaacgataatttttatatctctttttatttcagaaaagtaaacaagtgctacaggggccgttcttgtccaataattgttcattgcaggcaagtacaacttttaatggattaagaagttttggctacctcaaaaactaatctatgcaattaaatacagaagcttaactttctaattgcttaataaatataactaactggcacttctaaaggaaaccaaaaatataaacttacttttctatgccatttgggtaaatacaattgggcgttgcttgtattatgtctgtataaactgcacatggcttgcttttttttttttttttttttaactctgttgcccacgctgcagtgcaatggcgtggtctcgtcaggctcactgcaacctccacctcccgggatcaagcgattgcgcccgccaccacgcccggctaattttttttgtatttttagtagagacgaggtttcaccatttggtcaggctggtcttgaactcctgacctcaaatgatccaccgacctcggcctcccaacgtgctgggattacaggcgtgagccaccgcgcgaggcctcacatggaatattttctagcagcccacggtgcagtgtcctgccttctactcacccgtgagcatgtcctgccaccttgcttgttcttaaaccctgtggtcccatgacacagaaacatcgagacaatggtttcagcctgttgcattgtctcaaccaccaggacgtccagcagaggctcagaaccctctgcagatggtgagaaatgcttggggccagttatgtacagggacgaaatctgtcattacaggaggtacagccacctccagtttatcatgtgggttcaggcctctgggtaaaaattcagtgactcatatccctaagtacgttaaaaccacaccagtaagaatagattttacgcaaagaaaactcaacctaatagtactgtctctgctggacttcatacccaactccttttggtgaagaactcatattccatttttctagaactgtcttatagaatgttcttcctgcctggaataaaaaggaaacctgtctccaaagaacaaacaccaaatctgtcaaatccaatcaagaagcatgtgtgttttgtgtgtgcattcctgtctatgagagaggaggatgaaaatagattacggtttgttatccttacagagtagagtagaacatcttttttacccacaaatgtatcaagacaagcaacacttagttggaagatttttgaagtatatcttaaaatattcatgtgaatatatgctgtgcataggagacaagtgagaaaggcactcagcaaccagaatgctcaccgtggccctttgaaatgagcagtgagggttacgtggcggcccaggccgaccgcctctcctccttggtgatgcagtgagggtgtgaggatgtgaacgtgccgttttttaaacatttaccatcccaactgcagcttttttcaaccatttgtttgaggaaacatgttaaagccaaaatgcgctgattctttaccatcaaaagatcacctataggattccagtcatttcttgggatcacagacggcatagaaagcagaaccgaaagtgtgatatctgctgggtagtcacatctttcttgaagtcttgaaatggaaacatttattcgttttccggaaagtcacaattgattttgctaggattataaatgtaaaaggtcctctgtttaaaagccagtcatgggtgtgaacacgagccctatgtacttttaagaaggtctctcaaactcatgcaacccagtgacagcgtctgcacgggggcaggaaatggcttcacacattcctcataagaaaaggatgatcctgaggctactcttcttccagaaaaaaagggaaattttttttcctttgctactgttgaagtattattcaaaacatttttacaactctagcccagatggtaaatattccaattatagctggtgggatgagaaagagatgaaatgagagtgctttttaaagagtaagatttagtaacgactgttatgtcaatttctccttctgagacggaggacctgcgtttagaaggggtggcaggcagcctagggggatgtgcctgaagtgtccctgcgtgcatgagccagcggggcccagccgcccagcgccctcccctctccgctcgggaggttgcccggcaacactagagaaggcaccttgcagatattttcaatacaaatgccatcaactctgacacagtcaaacgcttagttcattttgttctggcaaaatttaccacatctttggccaaagaggggggaacaagcaagagggagtcacatctgagcacagcagctcatcccacaagctacaagctgctcagaggctcgaagcccccaggggcctcccttctcccctcacttggattctcccagcccgcgtccttcctccccctctcacatccgccatcctttcctctcgccggcccccgtaagcaggaaggaaatgaactgtcactagctttgttgtgggtcgggcttccgtgtggacggcagcactttcatttctctccttctgttggcagtgacggtgcaggccggagcggcacctacgtcctgatcgacatggttctcaacaagatggccaaaggtgagacacagacactgccgctttgttgcggctcagagctgggatggcgtcgctatggcaacgtagggtgccgtgttcacgggaggccctggaaaaaattcgctgcttgttgtgcctctgctgggccgtaggaaggtggtttgcagcaagcacatctgcttctgaggctggtcgtttgttacctgcctctgcgtgccgagcctgcagtgggtcctttgttacctgcctctgcgtgccgagcatgcactgggtcctttgttacctgccttggtgtgccgagcacacagtgggtccttgacaggtgtttgctgcatacgctgcagcgttaacctcagagccacggagaagccaccctcgggtccttcagtgttgttgcagtgcagaatgccgctccagtatttggtgtaactccactgttgtcaaaacggtattcacactagaggcacactaaaaatatccgttagtaattgccatcaaatgtcaatcaccccctctcaaatgagcctttcagccctctttgtgaatgtccttcttatctagggaatctctgtgcgtgctgtgggaggcgttcctctcagagacggtgtggggagtcttagacttgaggcctgtggtgggagaaggacaggtttggcagagcggcagcatgcgcagacggcgtggggagtcttagacatgaggcgcagggtgcgaggatgggtccagcagcagcgtggaaaagcagatctgtgcgcgggtctggctctgccagcaatgaggtttatcactttggacagagcttttaacctctctgggatccaattttctcctacaaaagcatggggattgagctctggcatttctcaaaaggtggtctccagaatacccaacctctaaggtcatctctttaaataggggccagagagaaggctccccaggcaggtgagcttgagaggaggcacacactgagtctgctccttgggcatcacagggcaggtgtgcatggagaggtcccaaggagtccagggcagagagatgtgtccagcttcccttcagttggcgcctccgacacttacttgagaagagtctgcattagccttgcgatacccgttagcgtcccatggaaggtgggaggcaccgaggtggtagcatcctacggtctctttcccagctgtgaataaacaattccctttgtctcaacacacacacacgtatatgtgttcatacagagacctccgccttccgtaacatcccattctccatcactggcccagtgacaggagcagccattgattatagaaacaagtttctatacacttccacgaatgccagcaattttaaaataagcattttccttacttcattttcttctggttaaaaaaaaaaagacataaatatgtgaagataaaacaacagccatggctttacgcagaaggactggagagcctgggcaagttctccagcgtcctgcagcagaggggagggctgcagcccagccccacaccccacacctacccaacaccgccagcatcctttgctggctgctggggagaaatgaaatcagtttttgtgccaccaaatgtcattttaaacacccaagattagtttagtggtgggaatgtgcaaacaaaaacaaaatgcaaacactcataatatttttaatcctttttttgtttgttttggacatgacacaatcctaactttttgtcatttaaaagtccatttttccttgtccattaatgctgctgtgtcttgtcaaatatttcttttcctttccaaatttacagctattggagctcagagccatccatggaatttgtatttctccacttatcatgggccctcccttctttccctctctcagacaaagatttttcttctcttaaaccaaaatgtcttcagaacgttacagatcatttgatgtaagtgtttctgaccaagcctatgtttgtgaacgtgtgatgtggtgagttgctgggggcacctgtgattccaatggaacctgcccatccagggaccagaagcacaggcaggcggccggacgcaggtgaccccagcgtgcgtctccacagggatgggatggagcctgggttctgagtggctcaggttcactccacagagaaggaaacatggagaagtatgtcctgggttcgagaccccggtacggggggcagggctggcatattgtccaggcacctgagctgctgttcactggctccattgtggcatgtgatgtcaattctcctttgagagtgggctcagctttggacaatacgcatgcagccatgtggaaatggccaaagagggctggcctggggccttttctgagattggtgaccctcctcctgttcttgacctgctcctctttccctggggtgtgtgcggtgtgaaattccctgacccgggtcccaggccacagtctcaggagagatcaaagggcaggcagcccctctgccggctgaggtgggcctttcccaggcctccacactgagaggcgctggggttttgttctggtgcaggctgggccctgcccgtgtggcggggcgtctttgtctggcctgagaagctggaggcccccactgcagacccagcgtttctcaaatgatcaaaggcccagagtcctggacgtgaaacctttcttcccatttccctttctgtaaaggaatgcattacagaagaccagagaatgcccttcccaagcttcccgggcagtcgggcagtgccaacgctgatgttagggccctccagtcctgcatgcagggcctctgcatgcttttagctccagcagctgcggccgcagacagcagagcagcacttgtccacacagcccatcagggattaaggcctttgggcctagttgaagggcctttaaaaacaaactcagaatagttgaagttctttctctactgtccagtttagcagcaagtagacgatgatgcagtttggaatgaaagtcaacaggctcatgttctgcaatgggttttgtggcaggaaagtaggcaccaatctgggaagcgcttacacgtgtcatttctgtggcagcagatgcgtttctaactcaccgataatagacgattgtgtaggaatctgtttttaggtagcctgttcctctctcattgaagggcttggctcacatgtagcaaaacatgtttttttcaagcaagatattttccaaggttgtgccttttacttttttgtcagtgacttcacttactgagggtatttttctacttccccacaattttttaaagggatgaggagcaaccagcactgagggggtactccccagagatgaggtgggctgagcatgctgggtggggtcaggcttcactccccaggggccagcacagaaatgcagtggctgagaagtgtggccaaacttccacggcattcccaccagggtctgcgcctgggccggaagagggtgcctgtgtggccccaggtaccatggaggccatgccaagcagacactgtatgatcccccagcagctgtggctgttgacaaggtgcagagtgagtctggggtgactcatttcttttgtctggcaggagccacagaccgggaattttgtgttccaatatgaatccccacggcttgtgagcccatgctggagcgaccttttaaacttcagctggctaggagtacgttcctaagtagtctcacggcgtgaatgtgagtggacggtggggtgtccacacgggcatagacccagctctcagactcagcgactggacatggtactattttgtgtgtggatacacatctccttgcctacggggatggatcacttccgttcttctttgtttccgcgaatctgaatatactacgcacctcatctaagtggagtgataccgcgtctgcgcttccgtgactgttatatgtcactttgcataatgccttcgaggttggcctgtgtcgtggtgtgtgtcagcactaacttccattttatgactgactcatattccatggcatggatggaccgcactttgtggattcatttgtgtattaatggacagtgccgttgtttccggctttgggctgttgtgagtaatcctgctgtgaatgtggatgtgagggtgtccacccacatccctggatatgtccctggggcggaatcgccacatcgaccgtaattctcttatctcttggctgtttgattacagccatcccagtggatgtgagtggatctcaatgtggttttagcatgcatctccctaacaactagtgatgttgaacatcttttaatggcttattggccatttgtatatcaacttgagcaaaacagacatttcaagtcccttgcccatttctgaagtgggctgtttgtattttttgttgttgaattctaagagttctttatatattctgaatactactcccttatcagctatgtaatttgcaagtattttctcccattacatcggggttttttactcttttgatagtgtctttgttacacaaaagtgttcaattttgatgaagtccagtttactttttaaaaaatatttttcttgtgactcacacctgtaatcccagcactttgggaggccaaggcgggtggatcacctgaggtcaggagttcgagaccagcctggccaacgtggcaaaacccagtctctactaaaaatacaaacattagccaggtgtggtggcagatgctactcaggaggctgaggcaggagaatcacttgaacccgggaggcggaggttgcagtgacctgagatcgcaccattgcgctccagcctgggcaacaagaaagaaactccatctcaaaaatatatttttttttcttgtgcttttagtatcatacccaagatatattggccaaatccaaggtcacaaagaccttctgctatctgttcttagatttcctcctatattctcttaacttttaagggcaggcccaagtagtagatggaaagttgcctgtgggaagcgagaggggccatggagcagagagcctgctgcctcgagcgtgtgcgggagcatgtggtcctgatctgctgtgtgtggtgtggtgatgtgggagcacatggtcctgatctgctgtctgtggtgatgcaggagcacgtggtcttgatctgtggcatgtggtgacgtgggagcacgtggtcctgatctgctgtgtgtggtgatgtgggagcacgtggtcctgatctgctgtgtgtggtgatgtgggagcacgtggtcctgatctgtggtgtgtggtgatgtgggagcacgtggtcctgatctgctgtctgtggtgatgcgggagcacgtggtcctgatctgtggtgtgtggtgatgtgggagcacgtggtcctgatctgctgcatgtggtgtggtgatgcgggagcacgtggtcctgatctgctgtgtgtggtgacgtgggagcacgtggtcctgatctgctgtgtgtggtgatgcgggaccacgtggtcctgatctgctgtgtgtggtgacgtgggagcacgtggtcctgatctgctgtgtgtggtgacgtgggagcacgtggtcctgatctgctgtgtgtggtgatgcgggaccacgtggtcctgatctgctgtgtgtggtgacgtgggagcacgtggtcctgatctgctgcatgtggtgtggtgatgcgggagcacgtggtcctgatctgctgtgtgtggtgacgtgggagcacgtggtcctgatctgctgtgtgtggtgacgcgggagcacgtggtcctgctctgctgtgtgtggtgacatgggagcacgtggtcctgatctgctgtgtgtggtgacgtgggagcacgtggtcctgatctgctgtgtgtggtgacgtgggagcacgtggtcctgatctgctgtgtgtggtgacgtgggagcacgtggtcctgatctgtggtgtgtggtgatgcgggagcatgtggtcctgatctgctgtgtgtggtgacgtgggagcatgtggtcctgatctgctgtgtgtggtgaagcgggagcacgtggtcctgatctgctgtgtggtgatgtgggagcacgtggtcctgatctgtggtgtgtggtgatgcgggagcacgtggtcctgatctgcgtgtggtgacatgggagcacgtggtcctgatctgctgcgtgtggtgacgtggagcacgtggtcctgatctgctgtctgtggtgatgcgggagcacatggtcctgatctgctgtgtgtggtgacgcgggagcacgtggtcctgatctgctgtgtgtggtgacgcgggagcatgtggtcctgatctgctgtgtgtggtgacgcgggagcacatggtcctgatctgctgtgtgtggtgacagcagaacgtctttgtcgaatcgtgttttgtggctccccggactttgaaggtccccggactttgaaggccagcagccctccagagccgccttgttccatacagtagccacatgtggttccttagagtcactaaaattggataaagtttacaagtcagctcttcagttgtactagctgcatgacaaagccacagtggctacaccaggcggtgaagctggaagtcactccttcccccacagcaggtcctgggggccacacggctccaaggtggcactacggtggctcctgacttcaccctcaccctcttctcatctccctgggcccagccccatcacccctcgtgtgctggtctccccgctccattttctcctcctgattaggtgtcacacagcagtcagtaagatgctttagacagaaagaccttgggtgcctgcctcggccctggagctgtccccagagccctgggcgagctgtccccagagccctgggcaacctggccactgccgatcccccttggtgggccactctgcctcctttggctccaggactcagggctttgcaggttcttttctgtggcgtggggggcgcacccttcccctccccagggtgcatcccccaccctctgtcctctctggagtcccactggtccattccttctctggcagatgccagggtaaaccgtgaaagtgtggctccagctgatggcagggcagcgtccactgcatgctggatccacgctgatgctggtttggcacctgctgcctgccaggcgtgggttgtgagagcaaaacagagaagccccatcctcctgctgcatcttcctgctctgccgagagacaggtaaggagtctgtggctgcagggtggtggagagcagacaaggacactcccagatgcagagatggcagcttcactcacgggctgtcctggggctcaggaggacccacagaaagcttttcactgaatggaagggggcccaaggggccctccgttctgaccactctgttgcaagctgaggaagcagttctgggaggttgggtgacttgcctcaaggcctccggtcagccagagtcagatgcagaaccctgctcagtctgcaaaggctcagggcccagagggaggatggtggaaggcacacggccccagggacggcgctcagaggcacagcgtggtgtgttccagggctccagggacagaggggcagcttcgctggggagttcctttggggctctcatggaaactaccggaggaagaggaaactgagggccagtggtgaggcgcctgggccgccgagctcagctctctctgggcacagcctggagtctgcagggaagtgggagaacccaggcaggtgctggaggaccagccaggcagtgcagaaccagagggcggggagaccggccgggcagtacaggacccgggggccgaagggatggcatggctgggcagtgcagaaccagagggcggggagactggccgggcagtacaggacccgggggccgaggggatggcatggctgggcagtgcagaaccagatggctgggggaccagccaggcagtgcgggactaagagggccagggaatggagctggaactgaagaacaggccagctcagccacggggcccaggagagggttgagccagacagagccacacatttgggcgcaggcaccaagagaaggaggtgcaggtgcatgaggctcagccttctgcagatgagacttagggggacgcgagggctgggcagaattgggaaagctgagcaggagacgtctcgcttttatgtttggctgaaacatgaaaacacgaagggccagtgggaaagggacctcacagacacgttgggcccgcagtgtctcttgtctcgctcaggcaagtttcaggctgaaaaagtgcccagaattgggtgaggtgggaggagggaaggggagagggagcctgtctgcacctttctcttcaagggagaagttgccttcggtcgggcaggagcagggcctcctctgctgtgtgttgtttattttctgtgcctttccttcccctgagctattctggtgcaagagaaacagtgagggatgtggggcgtgaggtgtccccaggttcccgggccggtctgcagtgccctgtcccgtgtaaggggctgacgacgaacgctggttggagcagtggtccgggggcgtggctgaccccacccaggcagggcacaggcggaccctggtgtcgatcgcctggtgggagcgtgtggacagcatgagacccgctggtcttggggaacacgctctgggcatccgtgtgggcagcactgcccaccatccttcgatggtctcctcgggggtcttcgtccctgtgcatggagccgtcctcactgagtgtaccagctcacaggtctcccaccttcaaggggtctcccaccttcaaggggtcaggctgaccctgctgagccagggttcacatagcctggctgcaggggctcctcacccactcctgggtctgatgtcctcacctgggctgtcctccgcttctcctcatggtcacgcagacacctcaggcccattggatgccgcaaaatgtcgttcaggtcccacctggccgagggctgtcccttctgcaagctccctccttggtcccgggtgctggcaccagcccatccaggcccatccaggccctcccctccctccaacacaggccttgctggcacacatttaggggtcagaccacgccagcaggagctggatgaggccacagcgagggagctggcagcaggcggcccctgagaatgtgggagagaacacaggagagagacggggcggggggggccacagccctgtcggggcagctgtgtcgctgtcaggatgtgcccgaagcactggtccctgagtccacatgtttctgttcaaactcctgtttggaaattcgggaggggatcaaagtcctgccctccaaggttcccgttggagacacagctccacggtccaggctggcccggcctgcgcacttgcctgcctgattctgctccctgctgccgggcagtcactccttcatctcagtccctgggtcctctccgtcctctgtgcgcatcttgctcacagcctggttgctccatttcctgcggcacagctgccctccccacacagtctgtggtcccccctccatctcctctgctctcgctcccacccactctgtccttccctcattcctctgctcgtccagcccccgccagtgtgttctgccactccctatcctgggtttccaggggcccatgtggagggctgcaggggtctccctgttgtcctggaggcacctcccagagcatcatccctgcccagcccgcaggcccaacatcctccgtccagaccctgaggggctgtccccagaggcagcaggtcccaagcgtccgttcctagcgcctgaagtccaggcacatgcagcctggccttttggcagtggggctccctcgtagtgttgagtaggatgctgggggtcccccgatggagtcagggtgctgcagggggtcacacgctgtcccgtggaatcagtaatcctcatgcaagattcttccaaatgcacagcaactgcgtgagacagaacgtgcgtgtgggaagggcagcgatcccgtgcagtgtcacgcggcccctcggctccctccttggcctgtgcttccgtttctcctgtttccgaggtcaaatgatgcaaagtgtccttgaccatgagcccacgggcatgggacaaggtctctgtgtttgcactgtaagccacggaactgagtcaatgcgtaactggccctgtccccagcccaggcactttctgaacccaaaatagactcagagggaccgaggcagctgccggccctacaggagcaagggggaggagagcctgggctgtgcacctgcaggagggatcctgccagacccccgtaaaggccaggcccccggaagcagcagtaccagcagtcagtgcggcctgggaggggagctggctgcatgcttcacgcatccccgctggaccagtgcatgagcaccttttgggtaaaaggtgcaagtggtgtgtgcgtgttccaggcagcatgagaaggtttgccctgggtgagcccagctcctgttctcctccacctgttcaatattcacaatttggtgtgattgttactcagctgcagacggcctcctgaacgccattgaccgcacatgcttgttgattctgacataggtgttgaggacctagccacatcgtggaggcccccatgtgggtgtgtgtgctctgcactgatctgggaatgactgcgtgtgccccatcacacggatgctccaggatgtacctcagcagtcccctgccttggggctctcgtgctgctcccaaacctcttctgtcagcacagacgctgcgtttgcatctcggtcctgccccggtgccctggcactggttgtgcagggcaggtaggtgggatggcagcaaactgcggtgggcaccgcgtcgcaccaatgtgcacgtgttcacacacagataggactcggaattgtggagccatcgtattcgtctttcccttttaacaatccccccttgaattgtgaagctgtgctcgcctgcacaggggtgcagaggtccggtgtctccgcgttgatgctgccagcacctcaacagtattatgggatggtccagcagtcgatagaaacttaccaggatattttgcacaattccctgtcctcctggagtattggggatggtgactttaaaatgacagtactcattcatacacttctacattttctttaacttatatttttaataaggatctggaggcatttcagtttctccaaaagaaggatttagaatttgttcaaaggaaaaaaaaacataagaaatagctagtttgttatgattctgatctacttgattttcaagtgaataagatgcagatttgcctcctttgatcccagcaatatgttacaacatagacaatataatttatctagaaggtcagcaaaaaaaaacctgcttataattttcataagtctttagttaagatcatccaggaaaggtgtgaagtaaaaactcagcactgaaggcccaggagagtgtgtgtgtgtgtgtgtgtgggagtgtgtgtgatgggtgtgggtgttgtgtgggcctatgcatgccgtgtgtacctgtgtgtgcatgcacataggtgtgtgcatgtgtgtggtgtatgagtgtgtgatatgggtgtggaatgtttgtgtgcagtgtgagctgtgagtgttctgtgtgtatgcatgtgtatgatgtatgtgtgtgatcctgaatgtaggtataaaggatgtgcatgtgtgatgtggggtgtattgtgtgagagtgtgaagtgtgggtgtttgtgtgcacatgtgatgtaggatgtgagtgttgtgtggtgtgtgcatgcctgtgtgtgtgtgtgcatatgtatgacctatgtaagtggggtgtgtgtgttgtgtggtgtgtgcatgcctgtgtatatatgtgtgcatgcatgtgagtatatatgagtgtgggtgtgcatgttgtgtgagcatgtgcatgcctgtgtgtatatctgtgtgtgtgtgtgtatgtatgatacatgagtgtggggtgtgcatcttgtgtggatgtgtgcatgcctgtatatatgtgtgtgcatgcatgtgcatatgtatgacattgtgtgtgcatgtgtgtgcatatgacatgagcgtagggtgtgcatgtcatgtgggcatgtgcattcctgtgtatatgtgtgtgcatgcatatgtatgacatgtgagcatggatatgtatgttgtgtgagtgtgtgcatggctgtgtgtatatttgtgtgtgcatatgtatgacatgagtgtgggatgtgcatgttgtgggcgtgtgcatgtgtgtgtgcatgtgcatatgtatgagtgtggggtgtgagtgtagtgtgggcatgtgcacacatgtgtatatgtgtgtgggcatgtgtgtatgtgacatgtgagtgtggggtgtgcatgtttgtgtgaatgtgtgtgtgtgcatgtgcatatgtatgatgtgtggggtgtgtgtgtttggatgtgtgcatgaatgtgtatgtgtgtgcatgtacatatgtatgacgtgagggtggatgcgagtgttgtgtggtgtgtgcatgcctgtgtgtgtatgtgtgtgcatctgtgtatgtatgacatgagtgtgggtgtgagtgttgtgtgatgtgtgcatgcctgtgtgtgtgtgcatgtgcgtatgtatgatgtgagtgtgggtgagtgttgtgtggtgtgtgcatgcctgtgtgtgtgcacatgtgcatatgtatgacgtgagtgtgagtgtgggtgtgtgtgttgtttgggtgtgtgcatgcctctgtgtgtgtgcatgtgcatatgtatgatgtgagtgtgggtgagtgttgtgtggtgtgtgcatgcctgtgtacccatgtacatgtatctgcatgcgtgtagtgtgtagtcagtgccaagtggcatccctgagacccaggtctggggagggcttgaaccgtgtggggcacccagagcatccccaaccacagttaccttgagccgagttttgctctgccagacgtgaggggctctagcttgacctctgcacccagtccagttctggggtcacctcggctgacatggagagctagaaagatggggtgtctgtgcccttcagagcccagtcctcccacagcgtgagctccagacaaagcagaaacatcgcagcctgggtgagtgaggagctctgcgctcctggggcacgggaactgttccacttcgttccttatctggattcttaataatcaccattcgtcatgtatttgaatgcatttagttaggaccaagcttttcttcagttcttccagagggtagagttgagaaaattttctcctgcaagtaaaggcctctctctcttgaacacttggcacacattgtcgtttttactttcaagaaaaaaagaatacattgcatccctgcagtttgcaaaacctctgagtaaaattgtaataaaacttacctgcgctcatgcagtcattatccatgaacaggctgccggaagccatgcggaagaatgacggtcaggagacggcgacgatggccctcccggcacaccccatccgtccgtgttcactgtttactgggaggatgtggtctagggccatgagctgaatcacacagctcggtcagccaagagccagagtccaggagaaatcaaacaagccttggaaagagacaccggtggcatatttgcttggttttctttaacttcaaatggattctttcattgtgacagatagttttaatactttaatactaatattcttttaatggcttttgtttaatggttaacattttttatctaaagctaaaaaaaaaccctctgttgtcttacaaatgtatttaaccaatgtataaacttttaacccaatgagccctgagtgaattagaaaataacaatgagagcgatttacatttgctgagcttggcacgggatggtacccagtggccattcgggtgccagcggagcacgcagagcctggtgtctgtggctgcctccctggtccactaacacgagagaggtgggtcttcctgggtgtcccaggcacgagggtgcagcccaacccaaactgacttggccggtgctcaccacactgggacgcccgccacactggggcgcccgccacactggggtgctgagcaagatggcagcctgcgtcacttccctgtagattcccgacatggacaactcgaattaaacctggtcaagtagcagaaagtggctccactgagtccattcatttccctggtgtttgaatcaccatgatgcttcttaggtggaaaacgcctgggacttctccgtggaccccacgctctgtccccggtagacatcgttaaggttcctttctttccttccatctggattttctttgtgtgtgcgctgactcctcgactgtttgcaggcttttcgatgtcagcgtcacaccactgggcctttctgtttccctggaatttaactttcgttagctgctccttcaccttgtcagcaaaattggatttttcaagagagaattctattttaaatgcactagagggagctttctatgcagtggaggctttaaatgaatcctttgacactaagaaaagccttttatcaagtgaagggggacacacgcccaccctatcccaccctacccacccagcaggtgctttatcaatgccaacgttgtgcccctgcccggcctggccacacccatgctcaggagggcacaagagcgggcaggatccagcgcccggcctggccgcacccatgcccaggagggcacgagagcgggcaggatccggcgcccggcctggccgcacccatgcccaggagggcacgagagcgggcaggatccggcgcccggcctggccgcacccatgcccaggagggcacgagagcgggcaggatccggcgcccggcctggccgcacccatgcccaggagggcacgagagcgggcaggatccggcgcccggcctggccgcacccatgcccaggagggcacgagagcgggcaggatccggcgcccggcctggccgcacccatgcccaggagggcacgcgagcgggcaggatccggcgcccggcctggccgcacccatgcccaggagggcacgagagcgggcaggatccggcgcccggcctggccgtacccatgctcaggagggcaccagagcgggcaggatacggcgcccagcctgagcctggctatccagggtctgtcccttatgaaagatctcatgcatgggctctatgaaagcttctgtctccaccacacttgaagtaaggagttagtcttaatcctggcatgcaagaagcaggagccgtccacagcagacagttgattttcctgctacatcattatggacctaatgctggtgctgcacactttttaagcgttaactccgtttcctccgctcttcagttttggtctcgggctcagcgcgactcggaggcacgctcccgtgtcattttgtatttccgcccggttctccccatgttgtctggggatggcccggcaagtctttctccttcccttttttcacttttcctcacaaaccacagcctgagagggagccacgatgtcatgaaataagagagactttatccatcacattttatgtgaggacgacgacgccactctgggagacagccgccagcaacagccatctccagagatcagtgcacgcggagggagagccccttcctcgcccacacctgctacagctcctgacggcttcatggctccggccagaattcgggagggcggttgccagtgagggacagtctcccaggattcccactagcaccatcatacacacagcccttcagatgacattgctgttgacagtcgttttaaaaaagaagtttcagggactgaaagcaagtaccctaaagccacctaacggagagaggctttaactctgtggcccagatgaaccctcaacgtgatgtctcaggagggctgagagctccccgtctcttgagtcagactatttataccacacttgcttctcctgaggttcatgactcctgagacagaaagctgaggggtccccgtagaagccgctgctgtcctcgtgcctggaaggcttcagagaacataactgattggatttcactgtctcccagaagagtttgctcacgagatctgtgaggttgcctgagcatcaaatgtgttttgtaaattacacgtaatcatgcgtcatctcactggaccctcactggaccctggaaacgggaggaaagcccctccagaggtgaggctggcccatccagcttcccggccaggcccagcataggcacgcggagcggaaacccacacctcagcactgtagcccgagcttccccacgtcatgtgacacaactcgacgtctgtcggcaaccccagcactcctgcctttaactcaccttttttggttttgggaaaatttcttaaaagccaatagacatcttacgtttttaattacacaagactggttgtaatacattttgtgtattagaacccggtttccaaacccagcagcgtatggccaaagacaaatagcgtgctctaaacgtgggtgtgaggccccagcacatggagcctccctcatcctgcacctcggcccatcccctccccacgtggtccaggtcagcatctcgctgaggtcagcagttggggtgtgtgaggagttacgagacccagtgttagatggagcctgtacatttccccgtttctgagctattattcacacggccagccgctttgcacgatgacttcccttctaaatgagagggcaggtttccctgtacatagaaatatgtaaaaatacatagaattatttttatcgggaagctatttagttatgttattgttttttacacgtggtaattaaacagcaaacgtcttgccatttcttctggatgatttctaaagagccaatcaagcagaatgtggtgcgtggtggccgtggggtacacggtggctgtggggtgtgtggtcagtgaccacagggtgtgcagtggccatagagtgcatggttcctgtagggtatgtggtggctgtggagtgtgtggtggtcatggggtgtgtgccagctgtgggttgggtgctggctgtggggtgtgtggtggccgtgggttgtgtggtggctgtggggtgcgtggtggctgtgggttgtgtggtggctgtggggtgcgtggtgcccatggggtgcatgctggctgtggggtgtgtggtggctgtggggtgcgtggtgcccatggggtgcgtgctggctgtggggtgtgtggtggctgtgggatgcgtgctggctgtggggtgcgtggtggctgtggggtgcgtgctggctgtggggtgcatggtggctgtgggttgtgtggtggctgtgggttgtgtggtggctgtggggtgtgtggtggctgtggggtgtgtggtggctgtggggtgtgtggtgcccgtggggtgtgtgatggctgtggggtgtgtggggtgcgtggtggctgtgggatgcgtggtggctgtgggttgtgtggtggctgtggggtgtgtgatggctgtggggtgcgtggggtgtgtggtggctgtggggtgtgtggggtgtgtgatagtggggtgtgtggggtgcatgctggctgtgggctgcacagtgtctgtggggtacatggtggccagcggccttcctttgggtgagccccagctggggtctgtgtttagcttgagcctctataccaacttgagatgcttgaaagatgctgtgaattgcagcttatttatccttctgcctacagttgtggtatttttcacatttaaattgcagcacagttctgggttcaatgtgtccagaagccacagctcctaccaaaggtacagtcacgggtgcaacagacaatatgggcatttctgagttgttttggctcaagcacgaatgtttgtgcagtgacactgagactaacctggcgctctccatgcagggacttgactttcataagacaagcttgtctcagagaggccagttcccctgcgtcgtttctgccatgattctgctgtgtaggcaccaactgcaggagtgtccgtgggaggaggaggaggagaggaagcggcttccttggccgccacagtcatggccgcaggaggggtcctttggcttcctcccttcctctctaccatttcacaaactcacccgtttgtgtcaggctgttttaaatttatggatttcttttaaaacaagattgtatttactgtagccttgtcgactttttaggcctttggagacccaaaaggagcaattaagcaaacccgtgcacctgaccccgccttccacccgcgtgagctgccagctagttccctggtggccgagctcacgggctgccgcaaaagaaagccgccttttatgcctgcagaggctctggcttaaaaggtggtggccctcatggtgttccctgcccaggagaatggggtcctttaaccaggggatgggagctggagggacggccagcttagccccgacagtggctcccatcaccacgagccctgttcctgccaggaaatgccagtgtctccatcttctgtgctcaaaggtggggagacccaccagccaggcagggcaggtggggtggtcatctcgcgcccggcctccctggtggagccgctgtggggctgtcctgacagccagattctccacaccacctgctttgttctcccttcatgcaaacatgacatttggttccaacgtgtgtcctccccaggcctccccgccacccctgccgttccctcctagctgcccgcagttctgacttggaggtgcttcgcaggcacctgctgtgacttggaggtgcttcgcaggcacctgctaccctgctgggatgatcctcctggagcctgagcccccactggcttcacagttgccaccccatgaagccacagaaccacagggaaaggaaattgaggaacctcgggaattttaaagcttctctcctgattcgctgggcgaggaatgtggtgtgcactcaggttgcggccggagagaaaggcctggggaccacctgactctgggccacccgggcctcctcaggtcttcggccagcgctgtcctgcccacggtagttggggttccaatggctgcggcttcttcctgtctgtggcttggacatgccattggccgcgtctctatttcctcatctgcgactcgggtgaccacagttctcagttcaccgtgttcggtagaggtgacatgaagtgcctggcacccatgtgggtttccctgtgggattctgacccgcttcggagctgcctcctgctcctcatcccacacttctctgtgtttctcatcctggcggctgtgtcctgtctgcccctctcaactgcaacacgctggagaggtcgggaccctgtcttgctcattatctgtctactaaagaacctagcaaaatggaaaaataacaatatgtgctgaattaattattagcttaaaatttaaaacttaagtagcatgatttgagtgcagccagcatcacctgccgtgagatcggtgctgtctacaggaggatggagcttttggtgaaccactgagctgggagtagctacgggcacctttacccagtcccaaaatgtggaacatttgagtttaaaaagcagaaaactctacagttaaaagccaatattaaggttgagtccattaatctaaattaatctgattttttatttctttaaataaaaaagtaatcctatgcaatcaaagttaaagttcgtatatggctccctatgaggtactacattccctgaagtgtcacaaaaaaaaaaaaaaagaaaagaaagaaaagaaaaccagtacagctttggtttctgacggtgacggcctgctgttggtaagcatcttataacaatttttcagcccagctttctggaattaatgctaatgaaagctgcccctgccttcgtcttctacatgaacactgaaattgcagccgcctgccagccggctgagggatgagcgtaataattttcaattggcctctcagcccagagggaacgtggctagcaggagattgacagatgtggcatggattatcttgtgctctgaactcagcccaatttgtggtttgttgcaggtgctaaagagattgatatcgcagcgaccctggagcacttgagggaccagagacccggcatggtccagacgaaggtactgtcagtctctcctccgggacgcagacccattcaaggtgcctctctgcggccgtgttcctgagaggagcacggggagggcctggtttaatgtgagccgcacaccgattgctctgctctgaccggcctcgtccatgccggccttgcatgggcggggtcacttctgggcccccaaaggtccactggcgtttcctgcaacacctccagatgcagccacatctcaagtcctaggaactcgatccactggctctttccattcactagatttgggggtggggggagaacgctgcatttttgtagaaagaggttgacgataaatcccagaaccctcaggaggatgttctgagctctctgagcgctgcccggcctctccggggcctgcgctttgtggaggcccccagggcacagcatccttgagcacccaaaatccctcatgcttgctgaagaggcccagtttgcagcaacagaggtcaaaacaaaaaaaattctggtgagctttggctcaacaagaactggacgtgaggttgacgtgtgtctggtctctctggccctgaggctggggttggtgtgcctttggcctctctgctccttggtttcatttcgccctctctgtgcaactggtaggaccatcacgtgattttgtgaaagttctttgtaagtcttgggacactatattttattcggtttttgttgttgttgttgtttgtttgttgttgttgttgctttctgagacagagtctcactctgtcacccaggctggagtgcagtggcacgatctcagctcactgcaacctccacctcccaggttaaagcgattctcctgcctcagcctcccaagcaaaaaatataaataaaatgcagaaataatccaccaaccctccaccaagtttccccaaatgtgaacacctcacataaccacagcgcagtgaccaaacccaggaagtcagcaccgatgcaaaccactgaccaacaggcccagcgatgccctacgcgcccccccagggagcttcccctggagcaggacacgcccagggcggccacgcgaggggcatcatggttcctctgctgtccgggacgcttcacggctgtgaggtcttctagagcgccagcggccttgctctttgtggaacgtctcttgtctaggcgtgtcccacgtcccccatggtcagggcagggggcaggactgtccctcacgagggagcggcacatctacacccactgaggcgtgtgtgtctggaggcttctgcgtggctgcgtgatgatttttccctgtgtggttactcagtgtcccgcggggagaagctgggactgtgcacatgtctgtctttccttctgcttgttcacaacagcattcggcatgtgttgcgaggctgtcgagagaggaggtgacacgggacagctgctgttccagcagcaacagccatcaaaacaaaaaagttctcatgagctttggctcaacaggaactggacgtgaggttgacgtgtgtctggcctctctgtaccaaggagttccaggttttgtgccatggaagggtccaaccttggaagggtccatcttgccgcactgaccatcctcctgtactggctgcctagcagtaaaagaggtggccttgtcaaggctggcacataccaccttctggctggccctgcatcccgtgagcttcaggtggctctgaactggacagaggaggccatggaggctgggagaacggggcacacattaccaggaatggtcagcgagagccacctcaggcaggtgtgttcgtgactccacagtgaggcccactctgggataagccccaggaaatctaaattcaaagtagtttcctccccacacctctgcctgcctctcaggcagcctctccctccagacgggtgagttcacccagaacacctgcctgtcaggcagcctcttccctccagacaggtgagtttgcccagaacacacactggctttaggatgggtctgggcaaaatcatcgcaaggggatatctttgccaaaagtgaaaaaaatcacaaggagcaaaccctccaagcctcccattgtatgtatcctgttcgccagaacaagcccttcctggcacacagatggctgaggtgcacaacggtggtcccaggacccttcgtgaagtgaggtgctttgggactcatcagagaaagaggaagccacagtcacaatcattacatgccaggtcttccgttctactccatttttaaatggcaagatggcagcaaagacatggaaccaacgcaaatgcccatcaatgatagactggataaagaaaatgtggcacatatacaccatggaagactatgcagccataaaaaggaatgagatcatgtcctttacagcgacatggatggggctggaagccatcatcctcagcaaacaaacacaggaacagaaaaccaaacactgcctgttcccacttataaatgacagctgaacaatgagaacacatggacactgggaggggaatagcacacactggggcctgtcagtggggaagggggatggggagcatcaggatgatagctaatgcatgcggagcttaattcctcggtgatggattcatgggtgcggcaaaccaccatggcatacgtttacctatgtaacaaagctgcccgtcctgcacatgtatcccagaacttaaatataaataaataaataaatagcaagatgataacacatacacaccccagccctgttgcccagatcacttggtgacccgaagctccgttttctgcactccagataacagagtcagcttcctagctgcttccttcttggactgggcgtccggaggagttcaccctcttcctcagggtgtgtgttcaggagctgtcttggagcatgcacataaattcagctcctggaacttcaaggcataaggaaatggaaccatgcgaaagtcaccatcacatcttaatccgtgactgcgctgcccaacatcgccccgagactaaacttcccctacaagttcagtttcacaaagatagaaaaattatttgggcaaaatgctgctgtccaatctgaatgcttgcttctacgaagccaagaggaggcgcctgcagctcctttgaacggaggaagtcacgtcgcctggtttggaactgaagacaaggaaagagcgagccgtcgagggtgagcacccggagaccatgaccaggatgaccgcaggccctgacagcaaaacatcatcgttgtggtaaaaaagatgcccctcaggagagctgtttcctccctggaatttgggtcgaatagaaaatgtttcaccagcgcccacctgagcatttggcaactcagtccccgaccacaaactccatcatcttagaagagaagtccaggcacccaggggctgaacggcagtgcgggctttgacaccacacgagccgccagagaggcggcacactcagccacacacactgtgtacacccacacacctgcacactgcgcacacccacacgcagccagggacactgcacacccacacacctgcacacacccatgcatacatccacacacacctacacacccactcacgcagtgcacacccacactcagccacacactgcgcatccccatgcacacacccaggcacaccccccacacacacctacacacccacgcatgtggtacacacccacatacagccgtgcacactgctcacacgcacacacctgcacacagtgcacacctacacacagccacggacactgcgcacacccacacattgcacacacacccacagacacccacaaacaccactcagccacacactgcacacacccacacacctgcacacacccatgcatacaccccacacacacctacacacccacccacggggtgcacacccacacacacacccatgcacactgcacacacccacacacctccacaggtgtacacacagtgcacacccacacacagtcatggaccctgcacacccacacacctgcacagctgtgcacacccccacacacatccacacacccacctgtacacacccatgcacacctgcactgctgcacacacccacacacacctacacacccacacacgatgcacatccacacacagctgcatgcacgcacacacacccgcacacattcccgtgtgcacacaccctcagcagacacaagggatgccagacaaggctgaaatcacccctctctcccgtccatgcctctgtggtagatgatgggttcttcccttccttccctccacacgtctcaagagtttcccatttcaccaaggaccttaacactttcctgcccacaatggtgtttcctcttttacatctgtcagttccagaagtagagccagtgatgagtgtgtcccacacccaagaagccccatgccctcctcactggacgggaggccccgccccctcctcactggacgggaggcccctcgcatgtccacgtgctgcccgtgcgtcactctccccaacctgccgtctcacatctgcattttagtttcttccccattttcttctgcaccagccccttgtcctaaagcctgacctcagcctcctcctcagacgtacccggtgttgtcctccgtcccagaagcagggcgttgcccagacatgctcctatcttcccaacccagcacagcaccggagtgacagacacggattctgtcacgcgtagcgcagtccacgctcacacatcagctccaggcccgcagcccacttctcccaaggcctcccgtgccattgaaactgttcatttccgtagctctccatctctctccacctctctccgtctctctccacctctctccgtctctctccgcctctctccgcctctctccatctctctccacctctctccgcctctcttcacctctctccgtctctctccacctctctccgtctctctccacctctctccgtctctctccacctctctctgtctctctccaccgctctccatctctctccacctctctctgtctctctccatctgtctcccatctctctccatctccgtctctgtccctccgccctggtgtacacacacacaatgcctagtccctaacttgggcagggctcaactctcacggtgtggcttggagcttgtctacttttgtgaaaagagaagctgaaggtgacagacacaggaaggtgtgtcatcctcacccccttttgagaggtgctgggggaagctgccccgcagttatgtgtgcagcctcctggagggcacaggtggctcagagacacgatcactgaggtcctctttaaggttcctatttgtacatctccacccaggcctttgtttacacctgaaggattacaaatataaacataagcacaaatagaaatccaagcagcctccacaaagctccacggcttccagccctggctgacccttaccccagcagcgggtgtccgagagccatggcagctcctgcagcctccatccctccaccaactatgtgggcaccccgtggttgtcccaggacagcctgagaaggggcgttcccactcgctgtccagcgtggacccaggggtggtgaccagacagcctgacctggcctgagcctggctcggccgtcccacctcagccacttctccaccgggtgcagttctactggaagaagccgtgggatctttctccaacaggcctcaaattttattgtagtatgtgttcaaaaatgctttcttgcttagaatgtcctgactcggcctctcgaatgtcctgtctttgcaaacccaggaggctttgcacccctcctgttcagactgctggcactcagatgcagtttaggctaagatggtcatctggtcatctgttgctgttgtattttactcctttgaaataaactcctatcataaaagttatccaaatgctggggttttcccagcctacccgggatctagagcatggttctaggtgatacttgctcagcggattctgctcagaacgtggccacagaccttcgaggacccacagggcttgggtgctacatcccggcgccgcatgcagctgacacttcacgataaaggacaagatgatccacaagcccctgtcccctcaaacgccagctctgaggctcacagcacccctccgggaagcaccccctcctcctgccagccgacgcccacagggcccagtgggctctgagtaaggtgcacggcacacaccagcccacacgcccggtggagcttctcctttgagctaaacagtgcggtaacaattgccaaacatggccagtgagtagagcacctgtctctgtggcccggttcccttcctgctgctctgtccggtgactgtgcagtgttggaaacagttatgatccagaccctggtggagttccccctgcccgtcccctcccccatagcatggatattgggctttcctgttggatgccgcaagtggctgcctgagaggccgctgggcagctctgcaggattagcactggccctgggggtggagcgctttccagcctccactgcatgatggggctgcggggcggcagcgcttctctattcttccctttaaagatcatttctcaggctagatttccagtgtgtcggaagatgtaaatagatagatgacacttgcatttcgcttcccaaaaagccacgcttaatttttggcatctccaagccctcacagagcctcagggcactggcagcccagcactggggaagaaatggtctgaatggctgttgtgtatttagcctggatcccctaaacagcaccttcatcgaacacacttggtgtgggaggggcaggagtcagcatttagacagaacgtttgcggaccttcccggcacagcccgacctgagcccctgcccccacaggggcagctcccacgtaatttcgaggagcagaaaggtgccctctggcagtgcagaggggagagagacggggcgcaggcagacacatctccccgggtcccaccctgaggtggccgccaggctcagttgactcctttaataataggttctaacacgtacactaagaggccgcgtggccacactaccaaaggcaggtagagtccagcagaccattccgtcagcatcagggcagaagaatatgaaaggagaaactgtcttttgtctcagaatgagcatcacgttattttgactttctgatgtctcggttcaagctattttccatctttctgttatgcactaaacattcaaaactggaaattaatcatcgtttttggcttggggctgccctgttccttaaatgatcaagtattggagctgtcaacagggctttccttccagaagttgttagctgggtaacagtgttgtttccgtccacgcgttctcagctgtagctggagtgctgctggcctgctttggagttttccatagcagtgttttgaggtggaaactgaagagcaagaggaaatgagcatttatccacctcatctgtgggagaggaggcagatacgctctccggcgctaagccctggtctttggaggagcgaatagtcctggcatcgtgaacccgtccctcgtgcccactggatgctctcggcaggctgtccgtggagggaggggtgcccctcaggtgtgcctgcccaagtggctgtggacgcgcatgccctgagccaggaggggtgtggacaaggggaggtttctcagcatgtggaacggagtgggtttggtctgagtaacaggtggatttcaaaagcgatgataacaccacacttccgaggacaggaaacgcccaagcatggccctcattgtgagttttaatggccacgtctttgtagtgtctgcacctgcccctcacaccgtccaccaaggcgggtggctgtgaggaggaatcgtggagtcgtagggtcagaaggacagggcagtacgcaggaaccgttgccttctcgctgcttctgtgggcagcttctccccgcagggggaaagatgaggcttttctagtgcgagagaagctcaaacatgtgtcactgttgtgtctcccaaaccgaagggtacactgtcctttctaaggaaatctgagccttttgcttttttttgctaaacaatttctttctgcgaaatggcccggggagctgatgctgcgttgggaaggggggacgccgctttcatctgcagggagccgacgctgtggcaggagtcggggggacgccgctctcattggcacttctctcgtttctcgccctgcaggagcagtttgagttcgcgctgacagccgtggctgaggaggtgaacgccatcctcaaggcccttccccagtgagcggcagcctcaggggcctcaggggagcccccaccccacggatgttgtcaggaatcatgatctgactttaattgtgtgtcttctattataactgcatagtaatagggcccttagctctcccgtagtcagcgcagtttagcagttaaaagtgtatttttgtttaatcaaacaataataaagagagatttgtggaaaaatccagttacgggtggaggggaatcggttcatcaattttcacttgcttaaaaaaaatactttttcttaaagcacccgttcaccttcttggttgaagttgtgttaacaatgcagtagccagcacgttcgaggcggtttccaggaagagtgtgcttgtcatctgccactttcgggagggtggatccactgtgcaggagtggccggggaagctggcagcactcagtgaggccgcccggcacacaaggcacgtttggcatttctctttgagagagtttatcattgggagaagccgcagggacagaactgaacgtcctgcagcttcggggcaagtgagacaatcacagctcctcgctgcgtctccatcaacactgcgccgggtaccatggacggccccgtcagccacacctgtcagcccaagcagagtgattcaggggctccccgggggcagacacctgtgcaccccatgagtagtgcccacttgaggctggcactcccctgacctcacctttgcaaagttacagatgcaccccaacattgagatgtgtttttaatgttaaaatattgatttctacgttatgaaaacagatgcccccgtgaatgcttacctgtgagataaccacaaccaggaagaacaaatctgggcattgagcaagctatgagggtccccgggagcacacgaaccctgccaggcccccgctggctcctccaggcacgtcccggacctgtggggccccagagaggggacatttccctcctgggagagaaggagatcagggcaactcggagagggctgcgagcatttccctcccgggagaggagatcagggcgacctgcacgcactgcgtagagcctggaagggaagtgagaaaccagccgaccggccctgcccctcttcccgggatcacttaatgaaccacgtgttttgacatcatgtaaacctaagcacgtagagatgattcggatttgacaaaataacatttgagtatccgattcgccatcaccccctaccccagaaataggacaattcacttcattgaccaagatgatcacatggaaggcggcacagaggcagctgtgtgggctgcagatttcctgtgtggggttcagcgtagaaaacgcacctccatcccgcccttcccacagcattcctccatcttagatagatggtactctccaaaggccctaccagagggaacacggcctactgagcggacagaatgatgccaaaatattgcttatgtctctacatggtattgtaatgaatatctgctttaatatagctatcatttcttttccaaaattacttctctctatctggaatttaattaatcgaaatgaatttatctgaatataggaagcatatgcctacttgtaatttctaactccttatgtttgaagagaaacctccggtgtgagatatacaaatatatttaattgtgtcatattaaacttctgatttcac

SEQ ID NO: 36315 - DNA, 34649 bp, Homo sapiens
cccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgaggtaggtgtcgccgcccgctgtaccggtacggacgccgaagcccgcgggcgtgcaggggcccggccccgggcggtgtgtgacacagtggggccagggccccgaggcttccgcggacctgggcctgcccaggcggggatgtccgctgccgctaccgctgcgccggtgacggaaggcgcctgcccagcctaccctcgccgagcttctggagcgcatttcttgacctaaaagtttttttaaagccggcaccgcagttaaaaatgcttcggcggggggccgggcccggtgtctcgcgcctgtaatcccagcacttagggaggtcaaagcgggtggatcaccagaggtcaggagttcgagaccagcctggccaacatggcaaaacctcatctctgctaaaagtacaaaaattagccgggcgtggtggcggacacctgtaatcccagcactttgggaggccgagatgggtggatcacttgaggtcaggagttcgagaccagcctgcccaacatggcgaaatcccatctctactaaaaatacaaaaactagccaggtgtggtggtgcgcgcctgtagtcccagctactcaggaggctaaggcaggagaatcgcatgcccccaggagacggaggttgcagtgagccgagatcgcgccaccgcactccacactccagcctgggcgacagaggtagaccctatctaaaaaaaaaaaaaaatgcttcggggccagtggggtagtctaggttaaagacccgagcctatttggagagaagagtggaggggactgcggccaactgcagagcgagcgccagcccctgtggcaggtggggatgcagcctggggcagccaggtcttcccattgcgagagaaacagggttcatcagctttctaggaataagatctgcggttctcaattgatttttctctgtaaaatgaggggggtgggttggatatgtttgattctaggaatggtgtgagctgcgctaataggctgcttctgtttaagcagggtaacatctgataaatcagtgatccttcatcagtacgagatggcgtgccctaaaggtccccaggagcccagattgcccataatcgtgttctgtgatttcggtctttcctgggagtctcttgtctacccagccatgtcatggatattaaagtaatacttacacatcagcgctccacatctgatggggcagcttgaaatggcctctttgggtcgcacaactgcaaaaacatgttcctgtaatggagaagagaggaagctgtcaaaaaagacccatcaaaaggctaagattagaaaaaagactcagaaagaccatgtgaacatatcaacagagttgcactgagataccatagccaattttttttcctgtttctttatactttttttatggtggtaaaagatacataacatacattttaccatcttaactatttttaaagatacagttcagtggcatgaagtgcattcacattgtgcaaccatcaccaccactatccattggcagaactcttttcatctagcaaaattgaaactgtagttaaacaactcccttattttccctccatgacctttctactttccatctttattaatttgactattctagaaacctcatgtaagtggagtaacacaatattcttccttttgtgactatttcattcagcatgatgtcttcaaagtttatcccatgctgtagcatgcattaggatttccttccttgttaaggctgaataatactccattgcatgtatagaccacattttgtttatctacttatctgtcggtaaacattttggttacttctacattttagctgttgtaaataatgttgctatgaacatgagtatcaaatatctgttcgagtccctgctttcaattctttggggtatatatgtagcaggggaattgctagatcatatggtaattctatgtttatttttttgaggaactatacttttttgtagtttgcaaatctttcacagtaaacaggatcacttttgtaagacaagtaggggaaaaagccttactttatgccctcagattagttcccagtgttgagctcatggtcaaagtgtgaattagaatagtgaatgtgaaagtaaatacagtactgaccctagggaactgaactcagcaggtagtagattgcttaccactcgttcagtgttcatctttagctcagaatttatcttaatgaggcagagggatggtagcaagtggttaggagactgagcatgggcttcagaccaggatccaaattccatctctcccacttactgtgctgtgtgacctgggacaagttactcaaacctcccagggacttggtttcacctcctgcaaataaggctaacaccacctaccttgcaggtttaagtgaggattgcagtcttgcatgtaaaatgcttagcccagtgtgatagttacttttacatgtcatcttgactggatcacggatgcccagatatctggttaaacattatttcttggtgtgtctgtgaagttgttttcagaaaagatgagcatttgaatggatagactgagtaaagtggattgccctccccaaagtaggtgggcagcatccagtctgttgagggcctaaatagaacaaaaagccaaagaaggaagaatgtgtcctgtctcctcctgcatgcttgatctgggatatcttctgcccttggtgctcctggtgctgaggccttcacactcaggctggaacctacacccttggctctcaggccttcaggctacaacaccagccttcctgctaacaagtctccagcttgcagacagcagatcatgggacttctcagcctccataactgcatgagctaataccttataacaaatccctttctagatgtaaatatatgccattggttctgtttctctgaagaactctaatacacccagtaattaacatgagtaaatgctcagtaaaagggtgactgttgttattgctgatacccagaacaccatgacatagaaggtacgggtttgaggtttggttctttcttaccagtaaggtgcccttattccagtcattttttttttcttttctttttcatcaatgattgatgaacataagtatgagggtaaaatggcagagcaagcattagactgtaaatctagagacaggttgagccctctttttaccagtgccgaggtgagtttcatgttggaagcttcaggagcagcttcatttctgctggggcttctcccgcctttttccccctcaatgggaaataacaggtttcgttattttcattggaaaaaaaggcagaggaaaccccagacactgcacggtttttaggccctagcctcaccagtctcaagcctcctatcaaggagggccatatagtgcctctgatctgcttgatgcagaccctagggtccttcccactcccatgagccacccaccagagtgagctaagaaatcaactggcagagagcagagtcacgtatggccaagaggaattgttctgggggttgtttagtaagcaggagagagggaggagaagaaaaactgcacagggatcagatgcctccagcagaagaaagcgaggcatagagatcccttaccatctgagtcacgtggcaccaaatatgttaccagtggcaaatcagtagacacctgcagcaacctcaatcttgtctcctcagaagaaaattcaactgggggcataaggcagaaaaagtgaccgaggcaagcttcagagcaggagtggaagtttattttaaaaaactttaggccgggtgcagtggctcacacctgtaatctcaacactttgggaagccaaggcagccggatcacgaggttaagagatggagaccatcctggccaacatgctgaaaccccatctctactaaaatacaaaaattagctgggcatggtggcgcatgcctgtagtcccagctactcaggaggctgaggcaggagaatcgcttgaacccgggaggcggaggttgcagtgagttgagattgcaccactgcactccagcctgggcgacagagcaggactgcatctcaaaaaacaacaacaaaaaactttagaacaggaaagaaagtagagtatgcttgggagagacctaagcaggcaacttgaaggacaagtgctccattttactttaaggaaaattaatcattctttctgtttcaaagatgctgggtaaaattgaaattgttgttttcccacaaggtgagcaaataatgagcatctactacaggaaagaaagtccatcaaaaaagccaacaatggagaggctcacagcccctttccaatgtacaggaatctgaaactgagactgaggcaagagcagcctagaccagaacccagacactggccctcctgtgcaaacaccctctactccaccaagcctcttcctaaagcccaaggtggcgacatgttaacctatctgtgcacgcttctcaattgatttctttcccaatcagcctgataatatgtgactctagcacagcaaagaatcatcaacaacagaaccttttaattttatattattattattattattattatttagacaagatccttctctgtcacccaggctggagtgcagtggcacgattatagcccacagcaaccttgaactcctgggctcaagtgattctcccacctcagcctcctgcgtagttaggactacagggatgcgccactatgcccggctccttgttaacaacttttaaaatttttgtagaaatggggtctcgctatgttgtccaggctgatcttggactcctgctctcaagcaatcctcctgcctcagcctgccaaagtgctgagattaccaggcatgaaccactgtcctggcctaattttatattagaaatgctttcagtgtttgggaatgattgtatacaggattaaaaaagaagacaaatgctttcagtgacgtcagataaaggataagggtagtagttggatttttatttgcaacacatctcagggagctctttattatccagaagcctaaacttcatgccagcatcggttttattacctaagagaaccacagattagaacccaggagaaatattttctctgtttacaatgggtagattgatttttctttggggtgtttgcataactaaactaagcactttgtactacagtgatactttatatttttatacctctatttttcccaaacattttcgtattcaaagtgtatgtgaggcataatatagcgtagggggttaaaagcacagactttggagccagactggttgggtgtgaatcccagctctgccacgtagcaattctgagactttggatgagtgtcatcctctgtacacctcagcttcttcctaagcctcgtaggtggacttaatgcatgtgaagctcttagaatagtgcctgggaggcagtaagttcaatagatctgttcgctgtttttatcttctttgagtcactcagcaaccctaaggcttggtagggcagaggttattcccatttaacatgggaaaaaacaagatcacaccatggttaagtcataaagctgagaccagagctcaggtccgttggcccttagtcctgtgcttattctgtgacaccatacttccttccttatattatcaccttagagaagggagaaggtaaaagggcaagcagaaatgaggaaaagagaggagaaatacatctataaggctgggtgcagtggctcactcctgtaatcccagcattttgggaggccgaggcaggtagatcacctgagctcaggagttcgagactagcctgggcaacatggtgaaaccctgcctctaaaaaaaaaaaaaaaaaaaaaaaaaatacatctataaacaagaagcttcccgttgctattaagataagagccacattccctaatatgacccaacgagacccaaaagaattctagtgtgagcatctttatgttaatctttggacacatttatcagtattgctttagtattcttagaagtgaaattacaggaagaaagaagatgaagtatataaagcttttgatgtcaacaaatcgttttccatgttgttagactctcttatgatacttgacgtttagaaaacatcatttaataagtagaagagtcaatataattatttcccaaagtgcttatgagctacttagcatatttatcttgaaatggaaaagctatttatctccttaaaacataagataccaatttctctgtttgttgttgatacaaccctaaatttacatcagttctctttccggaaccataaacgtttggcataggacacttggctttcactaatggtttcatctgtctttccaagtgatatcaactgctaacatgctctttcttggccttatcagtgacaggggtcttcagaaagaacaagcccattagtgctaagtcatggtgtaggagggataggtctcttccacaagcatttgattgccttcttcttgtgtaccgtccccatcggaaattgcttaggaagagtctttgagatctaattaagatctgtttccttgctctgtcgcagtgccctataaggactgccaggcaataatgaaggttcttttactgaaggatgcgaaggaagatgactgtggccaggatccgtatatcagggtaagtggcctgagactccttatcccacagtgtcctttctactgagtcaaggggcctggagcaggcagggatgggttttgcaaaacctcagaggaactgacgcagaataaattgttaatgttcccttattttaaaaacagccctagccaatccagaactatattctttcatttcaggaattaggattatatggacttgaagccactttgatccctgttttatcgtttgagtttttgtctcttcccagtttctctgagaaggtaaggcctgttgtgactgagcaccatgttagtgtttgatttctcccttgccagctgaagccagagagggactattttactgtcttcttattttattcccaaactttaaaacatggcagcataacttcacctggctccaggaggctgctgctgttgggaggttctgactgagcctctatcagcccctccagaaagccacccagactcagagattggggcccaggagagcaggtcatggtgagagcagcaaacctgcattgctctcagcagtcctagaaccctttcactcatcctctcatttaatctacccctcacccccaacttctgcaaagcaggccagggaggtattattttcccgttttagagattggggtctcaaattaggcaactcagctaagacctctagcaagtaagagacagggctgggactcaaacccagggcttctgcccacaacttcagttcttcttccagtgaggagtgataaaaattgcaggagacaagtccagtaaagccttccaaatgcttcagagtgaaaattcagtgcccacagcttcagtgaagtcagatatgtacagcagcctagtgcctggctcagagtaaatgttcggtagatgatatcaccattatcctctttgaaaatcaggacttcagcattgatatcaccccctgaatattcccatttttattacagattcgggtcaagtcttcccccactacctgcaccccactctaatcccaggctgcgtcaggcttcccctctgtgctgcagtgcacttatcaccctgtgtttcactgtctctgccctagactctgagcttcctgagggaaatactgggaataaggaattcacctgtgtaccctaaaagtcctagaataaatagttccaggcacatagtaagcactcagtaagtgttggggggatgggtggaaggaattagtttgcctactactattgtgaagcatttggaattctgagtcttagctccttggaagatgttgaacatagccatcgtataaaatgtctttattgctttttggtgtgcagctttctcatcctgaagattacgggggactcatttttaccagccccagagcagtggaagcagcagagttatgtttggagcaaaacaataaaactgaaggtgagggtgggtctgctgtggattccactggacatttatttactcttatttctcctgctgggagactaaattccagaagcagctgcacttctaagagaagtgagtgcttagtggtatcaggtcacagactctgccttgggaaacaggagaacagggctatctcctaaactcccagacagatgaccctgaggaggactttcccctgtctattcgttgttcacctcctagggactgatatatccccttagaaggtatcatctgaaaataggataaatactactttcctgaaagagagatgatgaaaaaatctaactatgagaaaatggtcagtgccaccatgtcaggcacttagtgacccagtcacctctttgacttgtcttcccacctccgtccctcactattagaacagtatgaaaatggcagtgcccattaacagaaccctgggtttcagcctgagcaaacaccttaataaatgcaattgaacagcttcctagctaacaattatggagtgcctgttgtatgtcagaccctgtgtaatgaatacttcacgttcattaccccacttaaccctagataacaatccagaggcacacattgctatgatcttatgtcttatgttaccattgagaaaactgaggccaggatagtaagcacagaacaagtcagtgcagagccaggcctcacactcgggccacccacctccacagttacactgatgagcggaggcagcgggcagagtggttatgcaagggctttggagtgagttagtcctgggtttatgcagccatttggacattaatgagttccttgacctctcatcatgggattactactaatagtaatgggattatctactaacagtagactattagttaggtagaacttactgaatgctcactctgtgcgagactctgtcctgaatactttttcctgtgagatagatgtgcttagtattttcacttggcagatgaggaccctggagaacaaagggtatggaactttccaggcccccacaatgtgtaaagcacaagtgcaggattcaagctgcagagtctgagtcccaaaggaaagcatccaggacattacctggagcagagtgggcatggagtaagtgacagtggtgagttttggttattctgtctccacatttaaccaggcttcgctgtagcctaaacatcccaccttcttggtgatttcatacacacattcacctcttgttgaaaagaaagcgtgagaacctaagaaactcagagccagccaggcgcagtggctcatgcctgtaatcccagcactttgggaggccaaggtgggcagatcacttgaggtcaggagttccagaccagcctggccaacatggtgaaaccccatctctaccaaaaaatacgaaagttagctgggcgtggtggcacatgcctggagtcccagctactcaggaggctgaggcacgagaaccacttgaactcaggaggcagaggttgtatgagccgcgattgtgccattatacgctagatggggaagcatgtgtactctttcccagtggtgctctgggtgctttttcttgcagttgtattttttctttttgtgtatgttttgaggatgaagataatgaaaaagaggaaaaccctagaaaggtcactataactctttctggtgctttataataaagtttaaaatgcattttcccatgtattttcttattttgattctcacaacaaccatagggaataagcagtaggagtgtagttaatcccagttaccttgatgaagaaacagacgaggtgcgttaactgacttacctgggacacacacgttaaggggcagagctggctctgtggaaggctttctgactccacccagtgctcactccagttgttctgctgtgaggcttggaaagtagtttgtttacatgctatggataacttttgaataaatactattgatatttatggggtaggaagcaaagtggaactcaatctttggttaccatttcaaagggaatttcccttaatgtaaagggtagaggaatgctcttgaatttaagggaaagttatgttcataaccagattttggaaaggaagaaccattatttccctgttttctaaaaatgtaatgaatgcccagtagctttatgatatatttatacaatccattttctctttgtgtttctttaatctatatttaaagattttgtttgatcataaaatgataatattctgtatcaaattgtgtttgttaattgacctgaaatttattatttttactttggtgtaatggataaatgaaccctctcctctgagattacagtttgttgactgctttcagatttatgtcccaaataaaccaattggatttccttgttagacatttaagttgctttttttaaatgaccagtgtctttttctttaaaagtctagatttaaatttttgatttcactatgcagattaattcttcaagttatgttgatttcgtggttcccattaaaattcttctagtaccaactgtggagataggctaatatttcaagcaaggagtactaaaacatttatgaaagcaattttttaaaaattgcctataaaacatgaacaaagtgaaaatggaattttagtttgagatgctgttttttacatttggttgctaatagtttgctttgctcacagtttcttagggtgaacaagcagccttgggcaacagtccaaatggccactttggtatttgcaattcacatatcatttcatgttttacagtctgggaaaggtctctgaaagaaaaatggaatgccaagtcagtgtatgtggttggaaatgctactgcttctctaggtaaggagtcaaggtaaaaataaaacaacaaaaaatggcttagccttttcagttttaaaaaacagtttaactcagtttaaaaatattattttttgcttattaaatttgcaaaaattaattaagtatacgatactactgataagaatgcagtgaaacaaatataatcaaacatttccaaatggcattaaaaattggtttacatcttttgagaaccacttggtcagtatgtatgcaaaagctttattaaaatgtttgtaccctttggctgactaattccattgtgaatgtacataatgccactgaattatgcacttagtgattaaaatgacaaattttatgttatatttttactataatttttttaaaagcctaaatctccagatagtgatatcatagttgtttttttttggttttcttaatattttgtgcatttttccagtcttgagtctatttattcttcttaaagcataaaatgtaaatagtaatcattaaaaattaacattgagcattttaaatacttaaaacaatgcttagcaattgtcataaattagcctgtaactttgtttcagaacagttcaatttgtccagtgaatttgaaaatattagaggaatgtataatatgagtgaaaatagtttaagaattaaaagcacattttccagagaacaaaatgaggctggggaagaaaccagttgggagttgctaagctaattaaaagatgattcctagatcttctgagcagcatgacttttaccacaagctcagcagatcagccagggaaagggaattagtggcttggttgccaaggaaaccatcttccctcccgcacatctctctccaaaaataagttaagaatttgcttgttactttcttttatcattttttcctgaatgagaagaggaaagaaaatagccagtttctttcattctctatatttcctaccaaaaactcaactatcaaatatacagtatatttatacattttccaaactttcacacattcactgataagcaaacattttgagcatcacatccccttcagtttgatttcggtagcatcactatgcattttgctgtcactgtcctgtcatatgagaagaaaatgagaaaaaagactatggtgatacaatgaatgatgagcatctatgtcttgagacttagagtggctgagagtggaccatatcaagtgcagcacaagcagcagggccttggtctcagttaggcactcactggactcagtctggtccctgtttattcagttgtgaaggaaaaggacatgttctaaatgcagggaacatattatcaaaggagagaggaaattagaagtgttgtaacttttaaaaatgtctttgaaaggaaaccacatttttccttgacatgaaagtcaatcacccaactttgaacattctattttagctcaccttttcagatataataatgtacaaaggagctcttttgagtaggtacagggacaaggcattgcttgaactctctgaggtttctgttcaactagaatctcagcaggagcctggagagttatcagaagttgagcaccaacagctgggaggagaccaggcccaatgtattatctttgctgcgtaacaaattacccccaaattaccccaaaacttactagctagaaacaggcatttatcatctcaatgtttctgtgggccagaatctgggcatgatttagtgggcttctctgtaaccaggccatggtcaagctggtggtcagggctacagacattttgaggcttgacttaggggagggtctgcttccaaaatcactcacatagctgtcagtggcctcagaagatctgcttcccagctcactcacatgggcctcccgagagggctacctaagacatggcagctggcgtcccctgtcgcaaggcaatccaagagagagcaaaagagagcacctaccactgaagccacagtctttttataacctaatcttggaagtggcatccatttcttctgccatttcttttggcttgaatcaagtaagtccagcccacactcaagcggagggatgacacaggggcatggatcacagggatcattaggagccactttccactgcccacaagccctctagtcaagagccacccctggctccctagagcctgggaatcaggttaggaaagttggacatttgaagcaaagagaagacaaggtagacatttttcttgaagtagaaatgaaaacaagggtccagtgaatagcaagggatttcggtgtggaagtccagtgagagaagatgccagtatttctttataaatgttgcacgctgacataattttacaggtattattgattaataatagatggcaaaaagtacatgctggctgggtgcagtggctcacacctgtaatcctaacactttgggaggcagaagcaggcagatcacttgaacttaagagttcaagatcagcctgggcaacatggtgaaaccctgtctctatttatttgaaaataaatttttttcaaaagtacatgctatgtaacattatacagaaagtcctcacttaacattgttgataggttcttggaaactgccacttcaagtgaaatgatatataatgaaacaaatttttttttccttatcaatgttgtaatgaaaacatgttgaatgaaacgatgttattcaaggacctgctgtatgtcgtttcacttacagtggcaatttccaagaatctattgttgacattaagtgaggacttactgtacttggtctacataaaatctcctgagaacattatttggttcaataatatatgcatattttaataacattttaatttttattgaaaaagcaaagatggttggcttgtggtttgataccttgcaactcagccagccatatcctaggaaagccttccatttggctgcccaaaggtcaggtgccccaactttcccatctgattgcaaagttggacctgggcgccatttagtaggcactgttgcttggccttgtaaacccagaccagtgatgtcacagaagatagcttagcaattaacaacttggaattcataacacagaaagactgtaccagcctgggcaacatggtgaaatctcttctctaccagaaataacaaaaattagccaaacttggtagtacattcttatagtccctttaactgtggcagtcagtgtcttaacctctcaaatataaaaaatactctctggcaggtttatttaacacagttggagacaatttgaagtttcactgtcagcttttacttgggcagggcccttaagatgggcttacccagccagagtgttggttgaaatgttgtactgacttgaagcagagtcagtcttgccacatgcagggactgagaccttagaccaaatatgcattccccaaacatttcttgagagccatctgtggactgtggggtggaccgggtagccccagtctctgccctcacaaatagagctggccactgcttaatagcttccttccctctcaagtacagtagtaattgttctgttcacagggttgtggtgtgaggatcaaatgagcaagtgcttactttgtgatcagcaaagctatatatgagagttaatgttctggttatggttattattgtttcattacttgggaaaaatgcatatttatgtcaatattgattaccagcgtcactgctaagttcttatgtctcagttcagttcctgtgggatttttacaggtttttttgtttacttttgtttttgatgcgtttagctcttctaagctcagacaggaggtccagcctcggttgccactgtagcataagcaagggcttagttcctgaactgagttacagctttatttttcttttgattcagcatgtttttaatgatccataagttaaaagctgctggtgtttttattaaagctgccatttgttactaaccaggctctgtgtgactcctaagtggaaagcccacagcacttccttcctcagaggcattccacattcctgtgagcaggtagcagtgttgactgagccagtcccttaggcctcccttcatcagcacgctttgtggagtggccaagtgtttgctgtctggaaaagtgcagggggagcctgagtctgttagcttcttacttggttcatgaatagggatctcacaaaagtgctggtatagcccctcatcctaaatgacttgtatttgtagcgctgtgggtccctgttagcagattattatgaaacctttcctccccttccttccattttagtctggccatgtcaagccataacacctttctggatgtggtctggccacatcctcccaaaaaaatgaaggctctgtaatgccgattcctgcaaaaagtaccaaatgcccatcatctccttcctgactgaagagaaaacagcctttgttgagcaccttctagatggcaagcactttgctcttattatctgacacgatccttaaaacagttccatgtggttggtttttccccctcttgtagatgagctatgtggggctcagggaagctagttaaggccttacttacccagcctacacaactggggtgcaggtaccaggacctgatgctttctcttctgaacagacacttgtgatcttccctcagtagctttcaagaaaagacatcctctatgtgatttgtaaactgcatacctgtgtatttgcacgttaaaaaataacgctggaacaaaaggacttcaataaccgtgttaagaaatacatttctttgtggttttccagtgagtaaaattggcctggatacagaaggagaaacctgtggaaatgcagaaaagcttgcagaatatatttgttccagtaagtagaaaaacatcactccaaatgaagccatttattttttgttgacctcacaaccactacctagggaaaagaatatttcctcagtgcattcttggtggtgagattgattggtgagcatcgtataacccactctgggagcatagcctatttgtatttgtgtatgtctatactttgtgaggtttagcccacttccttctaccccctgtaccaaagaacttgacttgaacataacacaaaataaaacatttgggagataaaaacagtggagagatcacttgagggattccaaagagagcagaggcaggaggtgtgagtgggtactctccccttactgaggactgtcctttcccttctcaggagctacttctgtctctgaattccctctcccagcttgctcccaggtaaagaactgactcatgattgggctgcctgtggacttggatttaaagtggcacttgttctaggggtgttagcatttaaatggggacttagtcttaaactaattatggaattgtaggcttcagaagatacataggcaaaaattcttggagcaagagggatgggaaggctgaccgtctacttgtagggcagccccacctctaaggtgcatctcccttcctctctgttccctgaatgtccagtacaaccgcaagctcttacacccttgtcatttgactcctctgctgtaggtgtaagatcatacacccccatgagagcatgaagtagaactatcttatcttagattgctgaagaggaggaaatccaggctttcctagagatcatgagctggcaaacttcatctgttaaggatattttgggctttgcaggcaaatggtctgtcagaactactaatctctgcaacagaagcatgagagcagccataggaaataaacaaacaatgggcttggctttgaccccaggctagagttttctgacccctttctaaaattgcttgagtgtctgctgagctgggaggccagggtcagatgaactgctgacagctgagagtttcctctaaggtggtcccaggagaggggtatatgccttggcccttgggtggtgagatcaggatgagtggtatagggagagagtataccttaaataggtctctttatggcttctgaaacagtgatagatggttttgtttctggtaaaacaaagtatttatgttatttaaaaaaaatactcctaaaggtgatgttggcctttcttgacgtgcaaacttgtacactaacgtcttataaggcattacttacaagtcttcctgccgtaagtcattgctgttgcctgaaggttctctagcttatatttttctttgtgttactgggagcttgttctagagaaagtcctgcgtctttttctacactgtggtctgaggatccctggagcttaattaggcccctgacagagtcgtctgggttgggggcggcagtgagcagtcagggaacagcagagatactgctgggctcagtggatcctttccaagttctccaattctccttttttctcttttctaatttcttttaaaaataacttcgttgtacctttcctgagtcactacatgctcggtgttaacgttgaagactagcatttactgagtgcccagcgtgtctcgggtacatagacacgtggcctgtatgatgtcatttaatcttcaccatcaccccatgaagtcagaatcgtgtccactgcaagctgtgctggccagtacagtagccactagccacatacggctatttaaatgtaaatgtaaattaattgaaattaaatacaattgaaaatttagttcttcagtcacactgggcacatttcacaagctcacttgtcactgtggccagtggcaccaaattggaccacacagaacattcccatcatcaccaaaagttctttctgactgtgctgctatagagactcttgggggtccaaggcccagatcttgtccaaggtcacaagctatgaagtggcaggctggaattcacactcagcacagcaaggccactgctcatcccatggcctgtcacattcagaggcctgactggcatctgctccatgccgacctgctctcaaggagatgctggccaagcacctccatccactctgatttacagtgactggggctcctgcagggatgaagacgtaagtgtgcttgactctgtgtttgaatctggtgggcagaggcttaaggagcctccggtttagaggaactacacgggccttttctggccactcagatgaataagctgtagtcccagagtgtttcggccacttggcaatcctgagcctgtgcactccttagttcagtggatgtgcgttcatcggctcggacatggctttcaggtattaatgcattgactgacgcctctcttgccccaccccccatattgcttcccacatcacaggagaacaagtcagttcaatatggttcggcagatgtttacccaggagcacctgtgtgccaggccctttgcagggcgttgggactgaagaggagtttaactccattcctgtcttctggaagttcccagcctagctggggctggaggtggggtagggtggggaacatatacatcagtaaccgtgataaggcagggtggattaagtgaccagaagaggtatgaacagtttttgtatggtgggcctgctattaagatacctgtttctacctgtaaaacactcaggataccaaataggtggggtttttcctcatatcaatgaccaattctccaatgctccagataacagctgggtgtcctacaacttaattttgacattacccagaattaacccagaccccacagctttaagggctcagtcttagcaaactgtcccccactttagatacaagtattggatgctgagggacctctgtccaagttggctacaagtcaggagttctcacgactccctactcaggttcagtaatttgctagaatggctcacagaactcagggaaacacttatgtgtactgatttttataaaggagataacaaggacacagataaacagccagatgaagaggtctggaagggtcctgagtacacaggagcttcttcccccatggagttggggtgcgccaccctcctggcacatggatgtgttcaccaacccagaagctctataaactcatagttgaggggttttatggaggttccattatgtaggcaccattgattaaatcattgacccctggtgactagctccatctccaaccctttgatcacatggttgtgatcctctgtgtggccttcagcccccatcctgaagctttctaggggccaccaccagtcacctcattagcataaactccagtatggttaaaaggggtttatcatgaataacaaaagatgctcctctcacctctaatgggaagttccaagagtttcagaagctctgtgcctggaacagggaggaaaacgaaatatttcctcttgtatcacagtgtcatgtcagggtgtccaaaagaaggcagaggtcttcaggaaagtctgtacaaaaggcatggcctcctctccacagagaagggcaggccctccctcaggcagtagccatggccaagccctcccactcagagggagccactgagcagagacgtggaaggagagggttttcctggagagtacagcatggcaggggcagtgggtggcaagctggggagcactgagtagcctctgagagttgaccggagccctgaggcacggggccttacatcagcccctgcgggtcagactcaggctggattggtcctccccaggcctagacgggaacacaacactgcctgctccctcttagcgggcatcactaggtacagccaggattgggcccaaaaggcagtcactggattaggacccagttctcttgttcctgggactttttaggagtgtctctgaaatttatcccttaagtaaaaagagcattctttaaaacctacagagccatcgcagtctaagagcagggcctggggtgctgtggcaggtcttgccttgaaggagccgtcttcccacagctcagtgtgctccagggcttgctggcaggcagcttccacggggtcctggaggctctgggggcataacagaaatgctatcagggagtttgagggcccgttatgagtctgacatacattggcattttgtgcatgcctttaattgtctgacatattgtggtactgagctgtgacatgggaacgattactagacctgcttttgctcatgaagaaactgagctcagagagggaaaacttgtccataaggaacagagctaatagtggtaggctggggctcaagcctaggactggctgactccaaagctcttcctgtctcccttgctctgtgtgcttctaaaagatacttagtccaagtccaaaatatgctcatttctcttccctcaggtgaagaagtcaaaggaatcttttgaagtgaagaaagtgggtttggacgtgcccttatgctgatgaatcattggagtaatatctggggtttagccgcatccttggtggcaaggcggtggggaaagcccctgagggtgaggccagcctgagccccaagggaaaggggctgctgggacctcctgacctcaactcatctccaggagcgcacagggcctcgcacagatgcctcagtctgtaccgctgggagttcgtgccatctcagacctaccctccctacctgggctgtacctaaagagatactgctaggctttctctagaatgtttcatgagccagcactgtgagacattttcaagctaaaaacatacagttcaggagactgtaatctgtggtagaaagtgttcaccatttgctgctagtaaagacggttggccctgtgcttctctggccacttgtgccacatggtgttctcggaagaggcctctccatgcaccagtgtggagaagccctctggaggccaattcaaagagcatctgaggctaagcaactgaaaggaaaaggcctgatggccaacgtgttgctttctgtggaatgttccagactggattgctgggggtcattttctttaacagcagcctagacaggcagtgactctcttttattcagccaggtgttgaaatagctgcagggaagccacagacagttgttccagctttccggatcagagagcactggttgggccccgtgccatgtggccccagccccatgggatcgctcctcaggtcatggagccacacatcagtgtggagggttcgctccaggggttcctggtacaggatgcagatgggtcttgtctggctccaggctttttgtttctaatgttgtttctagagagtcatcatcaccgcataaatggtatcaaagcccttcttttaaaaatgtagaaataaatgtaaatggtagatcttgacattgcttgtgggattaagttctacaaagaatagtaattatttctatgggtggctgacaattagctctttaatagaataggtggctcctgcctgttttcagtgaagacattgagctgtacccacagtttgtttgtaaggagacagaagtgaacctctgagtcgttgttcattagaagacccagaaccatcaggctggtgtccctgctttgcaaacacaagacagaagagatcaatgtcacttctgagtgatcacattggtgtttcagttaactgactcaaggcttggttggatagatattaacatattctgaccttatctgggagaatactggtctgcattctttgcaaacttctgccatttcctctaatttattaccagcatatctatgggtcctaataaatcttccatttgcaattagaatatccaaataaaaatccatgttgactgctaataaggaccttcaccttggctttaccaaggcattaatgatttttctttctcagtaaactttgatgcctgattttaaaagctaaaaatctacctctaatgcttgtagtaaacaggccaattcatagctatgcctatttattttagttaacacttaactactttgtgacaggcactattgtaagtgcttaaagctattaatccatttaatctgataactcattgttctgatagattctccttctttcccagatatctcctctaatgggaaagtaattacacactaaatggtaaaaggtagaatacagtataacttttgaaaagagagagaaactgtgtgggcagaaagattgcactgcagtttatttgaaatgtcctcctggattgggaaaatctctgcagcctggcacacttactgggcttttcttccattcctccgatcagcctcctcatccttattatcagcactcaggcgcccactgtctgctcgaactgattctcatggcagtgcccgagagggggaagtcattgttaacttggaagttgttactgttctacagatgtgtgcacgtccttcagtaagatgacattttaaaaagtcagtgtcattgatgcaggactttttgctccttaattcagctaaatctgggttcttgtctcatgaccaggaaaaattaggcatgtggacacattgaagggtgagaagggcagaacttattaagtgaaaggaaagccctcagctgggcgcagtggctcactcctgtaatcccagcactttgggaggccgaggcaggtggatcacctgaagtcaggagtttgagaccaggtcaggagttctggccaacatggtgaaaccccatctctactaaaaatacaaaaattacctgggcttggtggccgcgtctgtaatcccagctactcaggaggctgaggcaggagaattgcatgagcccaggaggcagaggttgtagtgagctgagattgcaccactgcactccagcctgggtgaaagagtgagactccgtcacaaaaaaaaaaaaaagaaagaaagaaagaaaagctctcaacaaagagagggattctccaagcaggtttctccctcattattgaataccaggggtaccacacatgagctgatgaggccaggctcctcccctgcgtaaggtgcgaatcctagtgactccgccccgttcccccagcacgcacacgaggatgcccaggtaaaccataggtagtatcggaaaaggcaacatttgattggttaaaaggcattattcggaaagaatcaattgggaaagggcagacaaacgggcagacgttctgcccctgggtcgctggtttcatctgggaccagcaatctggtctttcagacttcaggctgttctgggcttgaaggtgaggtctcaccggggacccttccctatctgcctaggcatttgtctgcctcctgcttgtatcatcattttcttaattgcctgcagtgactttatcaagccccctcctgagctgcgtaataataatactgtgttaggattttcagtgttattactcatcatcagcccggacagcccagaattccaggccttcttcctgttaaacgaacggagagcagagcctttgagctccacagttcactatctctgtgtcagccttaaccatcccattggcctgttggggctgaagataaatccccaggcattaagcatattccaaaagggaataactcctttgtctttggctttttgaagtgggctagttttcaggacatgtagttgtagatctctcctcaccagcaaaggaggactcagccaggacattttcaattttctcctttctgctgacagggtggtgccttttcagtgaagtcagctgagctggttggacatttgtgggccctgtgtgcctgcagagccaagctctctgcaaggcacaggtggtggagagatagagacaagcagctgccctcagggagccgcgtaccccttcggcccagccttgtgagtcagagataagaatgagcagctcaggactccactggaccctcacaagaggtgctgccaagggaagattcctgactctttccaaggcccctcgcacacctgtggggctgggcttgctgaaaaactggactgtagttctcttactggatccccaggaagagctttggcccctaacatcttccaccctgcattccccaacacacacatagacacacagaaacggggaagaaaattgcctctgaacatggctttgaaaatatgtctctagggatgcagagcatgaaaacatttcctcgcactggaagagagaaatcagcaggcatctattaacgaatttaacaatctcccaattcattattttattttatgttggtacagatatttacagagcagtttaaataaagaaaacattcaccagtatgtagcctttatacacttgaaattaagtggcctgcagttattcctgttgtttggctgctgcttgctagaggtggtactggatggaaaggggttgttttgctccttcctctcgttgtagtcaccagagaagatgtgatcagagagatcataaggatgtgagaaaatatacaatgtgtatgaataacgcccattaaaatttcttatgtcttacggatggatgtggggggtaatggctggttctactaaaatgctgtgttttcacatttggggaagattctggcatttgacaacttatcagcttttttggacagtattgttgcaaattggcattcaaatcctatgctgtcctcactattctgcaaagagttaagggctgaaaatgcccttaagtcttcccagagtggagatgctgggagcagaggttgtggtgaaaggagaggcaggccgttcttagcaggcttctctctctaaggcctgtgcattcgccttttggcacttggcctagtggctgttggtgtggctagaagaggagtgggcagtgagcttgtctttgttgggggtggctgcagagccactcctggctgccggttaccggctgcctcctgagcatgagccctggctcatctggagcctctttaaaggtagaaaatgtttgccccagtgccagtcagcaccaggcctgatcttcaccttcctgacttagttaaggtgcaaagtctgccttctaaatagtgactgcaggctagggagtcacttcaggatcagaaggagttaaaagaatgtggctaacttgtttgtgtggatgttcattttctgagcacctccacacacattacctcttatgatcttcatataacaacccttcaagttcggcaaggtagcaggtgctcttcctgtttacagatgctgaaactgagtcctagaagcagagccaggcctggagcccagggctgcttcccccttcccaaagctgcccctccccattcccctgtgcacaggcactggccctgagttttcacaaagcctggttatttattcacaggggagtcctcagcactgcctcttctatttccctgtggaaacctcaaaagagaaatcctgccaaaagcgctcaaggacaaaggcgagtagaatgctttgactgcatcccttaccactttgggatccaccaggagcctttgcagtgatagaagtgggtggccctgcagagagcacacaagggagagcagggctgggttggataagccaggccaggagacacagagaccatgctcatgggaagagtggacgtgcagtctgcactttcctttctttggatccactcttcccagcttgttagctcaagctaggagcacacagtgtgtctccagtccttcaccaagaggacaggagatcgagatgtggaggtggcccctgggcagataactgaggtgacaaaccatagaattggttccacatgtagaagaaagtctacaaatgtagccgatcttataatagcatgcagcaccctccagccgagccacacaagctccacctgcccctccagctccacctgccgtggctcccaagactgtcagcacctagaaaccagttcttgcctctgaagcatgctgccgtcctcgatgcagatgtcttagctgtcacctgcgcaccttttgctgtcacatagttagtctgggagcaaagtctatcagtggtttggagtaccagctttcggatgagataaaaacagatttgaattctccctcttgctgtttattagctatgtgaatgaaggtaagtgatgtaatctctctgtgcatcagtatccttatctgtgaaatatggttatctgtacataaccatggtacctgcctcatagaggtgttcagagatcatgtagcatgacaccttgttctccaaaggcaagctctccatggaactatgactgttactgtctctcccagggttttgaagctctaatagtccacatgagcagtgtgacccaggatgaccttagaccttgtaactttccccccgtattaaaatggagctagatcgtatcccttctacccatatcatctgtcttctaaagctaccaggaataaaggcagaggacattaggtaataagatcagcaaaatcattagcttttcgggaacaagaaaataccaggataaaataagagaaagcttggtctcagttacccttaaagaaataatatataaatcagaggtttgatacttcagtttatttctttagttttcagggatatgaaatggcaataggttgctgttttatgctgaagttatcatttcttctgagagagtttcccattttattttcagaagcctgagttttcactacttttcacctaccatctggctgcccctcataagtcaatatctgactgaaattgcgtgagtcccttcagtgcctagcgcctcatcaccagccctgaaaacccctgggaatattcagagtcgctgaatggcacagggaggaatgtgggaaagtccacggcttaatcagttcttgtacaagtggacacactgaggcccagagaggggacgcgtggccatgtggaggcacagctggagtgcagccggggatctggactccaggcctctcccaagagctgcccttcctacacttgctggtgtcatgcaaccagtctgtgtgggatccatggagtgactagggacggccttgtgtggacaaacctacataagcctgggaacaaaaggcattctgggtacaaatgaaggctttggtttctgggcctttgttctttttctgccgtctcagcctcctcttccaccggaccactccacagcgtttagcaggctgcagaggactgttcaaggcctctctgctgagtctggcctctcagcttccaagcagctcgttccaggagggtggtgctgtattgggaggtttcaccaactgtgctgtgaagtggtggaggccccattgtgtgcccagtgcggtaaagtctttcctgcttttgattgtgcccagggattgccatggaaagcataactgtgtatcagacagttgcacacccaggaatccaagggaacctgaacagctactattcccagcaggtacgtggcgtttgggggcggttctggcagggtgggtgcccaggtggggaagcagagggtgaagggcacgagctgatagatgttggttctatatgtggtttcactgtccccagctgtcacctgcatgccttttcctgtcacatagttggtctgggattctagaattaggaatggaaacaattttgtggttgtttcatgaaatgtctattgcaagctggtttgaaatcagtgatttcggtaagaggtgcttgtagtaggtggtctatgaaatctccctctttggagagattaatgtggtgactttgaggaagtggtaagtttttataggggttaaaggagataatttacgcaaagctttttgtacagcatcgaagatacatacaaccctgaggtaaatagtggccttgatgttatcattgctattcatcatacggggatgctggtggagctggaggggcagacactggagagggaggctgagcccatagtgggaagagctgacagtggccaccaaggagtctggattgaatttgggagtccgtggggactgttggaggactcaggcaggagaatggatagctcttgcttgagttccttgatgtcttcagcatttatatgcagtaaaacacctccctttcctctcccagggcaagcttctgaatgtcttgcctggtattgggagggcctgataggacaaaccaaatgcaaaaaggccaggcaggcttgtctgcttgctctgcttccagagggagggagcattgacagggagccagcactgcctcacaccactgcctcatgtgatcagtgccgtatgaccacaggagctagaggcattgtctaggctgctgggcacatgagctccgggatgcccatgtcctctggccaggcagacacagacctggggcagcaccagctttctgatggcagcctgctctttccaacagttccctaccagaatcctgcctcactggagcagaggatgccagcatcagccgggaaccactcctgtgctaaaaccgccttggtggcctgtggcttgaggtcttgatgcggatgaagccggaggaatgttgtctctcctcagtctcatggcaaggactgatcttgttttctgttccccacagggggttccagccagcatcacattttttagtccctctggcctcacatacagtctcaagcacattcaggagttatctggtgacaatatcgatcaaattaaggtaagttattcaatgagcttttggtctttttcagattcttttttttttttttaatctttatgaattatcctagggcttcaatgtcaagtgagacacccctggcctagcaggtgccttagaattggaagggcagctctacctcctgctgggctgttgcacagattgctcaccttctcccagcccgtttcctcacttgcagcatggggataattgtctctctgtggctttcatagacatgtgtatggtcttccctgcttaggatgagtctcaggattacatgagggaatttgagtaaagtcctgaattagctcagggcttggtacaggtgttaacatcctttccttcctttcccccatcttatgtttgccattattgtctattctaaaagcagtcacctttttcatatcttttaaagggtttacattctcacttactagggactgtatttattatgagtctacaaataaccacaactcttgtgtctgtaatagaaacacccttgaactggctccagagggactgaggagagggtgcaggatgtgacccagagcccaaggacagacactgccactcactgcagtcaggaagagcaaaaggcttcacctgccttctcacaggtgcatctcatgtggggagtatgcaccgctctcccagttttaaagatggagcacggggctcagagacatcatatggcctgtctgtaggtcacactgctgagaaggaagagctgcagttgaacctgggaagactgattccacattgtcagccatggtgatgccttgccatggtctcaggagctgctgagcagttgatgcacttctgggcagtaactgatacaattctcacaccagtccagtggtgggtatccagaaaaagaggtcagtgttcctcattacaggtgaggacactgagggctagagaggtgaaacaacttgccaaagtcatgttttgagttcctagaaggcccaggactcacacaggtcaccgaggaagaaaaacaatatctgaatcttgtggttagaaagattagagagaggccgggcgctgtggctcccacctggaatcccagcactttgggaggcctcaggcggatcacctgaggtcaggtgttccagaccagcctgtccaatatgatgaaaaccccgtctttactaaaaatataaaaattagctgggcatggtggcatgcgcctataatcccagctacatgggaggctgagacaggagaatcgcttgaaccctggagactgaggttgcagtgagccgagatcgcgccacggcactccagcctgggtgacaagagtgaaactccgtacctgccccataaaagaaaaaaagaaagaaaaagaaaaattaaagagataggacccataaagtgcttagcatggcaactggtccatatgaccagcgcttacgtcatattgcaggtcaggatgggtcacggtgctggtcctgctctggttcttgtccctctgtgccctgctgcctctcccctgggcctgtaggaggagtccccacctccaccccacccacccacccccaagtcacacaatgctgtgagatgcctggtggtataagcctaacacagttttccccaagcttcttagtgtttgcctagaggaagaacaaaagatttatactctatcttctttcaaagtgagcatatttaaaagcacaaatggatactcagcatctgaaccaagaactcaggcctttctgaatagactgctgcctgcattgtccacacccatggcagctgggggctgagtgcgtgttcctatcctgtatctgtcacacccatttctgcagccctccagacactctgaggagctctcagtagccccctcgcctcttactacagtgattgattaccctgcctgccagtagttaacacctctgccattgctgaggaggagaaagtgacagagctggccttgctcacagtgactatggactgcttgggggccacgaaggcactgtgtgtgggttgtgagttgtccctcgacactgggacttggcgctggatagtgaggtgctttcaaggttcacagaggacacagtcctagcccgtgagttggtagttaggcttttctgtctcagctcagcctcagatttgctactgtcctccctccccaggagtccctgtagggcccactgtttgtacagcattgcacaacatgcaggcgcaccacaaaagatcaaagggggtgacttccgacctgaacttgctacttatccattgacttgggaagaccacgcacttgtctataaatgccacagagatgtcactgcaaagcagtaggtaagcagattcgtaatcaccaccaccacactaatggcagcagctgaatttcctgtgtacagcaaaatgcccttgcagcctgtgaggtgggtatcttcacacctagtgctcactagccacagtggcagagccaggctgtgaacgtggctgctgcccccaaagccaggctggtgcactcacgtccagtttgtgccagggatggagaaagaacgttgatgctgggccccctcgcctggcctggggaagactgctgctctgtggggcagcatcatgtgagcattcattgacacaggagtgaaaggctcctgtgaaaaagctgctgtttcaccaaactgttgatacccctgctctaggactacagtcatgtttgccatttgctggttcccagtcccagggagtttctttttttcaaatttttaaatagctttattgagatgtaattcacaaaccataaaatttactttttatgattttaatatgtaaacttaaaaattttttttttatttttttagagatggggtctcactgtgttgcctaggctgatctcaaactcctggcctcaagtaatcttcccaccttggcctcccaaaatgtagggattacaggtgtgagccaccacgcccagcccaatatgtaaactttaacatgatttttatgagagtcacagatttgtgcaaccatcaccactgtctagttccaggacatatcatcaccccaaagagaaacccggtacccattcgcagccacccctcattccctcattcctcccactccttggcaaccactcaactgtttttcatctccatggatttacctattccggacatctcatattaatagaatcatacagtatgtggtcttttgtaactgactcttttcactagcatagtgttttcaaggttcatccatgctgtagctggtaccagtacttcatccctttttagtgccaaataatagtacatgctgaggaccgttttatttacccattcactagttgatggatatttggattgttttccactttcaggctattaaataatgctaaacattcaaatacaattttctgtgtggacatacattttcatttctcttgggtgtatatctaggagtagatttactagatctaaggtaactttaacgttcggtcgaattactgctattttccaaagtggttgtgccattttgcattgtcactagcaatgtgtaagggttccagtttctccatatcctccatgtccttatttttctgtctctgattatggccatccttgtgggtctgaagtggtttctcagcatgtatttgatttcgatttccctaatgactaacagtgttgagcatctttttatgtgtttgttagtcatttttatatcttctttaaagagatatctattcaaatcctttgcctacttttaacccaggttatttgtcgttttattgttgaattgccagaattccttattctgaatacaattttttttttttttttgagatggtgtctcgctctgttgcccaggctggagtgcagtgacacaattgtggctcactgcaacctccgcctctggggttcaagctattctcctgcctcagcctcctgagtagctgggattacaggtgcacgccaccatgcctggctaatttttgtatttttagtagagatgggggtttcaccatgttggccaggctggtcttgaactcctgacctcaggtgatctgcccacctcggcctgccaaagtgttggtattacaggcatgagccacggcgcctggcctctgaatacatttttttttttttttgagatggagttttgctctcgttgcccaggttggagtgcagtggcacgatctcagctcactgcaacctccgcctcccgggttcaagcaattctcctgcctcagcctcccaagtagctgggattactatatgcatttttagtacagagggggtttcaccatgttggccaggctggtctcgaactcctgacctcaggtgatctgcccacctcggcctcccaaagtactgggattacaggcatgagctaccatgcctggcctctaaatacaaactttttatcagacatacgatttgtaaaaattttctcccattctgcgagttgtctttttacttttttgataaagttcaatttattgtttttttcttttgtttcttgtgcttcgggtgttgtatccaagaaaccattaatttagtgttgctttaattcagtgttttgaagatttactcctatgtttccttctacgagttgtgtagttttagctctgaacttaggtatttgatctgttttgaattgatttttgtgtgttgtgtgaggtaggggtccaactttattttttcctcagggagtttcctaagcaatgggtgcttagcaaggcagtactgtgggcggggtgggagcggggcctctgcaggacagtggcctccctcccctcgttctgactcagccggaggaaggagcctcagtcccgcagcatccgaggttatgcagaggtacaggtggcttgttacctccactaccacctggcctgctgctcacttgctgggagggaggatgaagcggagtgctgggcaggggctgccaatgttggatgctcacttgctcccaaacaggtttggggtccacagtctcaatgcagaggagagtgggggatgaggaccttctctcatttaacccccacactagccctctgaggccagggtaactgtgccccttttataggtgaggatcagagaggctaagggacttgcactaataacagctagcagggggcagagccgggacagaagcagtgctccatcccaggcgaggctctgcacagaaccatcgagcctgtggtgcttgttcagagagagatgtcctgtggatgaggccagtgccccggattggctgattggaagtatcacgacaacataggcagcagcccatgacggtcattgagcttatctctgggccaggccaagtggttcacacctgtcacctcatttgatccccacagcagcccagtgaagagtcctgttatcttttcggtttgacagatgaggagatggaggccagagaggatgggccacgggccaaggtcattgtcctgtggagctgggatttaaatcccaaccctgtgcccacagagccctgaccttgatggctctactttcttggggattcagtcactgcccctgccacaccatcctccccttgatcagacccagggcccccaacacccgaagaagaactgtctgcagctagagcctctgaggaaggactgcactgacacagccgtgatggtgagcaccagcctggggccttcaagtccctgcccctcacctgagcctggcgacagtcgctcagggtggcagactgatgagagcgtggatgcagaggtattttgcacgctcagaagctgggctagaatcgggcagtgttgtcatttttataaacacgtcacatgagcagtaacgtccaaccgcaaagctggctgacggcccctgcacacatccagctgcctgctgccccagcccctcctggtgtgctgaagccctgttttctcttctgtctttatagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgcttactg

SEQ ID NO: 36316 - DNA, 22152 bp, Homo sapiens
cccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggtgagcgcaggccgccatcccccggcctccccgcagtgaccttcagccctcctgcctgccggcctgggcgcccgcgacttggcgggagagattccccgggcgtccgggccgcgccagactctgggcttagcgcccgtgccggcgtggcgggcctcccggcctcgggacgcctcttccggcgcagggatggagccgcagcccgggagagcgcttggggagggacgggggctgtcagagagggtcctactgggcccgctcccggcgcctcctcggagccgtccgtggcgggccgaggccggggcgttttgaggtaacttcgctgctgctggcgcgcaggcccccagccccggggcgctgccctcaaggacagtgccggcgtgggcggagggtgctgggagaggggcagctcccgcaccgtcctgccccatagctgggccttgctggccggacactggccgcctgtgcatctagtggtttctgaactgtggtttgtttcgccaaggggcactgcactgctttcaggccctccaggtggggtagaaggttcttcgaagattttacttcctttgaaattgcatgctcagtttgttaggctgactatggtttcccccgtaattgttgtaaaactcttcaattccgaataccgcgggcatagtgttctgaagcatgtttgagcagattggctaggagctgaatcggtactttttattcagaaagccagctaagaacttaaagatccaagttcaggttatgacatgcttacgtaagtcattttgctctttagagtgtcatctttaggaatgcaggcttttaaaaagctttaaatacatatgtatattgttaggaaacgtttgagaaatgatagttgaagagttacagttctgcactggtgtagcatgaggtttgcaatctaagagatgtgatttcaaatccgtatgcaaagttgaaatacttacagctactcagcaaaactgcacatgtgaaaataccatgtagcgagtgctcattaaataagtgccccatctagggtatttcaaagggccagtactttttctggactctaaacttcaagataatttgattgggtcactatacctacgatatacaactatactacagaatcagagatgttttgtattcctcgaactccctgctcgaataattttagggcattttaaaacctttacatatttttaaatttatttattgtttatttagtgttttgtaaagggaagcagactggagaacttctgaatctatcctgttgatgcaaatgtcaaaaaatagcagcactactttgctcttagaattgtaatgttagctaaaatcagatggaggtagtttttgttttttctagttctggtactttttgccctctaaccattctcaggtccaaaatctctgttggttttgttaaaagttcttcctgttgctaatgttgagaatttcacataacccttgatgccctaaggtaccttttatttaaaagaacacatacaaattcattcaatagaaagatactgtttattgagtgccttccacttaccaggccctgtaaataagacagtccctatggggatagggttttacaggcagtgttttattcttgtctttagtggagattaaataagcaaagcagttaaataagcaaataaatcacacatgaataattagtgtgatcattgattattaaaaatgcattaaaaagtgcattgagaatgagaatatttaacaggcagaccaactgtgatactgacttggtagcatgatggcatatatatagtgtttatatatgtaaataatgtttatacatttcttatataaatgaatatacatatgtaatatatgtgaataatgtttatatataaataatgtttataaatttcaaataatcattcttagaccgttttcaaaagttcccagtaaaataagcattaaactaagtacattgaattggccaaatcttgaccagtaataagcatactcttgaaatggaaaagattactatttgtatttcaaagtctttatgtttatcaccagcatagtatattagttctacagtctgtctttaaagcctgaattaataagtttgtgtgacaaagagctctcaaggaaagacctgaaagtgaggaagagaatgagaatccaaatagtatttttttgtctttgtgatacttattcaggtttctttctctttaacagctgataagatgcgattacttttgatcctgggtttcttttcaacttgtaatagtgttgtattcttgtctttaggcaagccaaaattccttccggatagaatatgatacctttggtgaactaaaggtgccaaatgataagtattatggcgcccagaccgtgagatctacgatgaactttaagattggaggtgtgacagaacgcatgccagtaagtggcatttgtggaaatgttggctattttggatgaagtaggctgtattcatgagtcactttactttataaatatttttcagagttaaaatgtaaagttattagaaaagatggcttcgtgagtaataagaggttctctttcactaaaatgttaaagaactttttgaagttttagcatgctattattttgagccatcgctttgaatattttggattttttaaaatttaaggccgggcacggtggcttatgcctgtaatcccagaactttgggaggccaaggtgggcagatcacgaggtcaagagatcgagaccatcctggccaacatggtgaaactctgtctctactaaaaatacaaaaattagccgggcacggtggcgcgcgcctgtagtcccaattactctggaggctgagacaggagaattgcttgaacccgggaggcggaggttgcagtgagctgagatcgcaccactgcactccagcctggcgacagagtgagactccgtctcaaaaaaaaaaaaattaatttaattttaagttccgggatacacatgcaggatatgcagttttgttgcataggtaaatgtgtgccatggtggtttgctgcacctctcaacccatcacctagatattaaaacccggcattagctattttttctgctgctccccctccgcccacaggcccctgtgtgctttgttcccctccttgtgtccatatgttctcattgttcagctcccacttacaagtgagaacatgcgggtttggttttctgttcctctgttagtatgctgagggtcacagcttctagctccatccatatctctgcaaaggacatgatctcattcttttttatggttgcataatattccatggtggatatatacaactttttctttatcctttattgatggacatttgggttgatttcatgtctttgctattgtgaatagttattttggatttttatttggcagaactaaatgattgtcttttcactcttgctgggtatttacagatttttactagggttctacagtttgtaaatatttttatttcaatactcattcttttttcccccactaatttaaaactgagattttttaaaattacactttgtattttggtttcagtttcctaaaaagtgtatagtacacaaacacatcaaagtattactcttaaccatgtctgacatataatagataatatataagtatttattcaattccatatgaatgattaaatgatgagaaaactttctaccacattcaattaaatttaagatgccattaattagaagatgcaccaataggcaccactaagaaagaaaaatgctaccaattaaggttgtgacttaccattgattacaagatacatcttgatttcagagatgttaaagtgtgaaaagaattgagaaatgcataacatattctacgggagcccaaccggagtatgaaaaatagtcaatgcaggataggctagtaagcctagaagtagataggcttcatcctgtgagatattgtttaacacttatcttataaatatgcttttattttcaataattttaagtcattcctaagccttcaagactgcctcttgacaggtatatagaactttacaacaggcagctgaatctttgatgagaatatctttgtcattgccatctacagccttcttggtggtgaggtaaacatagtttgactacgtggttaggtgaaaaagggtagtgaccaatcctaaaataatctcatattattcaactccagagactaaggaggaggtcagccccagctagtgttggtgggagtgagcatggctgccgttttcattgatctgtgtcaccagcatgttttgtggttctggtggggcatggttcctgctgctgctgctccagagacagcacagccattgggattgcacacctgtgaaaggcagacacctggggtctcgattttgtcatactttctgaactttattatgtgtaaaacagtctgtatgtactctaaactgagtagtatgattaaactcaaccctttttacttgaggtccagaggaaaacaaagctaaaaagattatgaacatctaatgtgaataaattaagaataaagtgacctgtcttttctctctagtgatacattttgccattttatggtgttcgttgaacctctttctgctgtgaatgacccttttttatttttatggtccataaacactgggggtcattcactccattcagatggccagcgttgattggcattcacctttgcccttggtagtggttcagcccactacctcagtgtttgttactgtggagatttaaattcccatttgtttttgtgtttaaagtttttaagtttctaatcctgtgtgccatctgtcctcatttcgtttgagtcaaacgtttctaatgttttaattttagttacttaaaattgaaatttcaaattttctggttttccttttctatttgaccctcagcttatacttactctggtccaggtttatgtttttaatgtgtcttatttcttacttttcttggctttttctactttgattccagagatagcaggttctctcttatacattcatcattctcttcctttcttccctttctcccttctactctttccccattcaaacctggtgtgggatctatacaacaatctgtattattaattttgacaagaactcacaattcacttgtcttataaaaactaggttttcatttcagtttatccttttcaagcttggtgaggtgatttgggatagacaatgaaaatatctgcattaatggggttttatatatatcggaagctgtcacctttaggtctggagaatcttgggtttaaaaaaataattcttctgagagaaatgtccagggagttactgagtattaaggctttactagctaagtagaatagattgctttttggccttggggtgaaatgataacccagtcagtcactggtagtctcatactgattggcagttaaatatatcccttatttatttatttttttaagaggggaaggaaacaattataatgtaacgtgggatccagtaagagaaaataatggttcttgctggtgaaaagattgagtactaaatttgtttttatttatagtatatgaaataaacacatataatttattgtgtgtatttgtgcataggattgtattcgtgtgaatatgtgtgtatatgtatgtgggagacgtacacacatatatatatgaagagtcaatgtatttgtttttatttggttccttaaacaaatagatctatgataatgttgattcttggttcatgaattcctgtctataatctttctctataaccgaaacattttagagctatagtgttactgttttattgttattgttttatgtatagcttttgcatctgccaaaataataaacttccatgcttaagtaaaattgtaaatttgaaatatttttctgattaattttagaccccagttattaaagcttttggcatcttgaagcgagcggccgctgaagtaaaccaggattatggtcttgatccaaagattgctaatgcaataatgaaggcagcagatgaggtaggaggtgataagtgtgtttgcttaataacctcagacccatgccatactctggatgacgatatgctctggcagaaggaaaggggaactgtgaattcttgaattaatgaatttcaggggagggtggtagcattatttttagtggtgatattaatatggtgcttaaaacgttacattgtgacaaaatttctggatgattttataccttttgtttttaagccttttgactttccttaatttatatagttttaagaaaattttttgaaaagatatcatttgaactttacttgattttttattttatatataaatctttttaaaaccagttgattatttgataatgcatattgagaatgtaattttactaatatgctaataacattgtcttaaagaagcaatcagaggtaacagaactgtatatatagtgttgttaattacagcactatttataataatgaaaacaaattagacaatgcgtaactataacagctacttatataaattatatttatatggtaaattatagaaaattacttttttgaagattggcatgcacaaagcctagcctatgagaaatagggaggaaagtttgcaaaaatatatgtattttacgatcctaattttgtttaggaaaaaatgaacagaaagtgtgtgtttctcatatacacacacacacacacacacacacacaccctcattgcatgagatagagactggggatgccaacatgctaatagtcataattactgagcaatagaactatagtgactgttttacttttctcagttctcaaaattttctacactaatcacatatttttatataaccagaaaaaagttttattttaaagtggaccagttgttcaaggtaatagatttctcaagtgcattctgattttttaagctaaaatcattccagaagattgttaaccacccatattttacaaagcacaccatccaaaaactaacacataagctggatgtataaaaatacaacaaaaataggggcaaatctgggcagcgtttatttctacatttggtgattactgctcattggacatctgtgcaatgaagtagctattagtgaactcacattttcaagttactagctcattagcatgctgactctggcaataacatctgttggatattcctgctgagcaccagcaacaaatatatctagagactaaacgtatttgccagccttaacaggtggtcctctgttagaggaggctgtgggagagagataagaaagatacctttgattcccttttcatttgaaaccagtgaattgtcataccattcactatagataatatttcactttttaaagtatctgtggttggagcaagtgatgcttcagaagcttagatatgtgggtcaactgtattcaaactctgtggcataatcagcattattatttccttttttaaaatacatttttaacattttttctgcaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccaggtcagtatgtgagctttgctgttttttggttataaattgaaaagcatacctgagattgttcttgtaaaacaagcattcactttttgacaagaagtgttcattatttaatggataaggcttcttatggttcttatttcttgaaggaatcttggttttatgtttcaatccttataaaaattatttttaggacacctgaatttagtgtatgtatttttttattgtttaaaactctattttgaaataattttagatttataagagaattgcaaagatagttcaaatagtttctatatcccttcactcagcttcccttattgttaacatcttatgtaaccatggtacatttatcaaaactaagaaattaacatagatacagtactcttagctaaacaacagactttaaaaaaaaaacaaaaaactgaggctttcctcagtttttccactcatgttctttttcaggatccaatcaatgctatacattacatttagtcacatgtccccttggtttcttctaatctgtgacagtttcttggtcttttgcgattgtctcagtcctttggggctgcagtaataaaatacaatagactgactggcttataaacaatagaagaagttaatttgtcacagttctggcagctagaagtccgaggtcaggccactggccaattcattggcttggtgggggcccactttttggtttgtagatggccatcttttctgtgtcctcacatggtagaagggacaagggagctctctggggtctcttcgtaaggacactaattccgttcatgagagctttgccctatgaactaatcaccttgcaaaggccgcatctcctaatactattaccctaggggttaggatttcacatagcagtgaccttgacactttgaaagcagtggtcaggtattttgtagaatgtccctcaattctggtgtgtctgacgttttctcattagattgagacttttgaatttttgagaaaactatcacagaaataaagggcccttctcattgcatcatatcaggggttcatgatagcaacatgacttttactggtgatgttaaccttaatcacttggttaagctggtacttgccaggtttctccatggtaaaattataatttttcctcttctataccctgttcattagaaataggtcactaaaccctgcctgcattccaggcactgtatttcagtttctagagggaggagtatcaaaaagtttttgggcttacattaaaatcactgtagtaattaatagcgcgctaccttgaggctaggcaaacatcttctttttccttaaactttttcctactatttttagcattcatcagggaatcttatctacagcaattacttccatggtgttttaatagtgattttcagttttctttattcattctacacttgttagttgaatttttctgcaaggaagatttgttctctctgtcccatttatttatttattcagttatttgggtatatcagtatggactgatggttatttattttattcttcaggttatgatcccatacttttgtttatattgttgcttaaattctttcagctctgggaacccaattcatttggctcttgtgtccttttaggcatgccaccatccttttacttttctgaagtgtgttccgacttcctggtactttaagatgctccaagctcattgtcttgtattgtttctgccccagccctagaaacagccatttttcaaggaactgttggagaattcttattggaaaatgatatttagaaactgagatctgggtgctaagtataatttaatatatttttaagtagtaaggaagaagtgtttttaatacacgttcattgtataagggattttcccaatctaatacttgcctttatgaatttatgttctatatatactgaagtctgaagtctgcctcagaaaggtagagttatagatgaaacgtgattggctacatgttgataattatgtaaactatttgaattcaggtgacaggtacataagtgtttattataccattcatcctacttctttcgtaagtactttatattttgcatagtaaacgtcaaaatatataaataatgtatctttttaaatgacagtatacttttatatatatctgtgtgtgtgcatgcgtgtgtgtgtgtgtgtgtgtgtgtgtgtgtgtgtgtgtgtgtgtgtttagagattgtgcttcactctgtcacccaggctggagtgcagtagagtgagcatagctcactgcagcctggaaatgctgagctccagggatcctcatgccttagcttcctgagcaagtgggaccataggcatgcaccgccatgcctggctaactttaaaaatgttttcagagacagggtattgctctgtgttgcccaggctggtcttaaactcctggcctcaattgatcctcctgcctcagcctctgaaagtgctgaggttataggcatgagccactgcacccagcttgatattatgttttaaaagtacagggtcaacagttgaggaaagagcactgagtatatactacctggctaggtctcaggtttgccagttgctaaatattttggcatttatacagtctctttgagggcttggctttcctatttttaaagtggtaatctacctcacagaatttttctaaacttaataaagagctgtttatgaaagactgtatgcactgtataattgtaagatattcaattataagattttataagaatatataattcaataattgatgtaatttgatataattataagatattcaactacattgaagatactactgctgtcttcaagtgcagttgttaactatacttctctgtattttgctgtcatttattagcaggcagatataatacgtaatacataatataatacataatatattatataatacataatataatataatacgtaatacatatataatacataatacattcagtatacttaatgtgtataatacagttctgagtatgtgttagaaaccaggatgctgcttatttgattctataataactcacctatgacatgccacacatacatgtaactgagctgggttttgagtagttagttggagagttttttaattgagaagtttaattcagaagtttgtttttgttgcctctgatttaacattttatatttcttttgaaaaatttccaacagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggtataggagtttgactaatttgattcaatttagagcttggtacaaatggccaatgtgtcatccttgaaatctgactagcttaaaaggccaaatttgtaaccggaaacttcagtgacagaggttgttctgttcaaccaatcagtaattttcattgacatccacttagaagaaaagcagagtatactggctataagtcagattcagtcagactgctcgggttcaaatcttagctttgctgtgtacaagctatgggaccataggaaagtcatttagcctttctgtgcctcagttttctgagctacaaaatgaggaaaataatttccctttcataggatagttgtgaagctctagtaagttgatttatgtagagtgcttagaagcatgcctggcacacagtaagtacccattcatgttagctaccatcatcaccaccgtcatcgctgtcatctccatcagtatcatcatggtttttcttttgtctttcttacctaaattagtaggttatttaaaatttaatctcaaagtgattaaataaggtagatctttttaagatggatctggccgcatgtgaaggagatactactctcttctccaagatattagaaagtattttcatgtttctttttcaatgccttaaggaatatctaatagtatacattgtgaaggaaatgtaaggaaatacagggaatgacttttgtcttagtaaactcacactccaattggggtagcttaatttccttatggaaggaatgaggaaaacttgaaatgagtaattgaaaaacaaatgatgggactaaattgaactcactggattgagttgcttcttaaggctgtgtctcatttctctttgcatcattagtacttaggaccatgcataatttctaaggaggaacagtatgtatgttttgaaacttttgaatatttctcaagtttctaattttaacctttttttggtgttgaaaactacaatactaaataccatttgggccatgactcagcctcctgtgtaaaatcatcattcttcctgttaagacagaaaattacatttttctgtttgactttatcagaagcatttatacttgcttttattgggattgtcttttgagttcgtgcattgttccctgtcaaagtgtattttataagtgaatctatctagtgtgtttgtgtgtgtgtgtatacatacagtcatgtgttgcttagcaatgggggtatgttctgaaaaatgcatccttaggcaatttcatagttatgtgaacatcacagagtatactcacacaaacctagatggtatagccttctatacacctaggctatatggcatagccttttcctcctaggctacaaatctgtgcagcatgttactgcattggatacaataggcaatcgtaacacaatggtaagtatttgtgtatctaaacatatctaaatgtagaaaaggtacagtaaaaatacggttttataatcttagggtcccactgtttatgtgatctttcgttggctgaaacatcattatgtggtgcgtgactgtatatgagtgatgttatatcagatgcatcaggtctacctataatgagttatatcttttgaaatgttttctttagaacagtatggcatcctgtcacttatggttttttagtgttttcaggcaggaaaaaaggatagatttagtgtaaccatgtatcttggtttgtccagttaactcccagtgtatgccttttgtttctgcatgactattaatagagccctttctgtgttcaaaacataaattctgtggttgctttaattaaggcatgtcaaaatttggaaccagtgttgacattggcacattgatgctatgatctgactctaccgttacctcctattctttttggaaggtccttcaatgcaaactgttaccttcctgtgctattcagtgagtcattagcttcccaagtctctgtagaatgtcttcatatttcctggtaggtttatacactgaaattgtatggagaatatttctatgtttgcatttttttgggggagatgagttactattttttcttacaccaaagttgtctgaggcatcccaaaaaataagaaatcacttcagtttctttagtagactgcaagtaaaccaataatttagtgtagtaaagttgttctttttaaagtgtatttcctgtgctgtttttctttgcttcctattaaaagactagattataataaataggctgcatgttatcagtggcattgtcgtaccttatggttctataaaccctcatccttccctatactttgctcatcataagatttgaagtagtataaataaaacttgattagcttgtaatttagtattctgaaaggtatttttaaaaatttctatttaatgcagttagagtaacttgtaagctattaggaattacttattcttaccttaattttcttttcttttcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggttagtgatcacgtgaattatttctcattttcatttctcattatacgtggtctgtacattttctgagtgttcctgtcttgaattcttgtgaatttaaagttagaaatgatatttttccatcaaacatgtgttttaagtatatttctgaagttataatgttaattatttgccttttaaaaaatgttccatgtaggagtttatacagcatgccattaaaatctaccagtgttagctttgtttactagttagttttcaattaatttccctttaaagttttgaatagcagttttcaaaataggcagaaaaaactgagtgttgagtaagttatttgaatagtaaatatgttgtagacagacttaatttcttttttttcctattatgtcatgctgtgataattctttgaattattgacctttttgaaccatgtctttcctttagtagagagagtattatactttagataatgataactattattagggccaagttgtcatcttcagaaaactctcattaagatgtagatgttaccagacggttagggtagagataattatacactgcacatgatagcttaccagctgatttgtctttaaaccatattttaatagaaaagaactctacttttagggtttggcaaatgtagatttataaaatttttaacatgggggttaactgagaacatctaactcattttagcacactgtttttataggggatcttgtgggctcctggctaggggagaggatgaagcacagtaaagtggacaaagaaactttaaaaaattgtattaggggccggacatgggggctcacacctgtaatcctagcactttgggaggccaagatgggcagatcacttgaggtcaggagttcgagaccagcctggtcaacatggcgaaaccctgtctctagtaaaaatttaaaaaaattagccgggcatggtggcgggcgcctgtaaccccagctacttgggaggctgaggcaggagaattgctggaaccctggaggaggaggttgcaatgagccaagatcgtaccactgccctccagcctggctaaaaaagcaagactctgtctcaaaaaaaaaaaaaagaaaaaaggtattaggaaaggagtgtggtataaaccagaatgaattcccatatactttttactcaagcatagtcaggcatcatatacgtgtgtttgcagtaggattgtgttttttctttcagtacatttatcatacttgttatttcatctttttaaaatgtagtgcctggctaagcacagtggaattacactcctgtaattccagcacttcaggagaccaaggtgggtggatcgctagagcctaggagtttgagaccagcctgggcaacatggcgaaaccccatctctactaaaaattaaagaattagctgggcgtggtggtgtgcacctgtagtcttagctactctggaggctgaggtgggaggattgcctgagccatggaggttgaggctacagtgagctgtgattgagccacactgcactccagcctgggcagcagagtgagaccctgtctgaaaaaacttaaaaaatgtaataccagattctttctactcctttaggacttcttttaaaaatgtagacaaaatttgagtcttaagtaaacatttttttctgaagtaaaatttttattttttcgtatattggaactttctgtttcacttgctaatggtagaaaaatgtttagtttaacttgttcacccatctaggatatttttcttttctttaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggtaatcacatagctagtaaatgttggagctaaaacttgactaggtcctaggcattcttagctatggaccatgtctctctttgtttaaagttatcccgcagctggatgcgcaaggcgcactgttccagcatgtctgtggtcctctggtcaggactgctgggcacgtcacctgacaagataggaagaaagaatctgacttagcagcaagtatttcgaatcccacattagaaaatgtagagcaggctgttaaagtgatcagcgcgggttgaataaaaagaagtcataccaaacttcacttatttcattttttgcattccgttatatgcctgttagatatagcaagtgacacaacagtgtatgtctggatttcagcaagtcatttgatagattcgcatgatagtcattgattccagtggagaagcgtgggcagtgctggcagatgaatgtagctgggtgaacagtgacatttcagaagtgactaatgaagtgacttcagtctagaagaatatattggtaacaagctgaagggctctgcccttcaacactttactggtgactgagggtgaaggaagagaatacatgctaatcatattaacagttaacaaagttgggatagcaatactatggatgacagaactgagatccataaaggccactgtagcttgggctaaaactgacaatgtaacttttaatagtgagaaaggcctgactctagatttttatggaaattatggatctgtagaataagaagagatgaaattttgttttaaagtacttcatgttgaagaatgacataaaggtttagttgattgcaaatccagggtgattgccaaaagaaagagaactgggggagtcacagataaaggcaataatccacccaataatctttccagtgtgttaacttgtactggtcagaggaatctgggttgtttgattcaaacttggagcttgtccaaggagtgtgagcagggtagtggggttccagagactcgtgataaataggaaaattttagcttagcatcaccttcccctaggaagcctcccatgtgttagtgaagggtcgcttttataagtgttctgatagcagcatacactactctgtatttaccccttataattgccagctctttctccctagcctccaagttctgcgagggcagggcctgcatctttcttattcagtgttgtatattgagtgcctggctccataaatatgtatagaatgaatgaaaatcatgaaggtggagaactatatttaatgtgtagttgtggctactcgttagcctttgaatgattcattttgtggctacccatcccaccttccttggttggtttgtttcattaaattacactgatggttgggccttgctttattgtatatcttactctatttagtgaaattagatttctttattctcctgattatttgcataaatttagtctttactctgtcattggtggttttcttgaaggcaaggtgaaccctactcagtgtgaagcaatgaccatggttgcagcccaagtcatggggaaccatgttgctgtcactgtcggaggcagcaatggacattttgagttgaatgttttcaagccaatgatggtaagctttaaatctgatttttaatgttttttgaccaaaggcttattatcttggttttgtatttcataaagacttctagtgattccacattgggtagttgggtgacataagtagcagttggaagtcaagcatttattaagttaccagaataatcctagataatagaaattagttgacttttaacctaagcaatttgatgttttttttaatagcccgtttaagaaaaataaaatgcctccctacaagcctgtctccttctcatgctgctgctttcttcttcaaattcagtcttcttggaaggatagcacatactcactttcatttatgctgtagtcaccacagcccagcatggccccctccacgcttgaattattctcccattcattggtgactacctcagtccagctggcattgcgcagttagttcttcccttactaatagttgatgttgactgtccctccttgaaacattcttcatccctgctttcttgaacattttttcaccagttcttcttctgccccctgtcagacttcgtttcattgtctggctttacctttccacatacttgaaaacattgtgtccacccaaaccgttctttttctttcgtctttacgaagatcgatagatgcatcgcgccatttctcatcagtttcctcagctgcagatagtggagctgttgccataatttagagtccttcatttggacaaagtgttatagctaaagtagagtaggggcttactttctcttggaatctcttctaaattctaattttaattttataagaatatgcaaatgacaaatatggagtatatttaatatattcactaaatatttattgagtaccattttctatcaggcactgtactggatgcataatagagatagagcaatgaaaagacagatttcttgctctcatggaatgtatatcctagtggtaaataaaaacacaggccagagcagaactcagactgttaaaattttgctctcaggtcagattccaaacagttaacacgagatacccagcatttataggtgcataacaataaatgccttgttaatctttttaaaattttatttttaatgtaaaataaagataatcaatatttgccttattacaaggtcattagtagcaaattaaaacttagattatatgtcttagagtccattgttggaagtctagttttcagaccggagttttagaccagaggatattaggatttggatatatcttaataaatattggaaatgttgccaacaaagccaaaacaaactaattgattttatactgttttttaatattatatgaaaagttattttacagtgactggagtattcgttaaagcatagaaaacctagaaatttggtgatcattagattttgccctgactttactaattgcctcacactcatactgaactttcgaacctctgcatctttgctcctcttccttctgcgtggaagattctttttccttctctggccaagtcctctccataaaataggatttcaccagttccgacaactggagttaatttctctttctctatggtctctaacacttcagacctctgttttaaatacttgctatgggctattttgtgttttagtcatttgtatttatgtctttttcaccttttttagatttctgtgccttcaaatgttcatgctttctttcacatttgtttccttggttatagtgccttaaaatttgtagaagatctatatgtttattgaattgtatatttactgtcaaccagaaaataatatgttattggacaaaaaacatgttgccttagtaatgtctctctctctctctctctctctctctctctctctctcactcactcaaagattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatataggtaagtgtttaaggaataataatatcattttgaatgcaaaattaaaaagctaaaccatttttaagagacaagtggatcagtgtttgagaacagcaaatttcttttgaatatggttttagtaaaatctcaaaatatttgaaattgtgtggaaaggtactatataacttgtatggtgtcatagttctttcaaaactagatctattatgcctcattttatttgaaatgtatcgagaagtagtagttcaaacttattttgattttaatggaattcagacgccaaatattctatgcagaccattggggaaggttatttgtaagaccttcagtgggtaatgtcactaggtggcactgctgattagcaacattgaatgaactcatttttctaccttccctagatctctacaatgctttaattttgttgttttattcaattcagaaatggaaagttacaattaaaagaaaaagtttatgtattcattgcttatagtgaaagggaggaaggaaaatgcaaatattttgtctaaaaccatgctattgtattataagtcttttttggaactgtaaatatttcattatgtagaatcaaacatacagatttgggtagtagactgaccatagagatctccattaaataaactgtttacacttttgtagattttgaggcattatgttgcattatattatgatgtgttaaaagccttttacccattcttcctttctgctaagcagaggttaatatattttctgcctttctgttatagaacaagttatgattcacttatttggcataatatggctactgcttcttctataatcttgaactttcaaggcaaattttatattcctggtttcacatcaagctataattacagttttttaaaattagagctcatttgactcttttaggtagctctgagcccagtatgatatcagttttttggtgtggcattgagattggtaataatgtttgatccatttaaaattatggtacatcaactacatctggaaaaacacaaaggggaacccagaggctcgtgtgagcagttttcatcagatctttacttcagaatgtgttaccaaaactttaaattagaggtgtctcctaaagttgaatgattggcaaatctttattggaatcaacttattgtgacataaaaagaattgttagaggccatatgagaatgagatgggtcaacaccacctcactagttgacttggtgtgagccttacaaccctctgaatcatgggttccctatattctcattatgtaccaggctggttgccaatagtgtcttgttggacttgacagctgaaatgcttagactttaaagccattattaaaataaaagtactggatatatattgatctcaagagtttaacatgcaaattctttctcaaagcatttctgctttaagaaagatgcccttttcagtaaatggcatcaataaatgccctttcagatcaataaatgcccttttcaacatatttagcattcacaaattcagttaagtaataaaagtaactatgcccatgctttcttttatagctgattaataattgcatattgacacatgccatcttattgatgatgtatactgcctcagcaagcttcttccttttggtcatatttctctgatcttgttttttttctcccgcattggtttcattttcattcctgctttttcttcttgacatatatatatatatatatatatatatatatatatatatatatatatatgttaagacagcttgcagaactgccctgcccccacttttattaatttgaaaagcaaataactctgaagtaaacagtatgcctgtgatcttttgtgcagtctgtatttctgcccagactccctatttgtgtccctgtaatgtctgggaggaggccagggtatagaagccattgcagtggagagccacatagagaagagccattggaagcagctctggaggcacccctccccaggccctgcctgcgcctgcctcactgcgaggacttctcccctctcagagccactcaccacagttgccagacgtgcagtgctttattttctgctggactggagcatttagcttgttaatgtttctttagaaagataattgtttctagttaaacatgttgtttgaaaaatatacccagatgtatatttttatgtcgtggtgctataatttctacttttttccccttcaaaatatctaagttactggaaaatttcaacttaggaacaaatctgttggagaaagtgaggtatgtttaagtgtttatttcttaaggaaagtaaatgttctacataaaaaatgattattgagataatcactgttaactaatttaaaaacaaaaaatgtcatttaagaggcccatatagcatcaatatcaagtaaacaattatgtcaccttttgctttaggaaaccaaatatcactgctaacccatatgtcgtctttttattttttcttcagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaaggaaaacagacttaaa

SEQ ID NO: 36317 - DNA, 4044 bp, Homo sapiens
ctttttcgtctgggctgccaacatggtaggtgtttcgtttcttgcctcctcttccttgccggcggagacccctaagctgtattcccattgcccctagtcatccactccctaccatggtcggggcttccaggctgcgcatggccgcctgcggggcagggtggccggcgcgggcccggggcggggctcccggagccgtgtgttaggcccgcggttcggatctctaggacacgcgggcccctgcgctaccgtggtgagacctcacggccctgagcggatcggtaccctcagctttcccaaacgctccagaagttaggtctttgacccacaggcttacaggaccatctcggctggcgggcatcgccccctgcccctaattccttaggccttaccaccaagctttttccacacagccatccagactgaggaagacccggaaacttaggggccacgtgagccacggccacggccgcataggtaagtgccggcttcccctcggggtgggccttgggctctcttcgggtgcttagctagtctggagatcggtagcctataagtgggttagaataagacctttttgtggtcaagttgcacagctgttgatttttttctgacgatcctctagtattccagttctaaggaatttcacatcagtggggtaataggaattgagcaggcacggtattgggttagttgaagacatggagtactgtgggaatgctgtgatgtggaacctgaaaagatgtttcacccggaatcctaaagtaatcgcattgctgaaaaccggcatcggtagggtgggaacagcgtaagcgggacacagaagtctgggaaacactctgcttttgtgcgaggaagtattgagatgcatgagaaggctgtgtggtgcatgtagcttttttgtgtgtgtgtgagactgatcactgtcgcccaggctggagtgcagtggcgaaatctcggctcactgcaacccctgcctgccgggctcaagcgattctcctgcctcagcctcccgagtagctgatattacaggtgtgcgccacgacgcccggctaattctttttctatttttagtagagtcgggggtttctccgtgttggccaggctggtctcgaactcctgacctcaggtgatctaccccccctcgtcctcctaaaatgctgggattacaggcatgagccatcacaccggccccacgtagctttgtattcctgcaggcaagcaccggaagcaccccggcggccgcggtaatgctggtggtctgcatcaccaccggatcaacttcgacaaatagtaagtgtccttggactgcttttattgacacagcttgggaggtaggggcagagagagggctggcttaaacaaaaagtttagaagcaagccttgcctattgctgttttttaccaagttaacacttggtgtgaactgagaacctgtcatcgaggctagagtcacgcttgggtatcggctattgcctgagtgtgctagagtcctcgaagagtaactgctgaccttattcactggctgtgggccttatggcacagtcagtcaccaggttagagacatgcttcacattcacctacccacaaactagtggatgataaattttggctattcagaagacgtttattataggagtatgtagattttccatagagtgctgttatgtgacttgaattttagtctcggccctgcctctgacattgtcggtggtttatcctggttccaggaaataagactagccttttcctcatgatagtctttggtggtttttaaaacagttgtttaagtcaacagatgtatcatatgcctgacactgctctacaccagtgaataatttacactctaatagggggtggtaactataaagatgataaacatagcatcttaattggagtgtgtatgaaggtggttgttacctcttcctagccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcggtaagttaattggatgtttttctgtacttccataccttcccttacaaaactctggcttaatctaatccacttatataatctgtacttcccagttacctaccagacattgatattcttcctgtggtagaattatcataggtagttccctatccgtagcagtgcctactgtcactgcccaggttgtatcaggtttgcatttcgtgcttgaactatagctggttttcactgagcacagctcttggcccttcatgttctccagataatagaatcctaatatgttccattgatactcagtgccatgcattatctgaagagattttcccccaaaacagatgtattatgtctgtccttgcgggggttctggtccctgtgtcagtcttaactctcatgaatatagaggtagtgttaagaggccagaaccctagggacgctttaaattcacttcccagcctatttaatgtccattgagtagttctggtggtcaggaaggtggttgtcttcttttgcttagcagggggtatttgagcaggaggaggcttatgctttgccgagactagagtcacatcctgacacaactcttgtcctggtgtgctagagtactcgaagagaatctactggtcttgattcactggtgggggcagtcggtgcccccgttagtgcccagatcagaaacatacataccctgcctagggatttagaaagtgggttggcagtctttcctcacgcccatcacgcagttggtacctactacagtgtattgtaaacttttttctctgttcttctagggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaacacagacgttggccagttaaacatttctgtttataaagtcagaataatacctgttgatcactgaaaggcctgcatgtattgtactctgaattttacagtgaatgagagaatgtaccctaattgttcaacagggctcaaaaggaaagattccattttgatgggtcacattctaaagaggggcagtgtgataggaatgagatggtcctttaggacttaagttctcagcccaaggtttttccacgtggccccctcatcttttttttttttttaaacggagtctctcttgccaggctggagtgcagtggcacgatctcggctcactgcagcctccgcctcccaggttaagcgattctcctgcctcagcttcctgactaactgggattacaggcgcccaccaccatgcccagctaatttttgtattttcagtagagatggggtttcaccatgttggccatgctggtctctaactcctaacctcaagtgatctgcccacatcggcctccaaaagttctgggattatagtgtgagccactgcgcccggccatggctccttaatcttgatccaaattattgttacatccagaatgtgatgaatcaaaatctcgagatgggggtccagcaatctgaaatttcagtatgccagggcttttctgtatgtcaaagtgggtttgaaatagttaatttttcttctagtctgaaatgtatcgggaaaatttggaaatcctgaaggctggaaattgaaataagtttttctaggatttgtgtctcttgctattggaaaactgatggtgaccaattcatgtttacaaataagatcctcatagatctcggtaaattataatttgctac

SEQ ID NO: 36318 - DNA, 177629 bp, Homo sapiens
tgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggtaggacgccgggggtgcggctgcggcgccggccgccgcgctctgacctcgccgccgcgcttcgcctccaccccgggccgggcacccggcccttccctgcagtgtggccaccggccacctgcgggagctcccggccggagtgtcacctgctcacccggggcgctgctccgggctctgcggggtcactgggcgggtggcttctctggggggtgtctgctgtcccacgccatctcccccgctcattgtcccagggggcggcaccatttctttccctcgggggctcaaggcactggctgcaagttttcccattgtctgtccctgaagtaagtgtctgggacccgcgggggctggatgcccgggaggacacctgattcctccgggcacggggtgggggcgcctggcgcggtggtggggaggaagtgggggctctgcccgctcgcaggaaggagtcccctagcctaggagactgagagggaaagccagtccctccttggctgtcaggtctacttggagtggggtatctgagcaaattagttattaattgggccgttccgaagctggtaaaggtgtgcgtgccctctcttagccctcccgcggggcgcggggccgaagttcccgggcagccttgcaggggccccgccttctcccagctgagcctaaaggcaagattggggcccccgaaataactgtatcctgccctcccagacccaaacggacacacactctaggttttctcttggaagggttgtgaagatggtgtgtgtgtgcgcgcgtgcatgtgtgtgtgcgcgcgcgcgcgtgggggcggggaacaacaccctggttttttcctgcaaagggtgggactggggataacctgatcctcggatgtggattttctggtgcctagagatagaccagggccccgtgttattcatccagaggaaataaaaccagccgcgcgagctggctggaggtgggaattgggagcggtgggggaaattatttttttaatgtgtatttagggagcttctctttggctctggcccagccccagtttgcctcaacagatccagatccggggaggtggtgtttaattaaaagctcgcttccaaaacgagtgggcaggtttggaaagctgtgcaccgagtgggtgtggacagcccctcttcagccgctgcctgggcgcctggaggagcttttgtctgatgaagtgtaaggtttagagaggcttcgtgcctcggagatggtctttgggaaggaatgctcagctgtcatggcctgcttccacctttcagaaccaactgccacctcacccagggtgaactttatcaagctgcctctgtcctggttttgtccattttgaaatctttctacagctctcgtgccttttgtcacaaattgtccttagcatagcataatctgcagccagactctgcttgcccaggaatgcttatagtccaggcacttggaattagatggattattccctgttgaaagacagcccctttcattctgttgcccccagtgcacactgacggatctgtccactgtagtcctggagtgatcacatctggagttttttctctttgttctttaatccagaatccaggctcggttcttcccattcactgtttgaatcgaaagccgttcagaaggtgacctgcccaaagggtgggctgtcctgctttccacctgccatcctgtggctgcgtggcactatgccctggctggggactcacgggtgccaaggtggtgttttttcccctgcatggttccagttaaaaataaagacattttctttaatgcccagtcacggcggaatctagagtttgtgtatcctgacttctttcggtttgagtttagtaggtttgttcagtatcctatgggaaatcatttattttaaagttttttttttttggtttgtttgttttggcagtaaaattttaaaagcaaggtggaatggaagactaaaacatgccttgggttctgcagagttttagacttttggagactcgagagatgaagagagagggaatgtctgatttccaagattgtttatgcataagacaattcttgaatattttcttggactttgcttcttaaaagacttcatcatggattagatgacagtgacattttaaatggaaattaaaaatttttaaatttgaacagatctgataagcagtatatagtgtgcagatgcatgaagtcaccagcaacaaaagtcagtttttaatatctgaaatcaactgactttctaatgacctgcttatcctcttgttctcttctttaaactcccataatgggtttataatgcctttggtctcctatctgtttgctctgagggaaaagcgtaaatgtcggaaacccatttggaatgccatcttgataaaaatttttaggttattttctcagaagtgatgttaggctgggtgagaaaaggataaggaaaatggttttattagtagcatttgattcttcaaaatgtacagcagcacaggaagggagtcaatttcctctttggagaaaaaaagaaaacaataaaaggaataatttcaaggcctggcaccctccatcttctgaaaccagagaacctcaagacatggaaaagcaagagagagaggattctttgtgctttcctctaaagatgcttcatctaagtcctcggctggctgtcagggcatgggttttatccttttcaggcagtaaggtgtggaagaaatcctgactttttctccactggggaacagcaccatgtaaagcaagcagcagctagtaaacaacatatcgattccttgacgagaggaagcctggtggtttgtttcccgtttattctaccctgctgtggtggtggtcgctaatgaacggtgttgtgcaaaatcacctactggctgcctttcctcccatccatgcaaattagtaaatcgctgatcaaattggctggtgtgagttggttccagaggaaaggggagacaagatattcacgtggctggagggaagggcccatagctggtttgtctggggaacagtagtctggaagtgatgttgactgccttccgatgtgtagacgatcttgactgcatcaaggaggtcctggaatctttttggagtttctatccaagctctgggaagggagggctccatgtctcaaacagcagctttgtgcctttgcttttgagtcattgaaccggcatcgattttggtgatgtctggggagttcttaagaccaggagactttgctggccaaaattgaggacagctcactctgcggatgtctttcttcttttaataattaacttgggttaaaaaaacaaagttggatgtctgaaatcaaatattttcttcacccttgttgctcaagaatcagcatgtcgagagctgaactgggcctgctgcggggagaactttgtacgaggttaggagtatagaatgtgactggcgcaagacaaccccaaccacacctggttcctccaccccatgtgtcactttagacaggggtgtcctgttaccagcacctgtgctgagcagaatagaggccttgttcagttcctccccaccgccccccacctgtgtttgccatcactatcctctttcctaagttctgcctaaaattagaactgctaaagggacttcttgaattccatggaaatctttttgtggttcgaagccatgtcgtgatattttccctcccatatcataggatggagaatgtgggtagtgggtccaacactggatagtgatttcaggattttttttttacccctcactgctttgttttggggttcccatcagaagagagatacacttccttgctgtttatggagggcaattgtgtagaaggccttttgctaggctctgcccttggagagctccttgtcctgtgggctgtaaacaggtaatatgaatccaatatggtggtcatgaaggaagggctgtggttcagcctagagaagagcatcagtctctgcaggagttcccttggaggcctcaaaaaaaaagttttctccaggacagcactgaaaacccaaccaaggcctcagccaggtgctctgagggaggtgggctgctccctataaacggtgacagccaccaaaggcaggacaagcagagcacttgtaaaggacacatgggccccatgttggcttttctcttagcaaatggttgtatttggccagggttttacagcttcctcgttttgggcccatgggagaagaaggtgaagtaaagatgtcataaaatcgacagcaggaactgcctgggatgggtgcccagagatttaggacctcttctatgtagagtcatctttttggttttttgggtgccaattttgttgtttggaaatcgtttctatactggtttgagtgtttctttgtgaaaaccccctccctatttagtttttgtgaaaaccctttactatttagtcaaattttttggaacttctagcttgatgctgtgaacctttatgttctgaaattccgcagtttgtaatgctccaaatcaagagaagtcattcctaggtcctggtttgcatagaaggtaagctgagtttggattttgcctggttcagccattgcccagttcttactagagtaacatatactcattccgtagtatttattgagcatcagtggtgtttcaggcaccaaacgtggcataatgatttcagcaagtaaaaacgtagggtttcccattaaatttgcatttcagatatactaaaaaattgttcactatttaagtttgttccctgtgtgctatgtgttctcagttgctgacctcttgccctttgaactcttcttttgcacctcagccacagggaaaaggaaaaaagctaaaatgatgtctgtcaatttggctagcttacttaaggctgttaaaatgcttggagggtgaaaaggttgaaactattgattcattagatgctttatctccaatttgcatctcggctttttccatcttcacgggcatgggtggcgatagctggcaagattccttctgtagtgagaccatttagatgttcgaattgggtatggacaaatgaggtcactttgagttccccattacttctcggaactgccttcaggacacttaccccaaaaacccacacctctgcaaaaacaaagaaatacctcactccagaccaaacaaaagccagaggacagatttagctgcctaggatgtcagacaagaaatttgggggccatttaaagggaactaactgatgctgtgagccgtttaactcagatttggagatagcactgctgatatggccttattaagtagcaaacaggagaggaaaatgaaattgaggagtaaattaattggctgagcattaaggaagcccattgtcacgattgctgaggttctcccttgaattagcagtagactgcaggtttcatctgagtatgagccaccaaggcaaatcagaaacaaccgaacaaccaaaaacttaaaagtagcaattcccagtgcagaatccactccagagcagtccccgtctcaacacctggaagtcctaggcttggggctctctcatctcgcctgcttcccgatttgtttggaggtgacagtgtttttacctactgagcaaatgggaggatttgggttgtttaagattctctgggggctggacaagggcccttgtaagtctgtgtttgaagaagtggatgggctcaccaacaaaactccttcctgtgctgcctcttggcgtatctggccttggtcataggttctaagttgtttttcttttcctgtctaatgtaagtgggtgaaaaaaaaaaatcaattgagttgagtgccttttgaactgtgtgtctttttatttgcttgctttctctcaaagcagtagaaagtttcagctcactcagcaccagcagcttcctgggcatggaggtgggcagcaggttttgcctgggtcccctctgctgcctactatgcgacaggggctccaagggccgtgggaatgggtctcaccagaaggcgaggttctaggcaggtgtacctcatttggctgcatgcgtgtggttacagagcagggtccattgggttccctgggagcttggagatgctgctgcctgggccagggctctgatcagtgccttggggtacattcatggcattaagattttgaaaagcaccccaggtaattctggtgatgtccaaggctgagaatcactgagctgtgtaagtcttccctcaaagccttttctggtagggcgaggtgcccatcactctgggaggccaagatgggtggatcacctgaggtccaggagtttgagacgagcctggccaacatggtgaaaccccatctctgcaaaaaatacaaaatttagcccagcgtgatcacgcacacctctagtcccagctactcagtaggctgaggcaggagaattgcttgaacccgggaggcagaggttgcaatgagctgagatcacgccactgcactccagcctggcgacagaatgagactctgtctcaaaaaaaaaaaaaaaaattagagttaaatgttaaagtaaataaactgaaacataaaaataaacagcaacaaaggattttagaatactttgccatgatttattgattctgtccgttgtgatttttttttttgcgatgatggaaattgttaaatacgtgagccactagccacgtgtgactattgagtacgtgaggtgtggctagtgcagtcaaggaattgactttatttttagtcacttttcatttgtttaaatttaaatagccgtgtatggctagtagctaccgtacggaacagttgcagatctgtaacatatcatctagagaattagagtgtgcctgcgttgcaacacagctttctatcttctaccttctgctggctacaacactgcccctaaacccctccatagaaattctggagctagagttgaccttgaagttaaaggaatctgactcaaatcccatgggcgagttatttaatctctgtaagtcttggtttcctcttccgcaaaatgggtctgatgaacctgataagagttgttggaggattctgaagtgaaacattgcttgtgaaggttttcacacattgcctggcgaacgtccactcaaatgttagaagcagttactattctgtcttgtagatttgggaatgaggtattttgaagtcttagaatcagtggagtaattatctccaccacttcttaggcagacactgccccacccttatggagctgtatttagagcttgcagtgaagttgcaggaaatggagaagttgagtttttttcttgctaagtaaatcgcccctgagttcattacaaaggtcagctggcccagcaggacctatttgcattctgtatttgcaaaccctactgtttgtttattagggaaggagagggtggggtccttggctaggacatttgtaagtcagatacattgaggcctgggggagggaaagttgctttattagggtcatcttttcccatctacatcctttgagtttcctcctttttctggggcaaccaccaaaagtggccatcctgtgcctctagtctgccctgtggcagcagcttcccaagtcttggccacatctgggttcttcccatgggccgaatgtggcagtcctgccttaaccttttgtgtgaggacacctgtgatttggccccagctaagtggcccgctatgtgtccagtgctccctaactcggactcccaggcttccttgacacagcctgtgctcctcacttttgttgtttgtcctgtcctgtctctgccattgctgcctactgaaatctttctcatccttaggccccattagacagtgaccttattctctggtgcctccttttccctcaaagctcgataaccctaaagccatttttcacattctttgtgacattctacctagtattgattatatcctaccttaaaaagtggttatccttgggctttgaagcccggctctagcgtttcctagctctattgctctgagcaagttaagtttactgagccttgattttcttacctgtaaaatgggagaagaggtgaataatccttccctcttaaagttgttgagtattaaataagtaaaagtcgagggcttagcatgaaataagtgctaaataaatgctcgtatctatttgagccaccctagtaattcctggcagaacctcctgctgatagtggcactcagatgtttcaaagaatagaagcaacctatgccttcagtttgataatgcagtagagacaagtgcagtgcttttcaacattcaacatataagtaatttgagaggacacagtacatgtattcgtcaaatacgatggcatgtctactgcatgtcaggtgctgctggggggtggaggaacacctgtggacagtatagacagtcattgccctgaagtgctcagtctaggagacaggcaggcaggtaattagagttcagtgtaatccacaccaccatagagatcagcccaagattgtgtgggggctctggggagggcctctgattcccatttagggtgggagtacagagtccaggaaggcttttgatctgggtgacaccctcgctcggaactgagttttattttgcttattttaaaagcatttatatgcaaaccaggcactatgctaagtgcttgacacaaacttatttaatcttccaaccacccagcgaggtagtcttagtaactagtataattcccattttacagatggggaaactgaggtgctgcgcggttaagccatttgcccatgtcatacagctagtgagaagcatagctgggagttagttgagtccaggcagtctggctccagggtctgtgtgcctctccacaggactgggctctctctcgcttttgcagcctagcattttagattctgtaacaggtgtatttcattcatgtccttgatcgctctatttgtaccattaggactcaggatgagacagataagaacacacaaaaatctagactcacctctgagtttcttccagaagctcaaggggtctccctctaattaagaggaatatgccctggccacggacatgaagttgttgggccaggccagtgcagtttttgggagcagctgagctgtgagatcgaagtgtgcaatagggttgtctaaggtggcagccacacgacacatgtttgttttgctggaggagcccctctgtcaagggtcgctccagtaaccactctgcaccccgagtgattgagtgcagagcaggaagcgggcagatatttgcagaaggaggctgggagagctcagggattagttcccagggagacctcccttttgaggccggactcctctcctgcagccgagcacgcagccattaaggaagtctttgagtttggtttaatggcccctctttgttttgaagtggctgtttactgaaccttcaaagcccgctcggcagcaggatgtgatcgagggcctgaataattggatgaggcaccccaataggaaacagggagcggggagcagagccaggactagccgacagccaagccctctgtctgagcctccgctggagggactgaggtcatcctgcaaccagaagttgacctggagcgggggtcccctggaacctggcctctttgatgttgtgctggccttaattaggaacaccctaattaagtcactgaggaggaagcttttttcttaaaaaaaaaaaattagcagatgttttgagagcatttcatgagggattacttctcaaagattatgtaagtaacgtaaagttaatggaagaaaaactagaaacttcagttaagtaaaaaataagtcacccacaagcgcttgatgagaaagtgggttatgttcacactcacaagggctcgcacattttcagcaaagggtcagggagccaagactgtgtcagaaacttctttcttcacttagcggcctggcgtccttgcctttccgtgtgtgtagttgttagcagtgccattgttaatggctgtgtggtgttgcactgctttgtatttctctaattaattcatttggtcaaaacatacttgagaagctactagtaccaggttctaagtgctgggctctagcagtgaacacaatggacacaaatccctgccctcctggaacttacattctagtggagtgaggtgcagttgaaggagacacatggaataagtcaattctcttgtatagtaggattatgtgcaatggggaaaaagcactgttgctgtttttctttttaatttttatttatatatatattttttgagatggagtcttgctctgtcccccagaccggagtatgcagtggcgcgatctcagctcactgcaacctctgcctcccaggttcaagtgattctcctgcctcagcctcccgagtatctgtcccccaggccggagtgtgcagtggtgcaatcttggctcgctgccacctctgcctcccaggttcaagtgattctcctgcctcagcctcccgagtatctgtcccccaggccggagtgtgcagtggtgcaatcttggctcgctgccacctctgcctcccaggttcaagagattctcctgcctcagcctcccaagtagctaggactatagacatgcaccaccacacccggcttttttttttttgtatctttagtaaagatggggttttgtcatgttggccaggctggtctcgaactcctaatctcaagtgatctgcccgccttggcctcccaaagtgctgggattacaggcatgagccaccatgcccagtctggtgctgtttttaagtagagtggttaggggcgggcctcgcagaggaggtggcgttagagcaacaacttaagaaccgtgaagatgtgggcagggggtgagggcagtgttcagtgcaagggaagagagcatgtgcagaagccctgaggcagaagccagtacctccctcatttgtgtttaggttgcgtccagtttttttttttttttttactaattataagcaaccctacaacaagtacatccttgtgactagacattgatttacatcagtgatttcccccgaaggactttttatccttggtcaaaatgtgtgtttttttcaaggcttttgaaacccattacccaaagcctaccaaaaaacatgtctcagttcccaattcccatgtttgagggctcaccaccgtggattacatctaaaggagctagatgtggacactgggacctagctggcacccctgcttccaagggcgcaaagggacatgtggcatcttatctagtgcagtgattctcaaatcttgctgtgtgtaatttttaatgagcaaaagtgtccctggagaatgggttaaaatgcagattccctggctccatcccaggagactttttgttgatctgggggtggggcttagaacctgtagtgttagcaaacacttcaggtcattctctgataggtcttgctgggattccaccaggagtaggtggaagtgggagtgccccctgggtcacctgagccactgagagcttcctctgcagctcttgaagtatgtagggagctatctcccgcacatgtgtccccatccccgactccaccacagatatacttggaatgcgatcaggcagacgaaatgagttctgtgcctaggcagagcatgatctcgacttcctttcatttgctaattctgtcttttgcagggaacgcttcctccctctttgtttcatttctctttgccaagaaaattcccatttatcctctgagaccgaggtgaggcattgcctcactctgggaaccgcactgtccagcactttatatctcgagtatgctgcccttggggctttgggatctgcagttccacatcagctttactgctagactgcgttcctcaacgctttggtctctttctgtctatggcccacccctcactcagtgcctgcgcatagtaggtgcccattcatggcccagtcagggtgattggcatcgtacattgagtcatcaaagcagagttgaattctacttgctagtcacccttctaaacacttgttgttttccccatcatcctacaaccatcatttgaggcagggactgccatcagtgtcctttacagatgaagacagggcagcaccaggtgattaaattacttgcccagggtcacccagtgagcacatctggaattggcaggctgactctagagtcatgctcttaaccactaggccacacaaggcttttcaggctctggaatatggctacacctcagcgccctctcgccaggcaagaaaaatgacattcaatggaaagacacttaaaaaaaaaatggctatggaaatgacaaacacagttatcactgtgacactggtggcctttgactctttactggctaccagggcatcgttcctagcagcctggggtgggagttgaggtcacagaggaggtgctatctgtctccgttccaaaggggaaatctgcttcgtggaagatggcagagcacactaagcgtgtatagcgcagcaaggccagtgcttgccccagggtggatgtgacaagttcatcatgctgcccttggctgcggagaggtctcagtttaaaagggaatatggattaaaaaaagtaaggaaaagaaaacaaattaaacaacaaaaattaaaaaaaaagaagaaagagaaaaagaaaagaacataaaaaagggaatatggaatgaatacagaggtatgtgtgtatttaggggagcaaaacctcaaacatgatcctctctagggtagagggtgtttgtgtgtctgttcagggtattggagagattggccccaagaggaactaatccctaaaatgcagaagcagttttggagttgggtagaggcaggtcagagcggacacttccagggaaaagaaatgggtgagtgtaaatggaccaacgtgaagtcacgcttagaaggtctaacatttcatagggtgtgcaagccactaggtgttttgctcaggttcaatatctaatgtggacatttatagacaggaataaacacatggagcaatagctttggcctctggataggaggacaaaggttagagggtagatatgtattattctggggaggattaagcttatacaaatgctaggtaaaagcagccagcccctgtattaggtggttaaatattgagttcccaggtttccagatgtggagaatcagtcagtcttaggtgaacccattatacaattttattttaaaaagaactgggcaggctgggagtggtggctcatgcctgtaatcaatcccagcactttaggaggctgaggtaggtggatcacttgaggtcaggagttcaaggccagcctgtccaacatagtgaaaccccatctctactaaaaatacaaaaaattagctgaacatgatggcacactcctgtagtcccagctacacagaggctggggcaggaagatcacttgaaccctggaggcggaggttgcagtgagccaagacagcaccactgcactccagcctgggcaacacggcaagactccatctcaaaacaaaaacaaaaacaaaaacaactgagcaaactcaggagcaattaaccattgcttaggagcaaataacagttaatgcagttaaccgggcgtgagggcaagcccttccctgactttgggcaaattacttactctttctgtgcccgattttcctatggttagtagggaagtgttaaatgcctgttctaccagctgccctttcagtggtgttttgaaagacctctgtactctcgaatacagcatacatgtgaggcggtgccttcagtgcccatcatgacgtcagtttagattcccacatggcaggttttcacctttgaaaacttggccatacaaatgtcaggtggctgctgatgcaggcagtgactaaccataaacctcttcctctctcttttgatgggaggaactatctgaaatcataaaggaaatgtcatggccgtaatggccatggctcttgcttgtaatcccagcacattgggaggccaaggcaggcagatgacttgaatccaggagttcgagaccagcctgggcaacatggcaaaacccatctctactaaaaatacaaaaattagtcgggtgtggtagtgtttccctgttgtcccagctacttgggggactgaggcaggaggatcgcttgggcctgggaagtcgaggcagcaatgaggggcctgggaagtcgaggctgcagtgagctgatattgtgccactgcactccagccttggtgacaaagtgagaccctgtctcaaaacaagaaaacaggcagggcgcagtggctcatacctgtaatcccagctctttgggaggctgaggcgggcagatcatctgaggtcaggagttcgaaaccagcctggccaacatggcaaaaccctgtctctactaaaaatacaaaaattagccagacgtggtggtgcatgcctataatcccagctacttgggaggctgaggcaggagaatctcttgaacctcatagtcggaggttgcagtgagccaagatcacatcactgcacctccagcctgagtgacagagcaagactgtctcaaaacaaacccaaaattggggaatgagttgaatttaggggatgaaaaaggagagggattctatttttcaagaaatgtggagcatggaacacatacatacattttacagtggttaaaaaatagaaccaaaaacctagctgtggttgtagagcaccctaagatagtgaagcccttaggggtgccgttgtggtggggtggccattgctgtccaatagaactttctgcagtggtagagatgttctgtgtccatgctgtccagtacggtatccactagccactgcagagcacttgaggtgtggctagtgggctgaaaaactgaattttaaattttatttaatcatactttaaataacctcatgtggggctcccctgttggacagctcaggatagacaaaggaatacttcctggtggaaaacttaagaaaatgacttggaagatatggttgacatatttgtttggttatttttattttaagtggagacacccagatgtcagaaaacagcccgggcatccaacctagtaatgcgggaggaggaaaagcttgatatccttgatttgtttggttagggtgttaatagttacaaatggagcagtttgtaaggggagatggacggatggacagagggagcaccttttgtggttcagtcttccttttcataggcatatttattgctggtgtgcttgggcaagtgggtgagggtgggcgggcgaggaagcaaccattgattatccccaaggctgtcatccgcttgatggacagggataattagtggattaggcaacccccaatcagagaataaaagcccaggaatggtatttatgatggatgggcttacccagtgcctttcatctgaggatcttaggagcccttcatcttgcaggattgggtggggaagggtggttttggggacaaagctatgacaggcattcatgggccctgtctgtcatcccacacgcccacttctggaagctgagcggattcttgcctcatgcttgaagaagcagggaggccagagccactccagcgtaggtcagaaggtgccagcctcctctggaagctgcgtaaagcagcttcagggtaacctgaaggctgagctcatccagggtatacccagcggaagaagaggaaggatgctgttggctatgttcctcacactcgccctgctgaggtctccgcagacctgggaaggggtcatggtggcaggggtggctgtggcagctggagatttaaaagcccctcccagattgactctactgatctcctggtagaagaagaccagtttgtgtgttcacagaaaaccaagatgagataaaattatccataatcataccacaagtgccaacagctatgaacctcttggtgcatttctaccaggcatttttctacccactctttgttgtgtgtttcatgttttcttcctttttttttttttttctgagacagtctcgctctgtcacctaggctggagtgcagtggcgtgatctcggctcattgtaacctctgcctcctgggctttagcgattttcatgccttagcctcctgagtaactgggattgcagacgtgtgctaccatgctgcactaattttttgcatttttagtagagacagggttttgtcatgttccccaggctggtctcgaactcctgagctcaggtgatccatctgcctcagccttccaaagtgctaggattataggagtgaggcactgcgcccagcctcgtgctttctttttcatgtggttgggggtcctgaccatttccagggtggtattacaatccctctgggccatctgcagttgtaatcaggtgccatgtgtgcagggcacccttgtcctcttctgctctaccttgtctgggctcttataggacccacatgtaaagcgcgacccaacctgctgtctaagccactctttgcagccctggggctgggctgggctggaggctggctctgttcatgtggttacttgcacttcccagaatcagggaacacttgggctgcaaagtcagatctggcatcctattgcaacctggagctctctgctccaacctctctgggcatcagtttcctcagctctaaaataacagcagcacctgcctgcctgggctgctgtgagcatgcagtgagaatgcaggatcaagctgggctccttagagagtggtctgtggaccaggagcagcagcacctcagattaaacggccccacctccaccaagcaaatcagaacctgcctgtctgcaagctccccagatgatggatatgtaaattacagcttgggaagggccagtatatatacctggcacctggcaactctttagaaagtggtgatgcttcatgatgatggtgatgacagtgatgcttgtcaaggtgaacagagatacttgggaagttacctggctggtcatataccccacggcttgatttctcagccagatccactggtgagccagcctctgtctggcaccttttgggcagaacaaaggcctttgagctggaaccccactctctagagcctctgccctcctggttcctacttgattctcccctgaactgaattcttcctcctcacgtaagtcctccccagctctgtggctcctcccaagttgccctttctctggcagttcccggcccctgtgttccttgtgtggcagcgtggtgttgaattccctcagctgtcccagtggcgctgggctgggagaggcagttgctgcattatttatggagcaccggtcaccagccgtgctgatgagctacacacagttattctctgcaccatgtgtgggatgccgtcctgggcctctgttcaataggaaacaaaacgaagccaaacaaccctaagccagaatggctgttggccgattgctgtgccttgctttgtgttaggcaaatggcctgccatgggtcctggctctagggaaagtggaggaagaggaggaagatgaggagaggcactcggcggtgtctcctaagctccactttgagggtggggtgggggagaccaacttgtggatttgtttaggtggccaccaaactcttcagttgaaggagatttaggaggcctttttcctaaaaactaagaaaatgacttcattattttcctctctctcccaggaactagagtgatgccaggtatgtgaccattagccaggttctcccatcacctgtctggtctggaatttatgtcactcactgtctgaatgaaggccaccccggtcttcctcacctgtcccaagtccccaccctgggtcttgccctggaaggctgcccttgcccacctgggccacttcgcccatgtcctgcctggaggagtggccagcataaatgtgtcactccagtgtcccttggagagagctggtcagtgttccctgcctccttttgtgtcagctgcaccccctaccagaagtacttttccttcctcccttcatttctcagtccttgttccacagtccaaaggggaagccctcaggcttatagacagcaaactgtatgatgtgataagttggggagtaggtgcagctaaaccagagggtaggtgggaagggggtgtgtcagagaatgttccagaagaagtgtcacagctgggtagtgacagctgaataggagttttcaatattgctgaatccccctggagatttgaagagaagcagccacagggtgtggtgtgtgtggggagtgtgggtgagatcacgtgttcagggaagccccatctctcacccaaggaagtgatggagggagtcctctttacacgcttgtaaacaaactggctttctcttcccgtttctttaatagggaccttttcctttcttagaacccagtgtaatctgagttgtattttcaacgaacgcactgccaagggctccagaaactcctggctctcctctctgaagaaattcagggggctcctggaggaggtgcgccttctcattttgccttgtgactttggacttggcagaagccggggcgtggcgggagttttgttttctttgatttgggtctgtctggaacgttgtgaagcctttatgtgttctcaggtgaaatccacagtggggtctgtgttgaattgttttcacggctctgggagtgcattccgagggatttcctcaaatggggacagagctcagccagcaacctcaggaatgaactttctggggacttcttggtgggtggatgcagatgcaaaaaccaaggacagttggggaattgctttctaaagggctctaagagcttccagtgtcttgggttgcgggtttcttttgaaacttgagtatggtctcctttatgtagtcttgctgtccaaaaggcaggactttttctctgctgcctttcaatctttctagttaccttcttcctcctttcttacttcctctaagcttgaattattatagtaaaactgctctcaggtgggtagaaacttcttttttccttgaaagaaacttacaaaaatatctggaacaacccaacatcactttgcctttaaattttaatgacatttactcactttttttttttttcatttctcaacaaggaggtttttgtcttctgttcttaaaagttgattttttttctttttttagaatctattaaattatatattgcctaaaacaggtgggcctgactctctctgatagactgtcaagtgtcattaagtcagcagcaagctactttgggcaaccttctggctgggtggatgttcgtaggtggggagctgttagctgtaccccttgactagaaaggggacccctccttttgttgctaatttggtaaagactgaaatgacgctccaagtgggggcagataagaagtttcttcagtggtttgagtagtcgtctttttcaggcacactcatctcagggttgagtactccaccctgccatttgcttagcagcagcagagaaattgtctggcactgaacacccagctgcctttgccttggtctgtttctgcctaaccctggtttactaatagggagatgcagatgcttcccatgttggctggttccacaccaggtactctaaaaggggggttccagtctggatggacagtctgacttagactttacagtctgtcccccacacatcctaaaggagattactgagagcctgtggccacttggatccctcatatcaaatgtttgttgagcacttccagtgtgctgggcactgcaccgagcactttctgtatatgacctcattcgttcctcctctcagccctgtgaagatgtgacttaaacccatgcagaggtcaaataacttgcccagtgtcgcatagcaaatgggagagctaaggttcaatccaagagattgggcttctgtacgtgcaatctttattcatctccttcattctttcaatgttcaataattgatggtattggtaatggtgatggaattatttgttttggttatcatcattataagggaatgatccctgagaagtgaaatgatttcccctagtccatgactggcagggctgtgactagacctcaggacccagtgctccctgcccaggccactggccagttctgcatgttctcgatgaacatgcctcaccttttcctttggctttgtttctttgagacagggtcttgctctgttgcccaggctggagtgcggtggcacaatcacagctcactgcagcttcgatctcccgggctcaagggattctcccacctcagcctcctgagtagctaggactacaggcatgtgccacagcacccagctaggtttttttttttttcttttgagatggagtctcgctctttcgcctaggctggagtgcagtggtgcgatctcggctcaatgcaacctccactttccgggttcaagcaattctctgcttcagcctcccgagtagctgggattacaggtgcctgctaccacgcccagctaatttttgtatttttagtagagatgggtttcaccatcttggccaggctggtcttgaactcctgacctcctcatccacctgcctcctaaaatgctgggattacaggcgtgagctaccgtgcctggcctggtgttttttttttgtttgtttgtttgtttgtttttttttttgtatttttagtagaaatggggtctcgccatgttgtctgggctggtcttgaactcctgggctcaagtgatcctcctgcctcagcttcccaaagtgctaggattacaggtgtgagccactgcccctggcccacctttttcttaagaaatactttgatcgtcttaataatatttctccagggctccctggatgggagtgtttggtgtttgggagaggagggtctggctctttggtccttcttccttgtgtagccgagagatggtggcacctttgcctagaagtaggtgagcagtgtttctgaatgctcagatttctcagaaagcttttcatcgtgtcttgtggctcagaaagagaaggaatggtcggacgaagctgctattggttggttgagcctttgtgttcttagaggtgccaactgctgtccctctggacagagatctccagtggccatcctgaggactctgatcttggccctcatctctttaattggatgtaggtgtacaaggggtgttcttatctggactggattaaaaaaatggtatgtatgttgggtgtcataattggagtccccactatgtcttgatgggccttgaatgatagcctgagctctcacaagttttcatttgacataaattaatatacagttctgctcttgggtggaagtaacccccagggcacacacttgggatggaggtcatgtcgtgacaagaccctcacacaggtgttggttgacagtagctcaggtgtagctgccaaagggcctctgccaggagccagccagacacgattcttgcccggctgttgcttagtttcccataggggcaaattgccacttagaggaataaatccagaaacctgtgcttgagccaagcaggtctccaatgcatgaaggcagaactgatgaatgtggtgtagcagcatgcgtgaaacagactttagagttcgggtggattgtaaattcatggtgctgttgttgccagaacctctaatttgatcttacgttttaaaaaatgcaatgactttattgttttcattaaaatgatacatgacccttataaagaaaactcacaagactccagccataaaggaaagtacaaaggagaaagcaatacattggtccagattttaactcccagaagtaacccgtattaatattttatagacaactttccagatatctcttatgtacattttcagacagaattgacagctagggaagtatataaatagacgattctataacaaggtgttccttgttataatgagtgctccttgttataatgagtgctatgcatgatcttttgaaaaaatatacttaattgtactttcatttaacagaagaaaatgaaactgaagtaatactgtaattgtttcttcaccactttctttaagttgatttctcagatgtgcctttaaggcagtggttcttgactgggcgtgatttttgtcccctaggggccatctggcaatgtcccatttttggttgtcccaaatagggggtgggggaacgctggcatctagtgaatggaagatagcgatactgctaaacatcttaaatgtgcaggacagccccccacgacaaagaattatctggcctcaaatgtccatagtgttgaggctgagaacctgctctaagggtaagaaaaaatgatgtttaataccattaggaaggtaaaactgttaatgttttagctgggttgcagttttagacagttttaattgggcttctgtcatgaaagatgagttgattaacctcattataattttttcctcctttcctgaacaagaaaatcaagaggtagcatatgttgtttttaccttgtcagggttcataacatttacgctctgttctgcaaaaataatccccaggtgtttagtcttagttttgttttgttttattttattttatattattttattttttgagacggagtgttgctctgttgcccagtctggagtgcagtggtgcgatctcagctcaccgtaacctccatctcccaggctcaagtgattctcatgcctcagcctcctgagtagctgggactacaagcatgcgccaccatgcctggctaatttttgtatttttagtagagatggggattcaccacgttggccaggctgatctcgatctcctggcctcaagatgtctgcccaccttggcctcccaaagtgctggaattacagctgtgagccatggcgcccggcccttagttctgtacttaaatgatcaatgccaaataccacttctcagcccattgtttccccctttctgtgttgattttgagtcacctcttggttggtgggctgtgtgatcttaatataaatttaacatgtgtaggaagggagacgtcggtccctgcctgctttgccctgtcagacttgcacctgcagatttgagtttgtgtctatgcaccacacttagaggaagagtagagagacacgctgagtgtctctgggatgcagtcagggtgtgaagcagggtcccggggagaagtggggttggatgtgaaactggattttgaaaagacttccatgtggaagcaggattattgatcttaactgagggctcccagaggttagaactagaactacatgaacatcaaggacagggtggctgataataggctgggaaggtgatgagttccctgttagccgaagtgtgttggggaaccacctgttgctatactgtccctaggtgttgggcttaagccatcagctgagctgctgcattaggtaatttttcaatcttgagattctgatagtctaattaatgctttctgtaaccacctgtcctggggaagagccccagtcactctggttccctgcttggtgttgtttggggcaagtgggagaacagccagggccatgtttcatgaacaagtggttcagggtggagctttaaatgttctgtacaccttaaatttggacccaccatctaccaactcaaaagtgtatgtgtcagattctgccaaactagttcagttgatgtttgtagtatttacaagattataggaactgagcacattctaaactgattcctgagccaatacatgtatatagaatccgggaaacgtattgcagacctgcaaaggaagagaacatacacagattgttccctgcatgattggaattgggtgctctgttaatgtagtaatcagatgtctatcgcagtgtgacttactgatgtctttgatgtgttgcaggggagctatccagtttgggaagatttcataaacaaagcaggaaagctgcagtcccagcttcggtaagtagaagcacatgttctacaggaaaaggacaacatcctcagacaaggatggagtgggacagaccaaaatgcagattgattagggttgattcaggaagtgctgcagatagggaagcctgtgctgggttctgattggagcatgatcacctatagccatatatcctgggccctgattgccatatgtaaaatgggactcattcatgtctgctttcctccttccataggaattttgagagtcaaatgaggtaggtactgtatgtaaggtagcaacgggtaacatttatgtattgctcactatgtgccaggcatttgttaacttgtttaaatctcataaccccacaaggtacataccattattatccccattttactgatgaggaaactgaggcacagcgaagttaaataacttatccatagtcacatcactactaaatggcagagcaaggatttgaacttaggctctctggctccagagtccatgttctcctccattctgcttactgcctctccacaaatagagtttaaaacctcctgttggctgggtgtggtggctcacacctgtaatcccagtactttgggaggcccaggcaggcagatcacaaggtcaggagttcaagaccagtctggccaacatggcgaaatcccatctctactaaaaatacaaaaattagctgggcatggtgacgagtgcctgtaatcccagctacttgggaggctgagacaggagaatcgcttgaatacaggaggtagaggttgcagtgagccgagattgtgccattgcactctagcctgggcgacaagagcaagagtccacctcaaaagaaaataataataataaaataaaataaaaccttgtgttgactattgtataattccatttacatgaactatctagcaaaagcatatctttagagagatgttgatcattggttgcttggggatagggtgaaaaaggagagtgagaagtgggtaagacagatcttttggggtggtggaaatgttctaaaattggattgcggtgatgattgtgcaactccaaatttactaaaaatcattgactcataccctgaaaaagggtgtattttatggtatgtaaattatgcctccgtaaagctgcctaaacaagatccagtgctgagctctaaggggctgtgattgcctagtctcgtgcttgttcatatatcatgtgatatgaaatagaaaatacgttggcatcttcttattaaagctctacccttttaaatcattgtggtgaagggatacaatttcacttagtgggtgcttcatgaaggataggacattttaaaaaggaattattttgatggccctggttcatggcatgtaggggatgtcattggttggtttggatggaggaagatggttcagagagcggggcaggcaggggttttccaggataaagagccatgtggacgacagagaggtgggagagggatgatgtgatgctctcgggcctttgcctgtggacaccaggggtcactgcccagagtgttagccataggactagagtgtccatggtgccctatagactaaagaacttgggaaaggtgggccttttttctttcattccttcagctttgtttggagcctgggatttccatccatgaactgcagcctcagatggacagtgaacttggaatactgcaccttccccagttgtcaagtcctgtacttaagccctgcttaagctcttgtaattactttctactggatcagatcccacctcccctgctcaggattcagggctcctcacctgagtccttcaccagcctcaccttatttagccatatctactcccacctccatgtctgccatgattaccatttattttaggtagcttcatctttatcctgtgggaggtctcctcctatagtaatacagtaaaacatttaagtacatttcccctacttttttaagattcagcctcatttaaccgtctggcagtctttcagagtagaccaagaaaattgttatcttccccttttatcagtgaggatcttgaagcttaaagtaatgaacagatcagctgtcttaaacatataaagtaaaatttaaagtaatcttaacctgtccttactggtacaggatacattttatattattaaacaatgttttgtcctgaaggcagggaccatttctttattattttgttaaactaatagtacagggctgagagcaatataggggcctcatgcacatagtttaattttgtgtgttagagaaaggatgaagtttagattgcagaagaggcatagaagccttagtttatttaagctgaatcactcctctgtgtttctgttggttacaagtttgctctgccccatcaaagagggccaagatgtcttgtgactacagcggacagtgaaatatgactgccatttaaaagcctcaaacttgatcacccgcctaattttcagtggagccctggtgactgtgtaatatgcaagacacctctgcagctggttcattaaatttggatgattggcattgagttggatgagaataaatccagccattgtgtcagatattaattgtaaatcagaacaagctatttataagtcccaagaagtttgataaagctaatttttccagggtttgtgtttgatgtcaactctttaaaaaatatgcttcaaagtggttttgtgtacatgtatgtcattatttttaaaaattttgagcagaatgttttcttgccctactggaaaataacaggcctcattttgaagtttggctgtaagggactgttgcctagattttcccaggaactacttccagcaccttgcaggaaccttttgtttcaaaactactgttgctgatgtttaaaggccattcctttccctttttctttcttttttcttttctctttctttttgagagagggtattgctctgtcacctaggctggagtacagtagtgcagccatggctcactgcacccttgacctcctgggctcaagtggtcatcccgtctcagcctcctgagtagctgggactacaggcatgcaccactgtgcccggctaatttaaaaacaatttttttgtgtgtagagaatggagtcttagtatgttgcccaggctggtctcaaactcctgagctcaagtgatcctcccacctcagctttccaaagtgctgggattacaggatgagccactacagctggtttcatttttctctattttgaaatcttccctttctagtccttattgttattcttcttcagcaactttgcatccttaggaacgctcagtaaaggctgagttatataagaaatacttgaaaattaacacttagttacaagtttgattgtaaagtccttgaattctagttctggggcttgtttgtgtggaatccatggccctggcttggagtgttgactacgctgaatgatgccttaggtcatgactcttggaaccagtagaccacagagggctcaaggcatcctatggtgtccaaaaaaatattaagaacccagaataatttctaggacataagtgactatagtaccttctccccattctcaccttgtaggaatttggaagattcagttgaaatagtgtcctaaggttgaaacagtagtatctcagtttcattataactaggatctagggagaaaagtcacactgccaggatcttgtcttatagtgggtcaagcccaagcctgtgagtcatgaggctgggatacttgtcccagctctagtatgaactagggctatgtttgtggcctcgtatttgtggcctcagttctcctattcctaaaatgaattgtttgaactacatgatctttctaccagattccttcccccaactgatgtgcatatatatatattgctttcctactccaaaattaatttcacctctaccacttatattttttaatgttttatttttccttttaggtagaaatgcctctgttttcctcctgtataaaactttgcctggtagtaggtgtttcttttttctttttttttttgaggcagagtcttgctctgtcacctaggctggagtgcagtggtgcgatcttggctcaccgcaacctctgcctcctggtctcaagcgattcttctgcctcagcctcccaagtagctgggattataggtgcataccaccacgcctggctaattttttgtagacacggggtttcaccatcttggccaggttggtctcgaactcttgatctcaagtgatccacccacctcagcctcccaaagtgccaggaatacaggcgtgagccaccatgcctggccctggtaatggttttatacagtcagatgaaatggaatgggaagggctactagcatttattgattagcaccgaatgagctggatattattcgggtggagtacttggaaaaaagtgggttcagcaagacagtggttgtccatgctcagttgagttatttctggaggaaggttacatgtactccttagcagaggttttaggccttgagctgtaatgaatttgctagggagagacattccttatgcttttgttatctgtttgcattttaggacaacagtagtagcagcagctgccttcttggacgcctttcagaaagtggctgacatggccaccaacacacgtggtaagcagatggaggctgactcccagtgttaactgcattctgcacgtggactcttccccttgggtggctgcacaagaagatgcagcttaagttatcagagctgagctgactcgtattttcccattttttaaaactctgtgggattccacatattagaagttgcaactagttttctggataataaagcacatgtgaagaagaatgaaaaaggaagaaaatgaaccactgtttctgcacgagttggcttgatgggttctttgatcactttaatgacgtgctggttgttgaaccttgagctgtgcctttggttgcaatttgcgttttcctccttacgtgggttttccttgtttccttgtggaatgggaagcagtagggatgattggatagaccatttttctgagtttccataaaatgaagaacccttttaaaataaggatctcattgggttgtatctatttatgcgtccctcatatttgactgcaaacctgttgagatacagactatgacttattcatgtctgaagccccaaaacgtagtgcctagaacataggagatgtttaaagtatgtttattaaatcaatgaaaaaaatttaatggcttcagcaagtactgaatcatataaaagttattcataacatgtgaaaagtataaaaagaaaatgaatacccccgtatgcctgaccgtctttagaaatgcaacattatggtcaggcgcggtgggtcatgcctgtaatcccagcactttgggaggccaaggcaagagatccgaggtggatcacttgaggtcaggagtttgagaccagcctggccaacatggcgaaaccccatgtctactaaaaatacaaaaattagccaggcgtggtggcacgtgcctgtaattccagctatttgggaggctgaggcatgacagttgcttgaatccgggaggcagaggttgcagtgagcccagatcgcgccactgcactccagcctgggcaacggtgagttgggactctgtctcaaaaaaaaaaaaaaaaaaaagaaaagcaacacatgcaacattaccagtaacagacaattaccctattcaaagggaggagggtgatttccttttcattgcaatgcagctactctcttctgcctcttactttgccttgtctttctgggtcttcttgttgtactggcagctataggcctgttcttttcattgtcgtggtgacattggaaaatttgggttgtagggcaagtgttggggactgctcccaggcacatgaaagtttctccgaaccacctgatgggtaccttcagtgcaatgatactcattcatcacaggtgcttaaaagtatttgaatgaatttgcagcaagaacccttctcattcattgaacaaactccttttatttcaggcactatcatgggaccacaaaaagcaatatgactctccttgtcctggagcggcttacaattgagtggggaaaatgagaagtataaataaagaatttcaacatagaaactatatgtttggtatggtaatagttgtagaacaaagtgctaggggaatatagaaaagtgagcaattaactcagggagtgaaggagtttttcctaggggaggtaatatttctcctcatttccgggatgccagcagggttttacagcattcccttggagaatgtgacacagaaactagaagcatggtttcttcatccagtatgtcagcttggtgtggatcttaaccagtatctttttaaaagtcctttaaaaaaattactccatagcttatgtgtgtctgttatagaaacttgagaaaatacaaccgtagagaagaacttaatatgcaaaccattgcagggcctatagtattgcattttatattttcttctacttcagcagtatctggaactggacttggcagccatatttttatctttctgtaatagccatcagtatagggttttttttttgtttgtttgttttttgtttttttttgagacagaatctcgctctgtctctcagactggagtgcaatggcgcaatcttggctcactgcaacctctgcctccccacattcaagcaattctcctgcctcagcctcccgtgtagctgggattacaggcatgtgccaccacgcccgactaatttttgtatttttagtagagatggggtttcaccatgttagccaggctagtctccaactccttacctcaggtgatctgcccgcctcagcctcccatagtgctgggattacaggcgtgagccaccgtgcctggcccagaatatgtctttttttttttttaagctgctctactgttttaaggaacttagatatctggcattgcatgtttgaggctctgtgataataatgtttttatattttaatgtttaattcttggatggatcctgtagatggactggaaagagattcccagattgtccataagttcctgtagtgggaacctgggattctgaagatgctgctcccagaatggttcttggcgggacactgcagggcctggaaattgtcatctttgaagggaagaaaaacagccattatttgtgcaaaaagaaaccaaagagcctcactgcagaagtgatgggggtagagtaggagtttggaggtgatgtatttcaccaaaggcaaataatctcatagtgaacaaactcctgctttgacatttttttttctttttttttttttgagacggactcttgctcttgtcacccaggctggaatgcagtggcacaatctcagctcactgcaaccttcccctctagggttcaagtgattctcctgcctcagcctcccaagtagctgggattacaggcgcccaccatcacgcccagctaatttttgtatttttagtagagacagggtttcgtcatgttggccagactggtctcgaactcctgacctcatgatctacctgcctcggccttccaaagtactgggattacaggcgggagccaccgcatctggctgctttgacatatttttagaccatgggatttcagatcatttttagtgatgccaggatactttctgtttaaaatccatacgtgctactattttcattgaatgtgggagtgtgagaactctcaaataacctaaaagtatatgggtgatagaaagaaggtatattttacagagataagagaaactcgaatgtccttcttagtaagtgtcagaagtgacttttattaatttttacttaaaaatttaaaaaataggacatgctctttagtttaaaaaattgaaataagtaggctgggcgcagtggctcacacctgtaatcccagcatttgggaggccgaggcaggtggattacctgagatcagaagttcaagactaccctgaccaacatgttgaaatcctgtctctactaaaagtataaaaattagccaggcagaggagtgggcacctgtaatcccagctacttgggaggctgaggcaggagaatcgcttgaactcgggaggtggaggttgcagtgagctgagattgcgccactgcactccagcctgggtgacagagcaagactctgtgtccaaaaaaaaaattgaaataaatatataaactaaaatttatcctccccacttccccgcccctcccgggaattgggtttagtgtcatttacagatgtttttgcatatataaacaaacatgctgggaggaaaaaaaaaaaacaacactagttttccacaatatgtggaatgacacatggaataaaatatacctgtgtgacctttttcagaaggtagcccctaagaaacattgttctgtgctttttactgcatagtatattatagttatctttccagtacctataagtccaccttattctttctagcggccaaatggaatttctgaatgtagcactgtctgaatatagcacaactgagtcattattctcttgatagatatttaggttatctccaggtatttgctactacaagctctgctgcaattaatgcccatgtatatatccttttggagtcctacaagtgatctatttttaatgatgtatggatcaccaaggaaatgataatctgtaaaaagtgcttcaagctgttttggtcagcagcaaatagatttgggcttagggttggtgtaggccgtgactctaacagagtttgtggtttgatatctaccttctccagaaagaatatccttggttactcccttgcttacagcctttacatgtatttttttttttttatccctcttgatggaagtggtaggagggaattgcagttatcattaagtgcatctcttctgggcaagtgcccagcatttcaagctagcaggtcgctctggtttccaaaatattagcatctcatattgtttccaaaagggaacagctctgagtggtctttgtcctttataggaaatcttttgcactagctattaataaaatttacttaggaaaaactttgaatactagtcactataagagcaaaatcaatctagttgttatgtacctattgttaaacagaatgtggaaatatgttagaacttaattgctttcattttttttaaatgaaagtgtataagtggatattataatgtgtatatttgggttaataattaaactataatggaatttcagtttattagcactaggcgcagttccatattttgttgattttagactctggatgaatatacaatttgttttaaatatgaaagtacgattttctgtattattgaacacaaagaattggtttctaggtatctggtagacttggaacccgaggctttgtggagcagggtctctgcttccttcacatccataatggaccagcacgtggctattacaggagctgagaaatatttgaactgagtggcatgcatttgtctgggctacttaaaaaaataagaaaaggaaaattaaggaaattaagaaaaagatggtaagtacctaccacataggctgtggtgagaacaaaaagacttaatacacatgaaccactcagaacagagcccagcccatggtacacattcaataaagcctagctatcctgattttcagtcttaaaatcatgcctactttttagggtaacaaatttaagattctggacattaaagatgatctagtctgcctgggatccatttccttccttctgagaatctgaaatgccttcctcaggcattggatgtattaccatctaaacttccctgagatggttgttcaaaaccatgaaagtaattacagaggcagatgaaaatgagagtcacacaacactgctcttcaaaggcccttgctgacacaagcagatggcacagtggccgggatgggccagtgctgactaagagggagtgtgtcgtccgctctgtactccgcgcaagtccctgatgtgtaagggcacaggcttacaggcgtacgaattttattccccattttgatcccattttgattctgaatgcattaaaaaaaatctgtgtagcacaaaaaataatctatgttgttgaaataacaaaagtctatatgcggtagttagaataacaactagcttgggatctgggatacgtaggtttgacttcgtgcctttgcagctatgtgaccttgagtaaatatttcccttctctgggcttccattttcccacctataaagggcctaggagcctagatcatcacaagtaatttttttttggctctaatattctatgatttaaaatcttgccttggttcttattagctatgaatgaagtgtaaatttccttttctatattatctttagagcttccaatttttgctctgagtacaaaggaagtggaggaagcaagattaagccaaagataatggagagagaaggttagaagagaaaagggaaaattacagatgggcatttgggttgaggtcccctctcagacttggagtgtgtgtaggaggaaggcaggtggacgccggaccttctaggacaggcatcgaaggctggtccatcagacatgcgctttaatcagtgagtctggatcgccgaggttggtgaagcatgttggtgaagaaaattgctgatggcttagttcttacaaatgtgttacacatttgcagtacagattttggtaaatgccatggtctccagatctggcattaggcatcacagtcactcaagaagttcactttaagggacagatttcaaggccctgccactcccatggaatcagaataactgggtgagacccaggaatctccaattttgaaaagctttccaggagatgttgctctccattgaggtatgtttgtgctgtcctgtaaagcctcttgccatcttgccataacccacctgtccgatgacatctccccacccatggccggcaactgcacccacaaagaactgctcactgttttctgaaacccttaaaacccttgatccctatctgctggcacatgtgcattccaggcccagaatgtcctttccagccctccccttcttcaccctgtttgtatgcttgaggatctgctgcttgtctcccaggagtttaagagctgtatcacttgtgagacctttgtcttccctcaggaagtaaactgggtccttgctcagggcctcgggggacatgctggggtcagaggattcccctagctgtgctgtcactatcttccccaccagattggagacacctctaacaggacctgctccttcctgaggaactcactttcccagatgctgagtatctggccttcagcagggtgcagacccatctgctgaatgaacgactgcgtgcaaacagtagcttccacttttatgcagccctcatggatcctggtgggaagcccgtcagttctcgagcaaggggctgttgggatggggtcttggcaggattcctccctggagttcagaatttgaatcttggtgacccctccctgaggtcaagtctctggtgcaaaggacaactgggtagaaggcactcaccctgcttcatggatggagtggaggaggggagggaatctttcctctgaggggagaaggtgctgggttgtttgggttcccagctgggttgtttcctggctccagccagactgctcttgtttgctcctgagttttattttaaccagattgtttaattgagacttcactagcctttaacttctggattgcctttggtgttcaagcccagaactctttcgtgtaattagagtcttactatttctacctagcaaactttttttttttctttttaaaaagattgatgcatccacatgttatgggggcacatatgatactttgataaattgatataatgtgtaaagttcgaatcatttgagaggccgaggtgggtggatcacttgatgtcaggagttagagaccagcctggtcaacatggcgagatcctggctctactaaaaatacaaaaaaattagctgagcttggtggcgggcctctaattccagctactcgggaggctgaggcatgacaatcacttgaactcaggaggcggaggttgcaatgagccaagatcatgccactgcactccagcctgggtaatggagtgagactctgtctcaaaaaaaaaaaaaaaaaatcagggtaattgggatatctatcacctgaaatatttgtcttcttattactacttaccaaactctttagcctcaaactgaaaacaattttttttcaaattaaaaacatcatataaaaggcccttcttttaggtctggaactgaaaattctttgaatattaccataaaggaatgtagtcaaatttcttcatttgattaaaaataaaaaggtatatcagccggatgcggtggctcacgcctgtaatcccagtgctttgggaggcaggggccggtggatcacttgaggtcagcagttcgagaccagcctggccaatatggtgaaaccccatctctactaaaaatacaaaaattagctgggtgtggtggcgggcatctgtagtcccagctacttgggaggctgagacaggagaatcacttgaacctgggaggcggaggttgcagtgaaccaagatcgtaccattgtactccagcctgggcaacagagcaagacttggtctcaaaaaaaaataaacaactcttgaaaccatctaaactgtatatatgtgtatgtgtttgtgtacatgtatgtacgtatgtgtatccatatactttttatattgagcactttttataatctcaatcttacataaagtacaaataaaatctataaaaatgattgctatttataataataggcaacatagctaaaaactgtggttattatgtaagcatatcttcaagataaattttccagctcctaagccctcctatacacagattttagagctgccattgccctagtgggaggtgatgtaaaaaaaatattgttttaaatgggtttgtaaatgtacagtctgcttttggtctcatcattttggtgtttttccacttcaatttgtcttgcgtcattttaatttgttagcacaatgtatttagtcatatacgtctgctatgaataaaacatctttttaaaaatggcccgggcatgtgaagtttgtcttacgattccccattttttttaaagctgtcattgtttggggtgtgctttctatgaaacttcagactttgtgttgagcccaggacagtagggtgtcatgcatttttagcatttttacaactcatactatacataagaactagaaataacaaatgaatctgtatatttttaaagagtgtttttattttataaatttaaaaaaataccttgtttttgatgtttttcagttgatggagttatggttgcttatgtgtttgattattttgacgggcaagtacgtatatttaggagatttgtaaccatgagcctagcattactgctgataaaacgaatccctcctttctaatcccattgctcttttcttgatgtaaaaactgatgcctggcgacagcactgttccccatttgacaagtggccttttattattgatctttggttgggtagcagcagttgccagagagaattgttcattgtggtcaaccagtgctcctgcctcagtcgtgttttgcttttaaccatgtcttcctggaatgacacttgaaagggcagtcatcatgtgttagcccagaatgaactcaccggaatcccacatttaccaaaacatatcctggatcctcagggcaggatgtcaccagaattctataatcctccagcagggacagtgagggatatcagaattccacacccaagcatgtgtgtctgtcctgctcaggattgtcttacccctaacagagagaaagtcttgctccattcaatggggtttccccattaggctttagtgtatttccccagatgatacttgaattacatctggatgtgtgtgtgctgttccctgtctaacctcggcagccttcatcaatgccggtgaattatgcgatggtggtggcggcggcgggagcagcagcagtggggaggaaggtccaagcttggagaggatgtgtgtttttatgggtgactgagttgatttgtgtgcagcgtggttatttgtgttgttaggcagtttacataataaagtggtttactcagcagttgcccacttctagctaacagagccaccgtgcattttgtatacaagcactgacaattctcccctcttctcctcccccacctctttccatcctagttcttgcctttgcttcccatagattggctttttgttttggcttaataactaataccccaccccatccccactgccacacacacataccttgtagtcacttttggtaaaatattaacattcatgaaagaatgcagttattttagttcatgcagatgaagcgaagaatttttttttttttttttttttgagatggagtttcactctcgttgcccaggctggagtgcaatggtgcgatcttggctcactggaacctccacctcccgggttcaagcgactgtcctgcctcatcctcccgagtagttaggattacaggcatgcgccaccatgcccagctaatttttgtatttttagtagagatggggtttctccatgttggtcaggctggtctcaaactcccgacctcaggtgatccgcctgcctcagcctcccaaagtgctgggattacaggtgtgagccaccacgcccagccaagaatttttttttttttaatgttctcttgtgaagaatcatttgccatagagctatgaacttggtttggtctgctctgcccatcttagataaaaataaccatctggaatgtaaatgtgaacttgaagatacttgaagttgtcaaactagtatttttctaggacgggtctgtttggtcagaccacatagatgcctcctctgtgctccctttgaaaaagtctcagctagaaaacacgcacaaaatgtgaaagctagttggaactaaaattttcactttaacctgcgcttgtgtcctctgctgtaggaaaagtgctgttaccagaaaataactcaaggaatagttatagaatactaaaaaggtcttctgtcaccgagaatttggcagtgaattcttctgactcattttaaagacattagatttgtatacactacttcaagaaagcttaaagtgagaactacttggaagtttttttttttaaaggaactatctggtctttcatttttgagaagatacaggatttttttttttcttctgctcacctagtatctagtgcaacattttcatttttactggagacactgaatctcagtgaagtcacttgtccgaggtcacacagctaggaaggagactggggattctagcgttgggttttctattgcgtgatttcccttaaaaaccacctaagcagttgttggctctgacttcttggtttcatggtgagggagttcaaggaggacacagcataggttgtgaaaaaaatctctgttctgtctctcagccggtgattgtttacagacattttggtttgcttgtttgttaataagaaacccgtggtcatctggtttccaaagcagctctctgcttccattctggttcttcctttttctgcagaagatatttttgttttcttttagctctttggaaggggggaggctatttttgcttacattttaatcatttgtttcatttgacataagcttcttaactgtaagaataatgaggcttcaattcatttacattgccttcaattcatctacatgcacacatacgtacacacacatacacatatacacatacacacaacatacacatgtacacacgtacaacacacacacaacacacatacacacagacgtacacatgtacacatacacatacattcacaacatacacgtacacacatatatacacacacatacacatgcacacacacacgcacaacatacacaacatacacatacacacgcatatatacacacaacatacacatatgcacatacatacacacgcacacgtacgcacatacacacaaatacacgttttttgattcccaaatgtttacaattgaaatggaactcttatttctagtaaaagacactgctgtggtaatctgcagcatttcctgctgtgtgtgctagggcccagggacctcggttaccatggaaactaatatccagccgcccgggtggtacttccctttagagccgcatttgagcgcatttcacagttcaatacaatgctgcttcttcctgcctttaaaatcaggaaagggggcaaagctgattgattacaagtaaaatgaaaaaatactgtttctgctaagacagaaagggacctttaatacgcgcccttttaatctgattgtcagaagtaggacagtgcacagtttctcaaagatggccagaggatctgataaaatacaaaagaattgtggaggcgatagtaaacattcttcttcctgtgctgctgatccacaggcttctctttgagaatgactggcctgcaaggctgacaagggtgtttacccgctgactctggtggagtccatttggttcaccagaagggcttgagggcagacaaaagaccttgagctctctgcgtgtgccagtcatcctgtgtttcctgacccctgtctctctcagaacccactcacagaaccagatccgagagcctgggagagcttgcccggatttcagcccttgatttgccacttaagcacgtgattgccatctgtgcttgcttaaaggggatgctgattaggagagtgatacttcatttggataatacgatttaagcccaagtgcaagaggtgttgcttgtgctggaactgcaggaaatatgagccatgtaaacgcaccacccaacctcctgcagtggtccaggtggtcctaccggtcactgactacagtatgtctgtgtgggagatgacagtgatcccaagccctggtttccatgcaggcatatggactcctgcttaatgagattgaaggatagtaattgtctccacccttatttagatgatgcccatcgctctggcgtttgtgttttcaaatgttttggataaagcgagtgccgggagagtgtgctatttagtgagctcagtccagcctcggtcttgagcattgactgtgggtcctctgctgttggggttctcgacttgcccaccagctgccttatctcaggttgagaaaggtagtgggaaccccattttgcaaatggggaaactcttggtgacttgaagtcacctggttaaaatggcacacaactttgaagctgcctgccattttaaccaagtgtgccagacataagtttctggagtgtgtatctcgtctatgtgacactccagtaccaggttcttcccacctcagggatcagtttatggaaacacctcagaattgagaccagggcttctcaatctgtgatttggggctggataaatattagttgtgaggggcgtgttgtgcattgtaggttggttagcagcgttctcggcctctacaccctctcagttgtgaaaaccaaaaatgtgtattgagatcagccctggttgagaatcaccaagctagacctctttgggttttgttgggcaatttaacggaactctggctatgccttttttgaggcagttgtagctagcttggttcattgaagctaggtttgaaatcattcataactaagttatgatgttaggaattcgacagtccatgcattgtttcatctgaaaaacaactactctgccaagttgcacgtatacaactctgtaaagagtccacatcttactaaaaaaagactgcttcctttttaccaaaaggtcatttcccagagtgaaaatatgcaagtttttttttttgttttcagaagattaagtcaaatgagaataggaatggggtgaacagagcgcttgagttcccgttcgtgttgcgctccctgcgtgatggagagagggctcagggaggcggagctggatggggaggcggctgcaggccccctctgcctgctcacagctgtgtggccctgggtgggtcagtacagctggacacacctgagtttcgttgtctatgagatgacagtcaggtctgccgtacctgcctgtcagggtgacggtggaagtcaaatgaggtcatagttgtgaaagcattttataaattgtaaacccaggcagctgtgatgagaggtcgtggtgctcctgtgacttgggactttgggggtccctggccaccttccgactgctggctccttggtcacttagagacatggtgctcacttgcgttccgccttcaccccgcgtggcctgtcccctcccacttgtctgtctccaacttctgccgctgtttgggatccagttcagtccttgttttctcctgaatgtcttcttctggcattttaaaagtattttttataattattattttaaacaaatattttaagtatgatgtataattataatgttcaccccattattgtatgttttgtgattagatttgggggatgaatggtgtcttgaatgaatgtggggtttttggctgtctccccagtacatgccccaggtgtgttgaatatgtcattctctcctgcatcacacacactcggaatgccctctcccttccctcacctgcagactctgacttaccttccaaggttatctcaggcggtctctcctccaggacgcctttcctccttgaggggcttaggatccccgctgagagctctgcccagaatctgggcttcgctgtcgtagcactgtactgtacattacctgttccctggtctggagattctcccaccttggcctcccaaagtgctgggattacaggcatgggtcactgcatccaggctcctttcttttatttttttctcattgaggtgaaattcatataacataaaactaatcatttttaagtaaacagtttagtgacagtttggacatttttgcagtgctgtgtgacaccacctcatctaattccaaaacattttcattaccgtgaaagaaagccccgtaccgggatgatgaaaagttctggagatggaggtggtgatggttacattaacaatgtgaatatacttaatgtcacaggattgtatatttagaaatggttaattaaaatagtgaatttcttggtttatatttatttatttatttaccatgagaaaaacacacaaaaatctcatactcattaagcagttactccctgtccccacccttcccagcttctggcagtgttttgtgttttatcattatagccttagcccctaacatagtaggggccaaatacatcttctttgaatgaatggaatgagtttctacttgaacacacatttgtttatctatctaatggctatgtgacaagcaaagttatctttaagaacatttctttgaaatgtttcactagtgttttttcaaggggttttctacttatctaccagcatctccatagacatacctcttaaaccaaacctaactttgtagcttatctgcccccacttcattatctttagttgacatttggggccagtgatggaacccggtggtatctgtctggcacactcacaaagaaagtgttattaaatctctcaaatacatgtagcaggtcaaatatatgccttttcttatgatgttgaagttttcaattactgctgcttttatgagggagaaggaaaatctacccatccttttagaaatgaatgttcctaatctcattgcttccttgaaacatggccgccttgtcattcgttcttttctttatgcttgcaactcacaaaatcttgttcttttctgttgctctataatttataaaaccgtgttgcagttggcttggttagaatttacttaggcatagttgagcctttagattttccttctggcatggacaaaagcgtcattaattatgaatatgaattcctttgcaaaatgacaagattgaacatttcctcatgccagtaacccagctgtctcattctgatgtgcaacaaagactttttagagattgtttttaatggccgtggtatcagacactaaaaaataagaagcttaaaaggaatgcaaagtagcttacagttcattcgtctagaaaaaaagaaataaagaaaggtttttgctatcctgtggctgtctttactctgattgtacatttgcaatctccaagttttggccgtggctgcaaaccaaatggttgtgctgctctgctgttgtcagatacaagattctatttgttcagatgatcagtatttgagaatcctatggcccaggtcactttttcggtctccttggtttgataatggaaatgggagtggtgtcagagcccccaccgcatgtgggtaccggcttgttatggcctcaccaccatccacttggtaacttctcttattgacactggaagaggctgcaactgggctctgattccagagcctggaggcttttaactgctgtattatggggtcttggtcctgagtgtgtctgctcagccattggttgaccatgtcagtaagatggtttctgatgtttccacccgccctgtgtcttgacagatttgcagccagattcagatatggcagtgggctccttcgtgttggaaaggttgtgttgttccactccgtctgtctggatgcttcctagggcgtgtcccacctctggcctccagttgaggttttctagtctggagagacacctgtgtttctgagttcctttccagggtgtcagagaagctggcactcttggaaattccctactaggtttggatccttgcatgtacatatatctgtatatatgtgtacatatctatatgtgtatatacgtatatatctatatatacataaagctagtatttgatagtgtactgcaggctattgtaagactttgtttctgttcacaattccttgaatgaggattttggggtcattgtttttcttccattttttaaatttcatttttttaaaattgtgggctgcttcctttttaaccacatgttaaacattacacattaaacgttaaaacatttgtgtataagaaactttttttcttttttttttgcttactttaaatggaagtgctgtcacattaaacatcaggtttaaatcacatggaaataaaatggggccagatagttgaatgtactgtcatttcactactttaggaaacatcaggagaggaaccaagatggtctgaaaaggtcatagactggggaaggaagggctgggatgaccatttgtcagctttcaaaaagcaagacaaaatggttatgcctggttcagatcccagccatttttgttttcttcaagaaagtggttagaaatgtgttttggtttcagaaaagccctggttttctttgatgtttagtataaatttggcttgaaatgccatattccatcattgtcatatgtaggcatgtgctttttgtgtgtgctgtaaggacaatgtctacactgggtcatttccctccccacccagttccccttcgttgaagtaggagctgctgtttcagttagctgccctgagctggccttgcagttagccactggcccattcagcagcctggtctccccttgctgactccaggcttccttctgcatcacgagagccaaaccggccactttagcctcctgtctactgtattcttaccctgcaggaatggaggctgtaggctagagcctgcctgttccgtgaggctcagatccaaaggcttactctcctggaatggggcctctctcctgtctctgtgccgcccctcacacctgtggccttgtgcactgatggattatttgcccgaggtgaagaggaagcgttgaagggatagccgtgttagttttggattccagctactttgctgctgatggttgtgcaacctccagggacctgctatttagcaaatagggccgagcacagcctgggggaggctgccgaagatgggggtgggcacaagttgatgactagtgtccccacccctgctctgacttcacttaaagacaacccccaaaatggctttagcgtaaaatggaaaagatggtaaattattctggcgtgagggctaccctgttgttagagttaagaaagtgcatggctgctgtttaagaacctttgatttgagttgaatcccagcctgcactcttttttgcagtgtgacttttgggaagttgccttaacctctgtgtacctgttttctcatctgtaaattggatgtgataacagcacctttgtaggctgtgtgtggagtctttgagaaggtgtataaagagctttcagtgcctggttcatagtagccttcaatcgttagcttatatgaatcaggaaagctagtatttattagcacatacaaatgtgtcaggcactatgctctgggcttcctatcaattatagtaatctttatagaaagcagttttgttttgttttattttgttgagacggcattttttttgctcttgtcactgaggctggagtgcaatggcatgatctcggctcactgcaacctctgcctcccaggttcaagcaattctcctgcctcagcctcctgagtagctgagattacaggcacctgccaccacacccggctaatttttgtatttttggtagagatggggtttcaccatgttggccaggctggtcttgaactcctgacctcaagttatgcacccgccttggcctcccaaagtgctgggattacaggcatgagccactgcgcccagccaggaggcagttttgagagagatactgttgatttaaactaaacagtggtcatgtatttctatcattgaaatatatttgggatggttacatttttatcgtggatatttaaaaagacatacctcaaaacaaaacaaaacagaaactgggaatggcatagaagcagaacctttgctgcttgaaatagctccttcagcataaaacacatgtaggagtcctgaggttggcatttctctctgccgctgggatgctgagtggaagatttgttacttgagttcatcatttgctttttttttttttttttaaatgtcacagcttctctgtgttgtttttgactccatagacacatttgtctaaggttttaaaagttcagcttttcacttaggaggaagctgagctctgtaattttcctttttgcatctgacactaggacattggagtctctttcatgctgggggaccctctctactctgggctataccacttaatcctcaggtggccctgaacagattattaacttgcttaaaggtggttaaggagctcctctcctgcggtctaaagaaatccccactctggccaggagggtcttggtgaccttgccgaaccatcctcccctaggagtagagactggggtaacataaaatgcagagaagcaatgacctcaaagcagctgggtagatgtgacagctcctcaaagccttacctgttttgcctaagaggagtgtccttcattcgtacctatagaaacactacttggcaacagtgaatgttctctgacacatgtaataggttgttaagtttctctatttagagtccattggtagtcaagaccacctgggtgctgtttgcaagacataactatcatggaagtatttaatactatactattggtatagcaggtacatgatatgctattagtgctgtagaaatgttatgttagagacgggaacctgaagcccctccttgtggcacatagacaacctttgttttttcctataatcctttccaccttttccttggggtaatgcccctccaagtgtgctctcccctgggactcagctgcctaggccttccttcttagccactgttagctgagagcagaggcagcagctctggctggcagtggcccctggagctttgacatctggaggggatgaggaccccgttcggatgactcctgcccttccctacccaggctgtttgactcttgatctcgcctagtactttttctcaatatctaattcctgagcctgcgattgagttgtcctgcttggacacagcccttgtgttccacatgtgtggtctgatccagtgacaaagaagttgccatttaaacatctcatcttgaagaaccattctgcctttcatgcttcatgtattgaacactgaaactgataggagtcttagctttccctgtgtgtttccaagggtttaatacatacataatgatcaagagaacctgatttaacattttgctcaccctagtattaaaaaaaaaaattctggagaaggtaataaagactaagtttaaagaatgtcttggcagttgttaaaggaaattttaattaaatcccaaaatagtgggtacatgagaataattccatttgagggtaactgttgggtgtcctcattaaagcctatacaatgcatcgtatgaattttctcctgttgaagagttaggcagctttctatgctgtttctcctagaccttgttgcaaatgcatgcgaaattttgagattcccatatactataagtcttgtgttggcattttctgaagttcattttgggcatggatagggaaggttatgagtcaggtgacaggagtttccatatcacatccacatttgaccatatggcagtttgttccttggtctagccaacatgctctgaacatgttccacagaggactgggctggcttcttagaagggctctagaagcagatcaggcaaggattttggcccagtggggccaactgtccagaatggaagaccgtgcatgcaccttaatatgtataactttctaaaagtcctaatatttgagcctcactctcaggtagactgttttactgatccgagatgggacttgggcatcagtatgttctaaagcttccaagttgagtctaagtatagccagaattagataccactgcctagaccacgagcattggagggtgataacacaagacccttgtgaattttcaaatgctaagcagccactacagtgtgcgactgcagtgaggatggtcatacctacctattagagcagttgcaaggattaaataaaacctttggttaaatgaagagaacaaacccaagttgagatgccagcactaggcttggcttacttcttagctaaaggacttgccctcacaaaacaaccttgcctcctctaggattcggatcttgtcttggccaaaccgtaaattagcacttgctgtggaccagagaacttctgaatagcgccaaccatgagagtttaagccttcgaatgccaaggatctcctgaattcatgctccagagctactcccagacttacaggttaaagtggaactggtagtggggaaagtaaagaagggataggtgttttatagtcgaaggagcatgttaggcatgcctgtgtgtttctgctgaaaatagctaacgaattggtctgcaggttccgtgatggtagagactgggtctaccttgttcatctttgtgctcttgcagcccagtacactgtagtagtaaaacctttgttgaatgagaggatgaattagggcctaccaggctgatagggcttggctgtgtccccacccaaatctcatcttgaactgtagctcctataatccttacgagttgtgggagggacctggtgggaggtaactgaatcacaagggtgggttttcctgtgctgttcttgtgatagtgaataagtctcacaagatctgatggtttgataaagggcagttcctctgtacacgctcttttgcctgccgccatgtaagacgtacctttgctcttcctttgccttctgccatgattgcaaggcctccccagccatgtggaactgtgagtccattaaatctctttttctttataaattacccagtctcgggtatttcttcatagcagtatgaaaatggactaatacacagaccctgcactcaagtggtggggctatttgagaaggatgtttttaggtctcctcttaactggatagagaatttggagaggctgattagtgttccccaggtctcagagctaaagagcagaaccaggatcttaagtctggaattattcctgtgatactatgccagcttccttgccataaatatgtatactatccactggccaaactcatctctaaaatgcattcagtggatgaaaggggatcagctgagatcatggtttgggagggatcagtctcaatttgtcaccttcatactgaagctataacactaaaatctctcggggatcaaaatgtttgggggaaaagatatattttgatgtcctttctttctggcagcatgaccagtactagacacgttagaggcatctagtgagtacttactgatttgattcagaaaataggagtaactatgcttgaatttcttttatcaaagagaaaggaatgaaacatttaacttttagcagtaagcaagcatattttaaaatttgtggtcctctgccaacaggtgactaaaggactctttaaattttcttgagattcacagaacaggggtaggtattttctttctgaaatatgctgttgtaatgtccttgccttgttcttttccggtttatgcagaactttaaacctccctcccctataaataaagaaaaaaaccagatacaccatatcctaaaaagttagcatccatgatttaaagaaggggtaggcagactacagcctctgggccaaatgcagcctgctattggcccatgagctaagaatgactattaaagagttggggaaaaaaatgaaaacagtaatgttttgtgacatgcaaaaatggtatgaatttcaaatgtaagagtgcatccctaaagttttatgggaacacagcccattcatttgggttttgtctgtggttacttttatgctacagtggcataggtgagtagtcacagcagagaccaaagggccctcaaagcctgacatgtttactaaatgacctttcctggcagaatgtccctgatttcactttaaagcaaagtacccttgggagggaagggctaggggtgtggaggtagaggtagaaaatatatttcctcttaccttttccttgcctttggtaaaatttaagtgttcaagattaatcttaaaaaaaattttctccctgcctcctcctgatttgtgtacccctgaactgagggtcttgattggggaagacaaaagagagaaatgaacaattggtgatcgtggagaccatgagaaggaggactttggtatcattccagccagagaatttgtaggcttagcactcccttttttttctgtgtgcctttaaaattctcaatagtccaattttgttattttttgcatcacatggggaacacagtatgagaatgttcatctgactgactttattatgtatacaatgacgagtattggacatgacacaatgcacagtgccaagtccttttcatcagcgtgtgttttgtgcccgtggctggctgattgatgggactgggtctggcaggcctggctcctaaggtgagattgcattttgccccttcaagtaacctactgtgattgcactcgctttatactgaatttgaagccccaaaccttggattaaaaaagaattcaagggaacggagaccttttcacttgatacttgaagattcttaacacctagagggagttgagactctttgttttgctgagaagttgtcttggaagcagtgacaatattgatgttgacaacattagcctctccattacctgagtttagatttgagcacgttctttcatttgcccagacctgtagcagagcagcagaaggctggccaggttgcctcacatttgcgtctgtccacatgaggttttgagctcagagtctttggatggtcgtgagatcttgacttgataaaaatggctctgttcaaagaaaggtctgagtgttctggtcactaaattagatggcaaagatttggagatgaagagctttgctttggtctttcctgtatcatttttctttccatgtccctgcagtgtctttactttttaaagaatttaatctttaataccatctttgcattttccatgcatgttaggaataatgtccagttttgagacagtcctgttacacattctgagttatgattaatttttaaaaatcaaattattaatcaatacctttttattccttcacaaacgcttcatgtgcccgacttagccttagaagttcttcattgtttttcttattataaaagtggggtgggattagaaagtgatggcttaatgaggaaggaagcacagctcaaatgccattcatatgaccagggtctacctcacatacttgttagaatgaaatgtgaaagtgccttaaaagacgtcacctgctacatgaatgtctaccgcaacattattcgtgataaccaaaaggcggaaacatctcagctgcccattactggatgaatggataaacaaattgcggtatgtacataatggaatattattcaaccgtaaaaagggacgaagtgcagatgctacaacttggatgaacctcaaacgtgttagtgaaagtcaagagacaagaggtctcatatcatataattccacttatggggaatgctcaggataggtaaatccatagagataggaagcagtttccaggttgccagaggttggtgagagtagggaatggggaatgactgcttagtggccatgggggtttattttggggcactgaaaatgtttttgaactaggtagaggtggtcattactcacattgtgaatgcactgaacgcttctgaatcgttcacttcaaagtgattttgtcttatgtcaatttcacttcaaaatataaaacacacacatgcataatctgcatcaatgtcactatatatggtacaccctattcatcaccaggacctgtcagcctggatgtacttggtccccaaccctgtgtcagagggagaaccaaacacacctttacacataggggacccgaacagagctcaagggcaatggaacttgctcaaggccaagtcattgggaagtgacagttgtaggactggctcttgggttttcctgttttctatgcatctttattcattatttctacatggtgtttgctggcaggggaggctgacacattgggtagactagtgaaagatcagtgttcctcaagaagcttctattctgcccctcggagggcagtcaaagctcctccacatacctgctgtgaagcggaggctagctcagccttgttgtttcctgacttcttggagctggctttctctgtttgaaaacagaaagagcaagaatgttaagagggccggacatggtggctcatgcctgtaatcccagcattttgggaggctgaggtgggtggatcacctgatgtccagagtttgagaccagccaggccaacatggtaaaaccccgtctctactagaaatacaaaaattaaccaggcatggtgacatgcgcctgtaatcccagctaactgggaggctgaggcaggagaattgattgaacctgggaagcagaggttgcagtgcgttgagagtgccactgcactccaactcaggtggcagagcaagactctgactcaaaaaaaaaagaatgataagaggacttacctcataggatttttgggagtttttaaccagattgtgcagtgcctgggagaggtttaataaatgtaatctggccgggcgtggtggcttctgcctataattccagcactttgggaggccgaggggggcggatccctgcggccaggagtttgagaccagcctagccaacatggcaaaaccctgtctttactaaaaatataagaataaccaggtatggtgatgtgtgcctataatcccaggtacttgggaggctgagacaggagaattgcttgcaccaggaggcggaccaagtacatcaaggctgacagctcctggcgatgcgtggggtgtaccatatatagtgacgctgatgcagattatgcatattttataattgaagtgttttttataattgaagtggaattgacataagagaaaattaatcattttaaagtgagtaattcagtgacatttagtgcattcataatgtggggtaatgaccacctctaccaattcaaaacctagttgcagtgagccgagattgtggcactgcactccagcctgggcgaccgagtgaggctccatctcaaaaaataaaaaaataaaataatatattctgtacctgccccttagacagtctggttcattaagtttcttggaaaggttcagggaagagccttgtgccctccgaggtgaccgggtgagatgtggtttggagccccttccaccctggatcatgctgcagcttggatcattgaccctgtctcctgctctctgaggaagaggacccttcctgtgtctggagcaagggccatggatttcacagttgggtggcactgacaaagctgcaaaggctcgatggctttattagcaactcaccttgtgccatttttcaggtagatctggctgttggttccatgaaatatgggcacgttggtgaaatactcttaggcttctaaaaaagagaaaggaaaaaaaagaaatagtgctttcctctgctcgacacaccacagttccagcttcaggatgccctaacacaaggcaagagaaacgtgcagctttgaatctgggtctccttctcttcttgtagtaacataaattgacgcggcccatctgtgctgcttcagaacaaacaagaatgaagtcatggtgcttaaaatagcacagggtggagtggctgagagcaactctcactcttccacctcccctggggactttcacgcagggttttggaatggtggctgtgggttcggttcccttggcaccacatctgggtcatgcatgtgcttgtgaccagcttttactccacgtgcaggcagtactcttaaagagtgatttttttttttttttttgtgagacagagtcttgctctgtcacccaggctggagtacagtggtgcgatctaggctcactgcaacctccacctcccgggttcaagcgattctcctgccttagcctcccgagtagctgggattacaggcgcctgctaccattcccagctaaggagtgattttctctgagagggacatttgctgtgaaagtgagtgtggtctcttatttaatgttatgtggctttcccttcttcatatctcctgtgctgtcattatgtgtttcagggccactttaaaacacagctcaccttcctaacatagtgcactagtccagcgagaacatccagaaacttcatttgcaagcttggggttaccctgaaggaaatcctcatggcttgcaagattcagttcctggggcttggctctctttcctggacaataaatgagaggtctcatttcttcttcatcatgccctttttctttctccatatatatgtgtgcatgtgtgtgtgtgcatgtgtgtgtgtatgcatgtgtgtgtgtgcatatgtgtgtgtgtgcatgcatgtgtgtgtgtgcatgtgtgtatttattttaggatggggtgttgctgtgtttcccaggctgaaatgcagtggcacaatctcagctcactgcagccttgcctttcctggctcaacagatcctcccacctcagcttcccaagtagctgggactatgggtgcatgccaccacacccagctatttttttttaaattattttgtagagatgaggtttcatcatgttatccagggtggtctcaaattcctgggttcaagcaatcctcccaccttggcctctcagagtgctgggattacatgcatgagccaccatgcccagccctttccttcccatttttcttttttttttttgaggcagagtcttgctctgttgcccaggctggagtgcagtggtatgatcttggctcactgcaacctccatctcccgggttcaagcgattctcctgcttcagcctcccaagtacctgggattgtaggcacatgccaccacacccagctaatttttgtatttttggtagagatggggtttcacaatgttgggcaggctggtcttgaactcctgacctcaagtcatccacccgccttggcctcccaaagtgttgggattacaggcatgagccactgcacctggccccttctccatatttttaagtgaacaaaaataatattaatgtgttaacactgtctttgtatgttttatagtctggatgtatcttattacttcataaatgctgaaaaaattacattcttaattagtattccttcagaaattatgaagctgcattccaactgatatctctgtggatgtagctgctggatttttcttaaaactttcacagagtattacttgctatgcatggaaacatgcaccctttatgtgagtttgtgagttgcattggttgggaaatttcctgatggtcactgaatatggcaaaaattgagcttttgccttgcctgcacaaatagtattgatcatagtgtgtttatggacagagactctcaatctcttctccttattttgataaaggaaatggatgttgatcatggtatgtgtttcctggggcagaatgctgtgttcttaatgaagacacctcttatataagaggcgtctggtgttgttctgttgtcaagatgaagtcaggtgtccagtaaccactgtttgcaaacttgtatcaggacatcttgaactaatttgctgttgccatgaatccttctccaatgtttgagccacccagtgggaataggaatgtcctggaacactctgtctccactttggtcatcttcagaaaagttatctttcctttagagaaactttgggggttgctgtgcacgccatgcaattttagagtagaaggcagccaggagggcgagactagtgaagggggcttcgtgagaaagtcgtgactttcctggcccttgaggacttggcaagtgggtggaaagagggaggacagtctagcaagaggggccccatcattcgaggtatggtgtccagcttggtacccatgcatgactgtgaggagacaggtctctggagtggagaacgggggtagaagcaatgggagaaagaaggttggtgcgggtcatgaggtcaggtgaggatttgattctggaggagggctcagtgggaaaattttggaggtcagaaatcttatggggagaaaagtatttgagggagcctagcctgtcatggtggatgtggaagggaggtcagtttagaaaggcagtggttggagcaatctaccccaatgagcttattggcattggcatgcaaaggcttttcaggaaaaaaagaaaaagaaaaaagaaaaatgttctagaagatcatagccatgatcttgatggcttcatcaggactaatcactatggaaaattaaggatgcccatttcttatatttaatgcggtagctgtgttttcttttggttgacctggccttttggcactcctgggctctgtatcttaagccattttagagaaattatttgatgtcctcagagggaggagaatgctaaaaccacctcttttaatctgcggtctctggacttttcctctttaaccactttggagacgggatgaattggtttcttagtaattaagagccaggagctctttttattgcttgtccttaacctctgacttcactgccccagtctaaacatccaaatgagatgatgttatgaaagctcttggtaagccctagggtgctgtacaaatggtgtttatctgaagctcacttccttgcttttagtcatgttgctgaaatgatcaatcctaagtgtatcatgtttgctgagctcatacatacatttgtatttaaatttgtagctttttattgattttcgagactcctttgcaagtacgacgacgtcaggagtccctaaccatacctgccaggctgtgtggggtgccgccaggctgtgtggggtgccgccaggctgtgtggggtgccgccaggctgtgtggggtgccgcccgcctgagtgtaatctcctttgccaccactagtcccttttgtttgttcaaccatattggccaaattcctttccatcccaggatcacaatatttgctgttccctctgtttggttgctcttctgcagatctttgtgtggtttcagctcaaatataacctcaggagggccttttctgaccgcccagcaaaaataccccatcctcctcccactgcacaccccatttatcctttctgttccttggcagtgttttatggcacttagaattctatgaaattcttatttgttttcatgacctgttttgcctgtttccaccctcccactagcatgtaggctccatgagggcagcactttgtcttgtgttctctgtatccacagtacctggcgctcagtaaatatttattgagtgaatgaaatgaataagaagtttacatgaatgaatgttaaaatagcctgtgcttgcagacacatcctactgcagagatatttggatgctattagtagagcaggagcaagacgcgcgtaccatctgcctttatctagtgtagggagattcctctagtgttctgtagctatccactttcttttaccagtactaaactcaaaagagtaaacattaactttgcttagccaaatgaaaccagcagattttagcacatgatctataaaggtcattgctttgctttgtgtccctgaatgtatatagacaaagacactgaatgttagtagaaagcagccagaaatatgtaggtcactgtctttgactcatttttggctggaaccttctgcagtggtcctacaaaacaaaccccaaaataaacaaaactaccttcaatatattcactagccagctctcttgtttgccccaagtccaagaaatctggccttcatctaaaggaactgttttcttacttaggatgtcaatcattaaaagtgttcatttcatgtttggagtgagctgtactgtaaatgctgggctgtgtggttgtatcagtttgtgcaaacagtaggagccaaggacgttttattcacccctgagttagcatcatttgtcacactatctcagcggagcgagacggtggacacctacacagtttctcaggctgtgctttctactaattgtttgtttaattagaaaatgagtaattatttatccagaaaatagaatccaaaaccgtggggctgaaatcttctctaattgcaccatgtgatcatgcttttctgaggattgtatttttggtgtgtgtaggtggtaggggagtcttattttgtggctggtgtttactgagagatccatcttttgctcagcacctcaagtggaacaaaatgaagtcagtggcaatcaacctgctttgtaaaaaagtttaaaagccaggtacaatcagaatatctgtctaaacagtgaggtttgtattcattcaatagctttggggacctgctacatgtaggacatcattgaaggtaaactaatgtgtgggaaagggcccctgtgtacaagaaggtggtaatggtggtttgcacttcacgggaacaaagggagtcaaaccttgacaagctttgtggaatttgctgggcaaaagcttgtttggggtgagatcctgtcgatatagctaagaatggagtttgggttctgggtataggtcagctttttgatgggtgaccaaacacactgaggtcttcattgtggctaactgctgatgccgtttcatctttcttttctggtcccgttcagaggtatgaattttcccttcctaatagccgagtctggcatgctgtcgaagagtgtcacgggtaggtgctaagttgaccttgtaggtctgttttccatcctgacacaaaggggctactgggaagtttttagccagctatgatgacagggagggaggagttcacctgtggacctggtaggggcatgaacgagaaaggcgggttttcaaacggagctaggacaggatgaattcctgccgtagatgtgagctgaggtatggaaacctggctttgtctgtctgttggatgaagcagatctggtgacacctcctgtccacagcatcactctccatgaacacacattggtagggttagggcctgaacaaaacatgcctaacaagacagggcacgtggaactgattgtgcctgtgagaaaacaaaaagcgaatcaccaccttcctacagcccacacgtgtggccgcttgcgctgtgtcctcctcagttgctggccgggcctgttggcatcttggttttagagcccagcggtggaggtgaaagccttggagactttttttgtttttgttttgagacagggtggcgtcccccaggctggagtgcagtggcgcgatcatggctcactgcagccttgaccctctgaactcaggtgatcttcccacctcagtggtcccccagacccctgccctagtagctgggactacaggcccacaccaccatgtctggctaatttttttttatagagaaagggtctcgccatattgcccaggctggtcttgaactcctgggctcaagcaatcctcccaccctggcctcccaaagtgttgggattataggtgtgagccactgtgcctggccgcttggagactttgaatcttagctcggagtgcagtagctgtgtgaccttgccaactgcagatgctttttaagtcccagtttcctcacatgtctgaaatgataataatacctcctcccggagttgttgttatttatttattttttattttttgagacggagtttcgcttctgttgcccaggctggagtgcaatggtgtgatctcagctcaccacaacctttgcttcccgggttcaagcaattctcctgcctcagcctcctgagtagctgggattacaggcatgcaccaccatgcccggctaattttgtatttttagtagagatggggtttatccatgttggtcaggatggtctcaaactcccaacctcaggtgatccacccgcctcggcctcccgaagtgctgggattacaggcatgagccaccacgcccggcctattgttattttttttttgtggtaaaatatatgtaacatcaaagttaccattttaaccatttctgtcttggccttctctcagaaacatgtcgcgctttcacagttgccctgagagggtgccagaatccatgcacagccccaggcctggtcccctggtgagctctgcatcctctggggagagcgcctccccatgagggtcatgccttctcctcaaactcaccatctcaaatcaaatcctaagatggggggaaacccagggcgtggccatctcctctcccctccacctgaatcccagcctgcttcttagatctgttcttcttttctttttatataactagtgagactagatttgtcttgggttcatttgaacctttccctgcttcttaaatgggaattttaatttctgtccttattcccgctggcttcttcaactctccccctaaactcctccattgacctcctcctctccctactgctgatggattttctttccttagttcagatctgatcacccctcttccctctttgaaaactccccaggacccccattaatggtcacatgataaagctcactatctgccaactggtatgctaaccctcggccagctgggctcactctgcgctgatgacccctcctcattctccctccaccctccctatcccatgaccaacaccctatcacaggggcccttcatctttttggacctcagaccccttcaaggaacagacagctatggactgcctccctagaaaggtacatagtcactcagttttccattcagtttcaaggggtctgtggatcccggtggcgaacttagccggatgcccatgctagaccatgcattctaagcctctttgtcgtggcttgtgccattttctcttatatctttgttcctttgtctttgttcctgtgtttccatcagtatttttcttcagtgcactttcctgtcagagttaatttttccctctatcgtgcttgtacagcacattaccagaacatctatttagcatttgtattagagttgatagtttgcatggctgccttgcccttgtgttcctgagcacagtgccttgcatgtgttatacacacagtcatgtgtccatttattcattgattcaacagtttcttaagctcttgtgagctagccacagtgcttgtcctggggctgtgctaggaaatatgatccagtccccaccccagggagatcagtttaatggagactgtaaacagataagcagaatgttatcatgcagtgagactattgaacatttactgtgtgctgggtgctaatgagcacattgtattaatatgtgtgttgtctctgaattctcacaacagctttgtgaaatagggtctaatattttatggatgaaacaatggagaccacagctaggttaagtaacttgcccaaaatcgtgagactcatcagcagtagagtggaacttcaacactgtagactgtctctgggggccagatttttttttttttttttttgagaaggagtttcactcgtattgcccaggctggagtgcaatggcacaatctcagctcaccacaacctccgcctccggggttcaagtgattctcctgcctcagcctcctgagtagcttggattacaggcatgcgccaccacgcctggctaattttgtatttttagtagagacggggtttctccatgttggtcaggatggtctcgaactcccaacctcaggtgatccacccgcctcggcctcccaaagtgctgggattacaggcatgagccactgtgcccggccttgggggccagattttttttatagctaggctgtctgagatcagcctggccaagccagggccctgtgagaggccaggagaaagaagagaggagaaaagccaggtggaaatcaccaaagtcttcctggaagagtatgaagaattgggatgaagacaaagtaaccaggggcccaaaggtgagactgagcgagtgggtgaactgtggatgaaatgttacgaactcaggtctgcggagatggaaaaaggagagaaggcagtgcccacggaatgaatcgaagagaaaaatagaattagtcactgaacagattatcgaattgagcaaatctttaaagaattccaaagatagaaatgtcttggacacagcaggactaatttttgtttcaacattggaaggcagccctgcttcttattatagacatgttcaaatagtttaagtgctggttactgaccagattatctggtacaaacatttatattacagcaagttacttaccctctccaagcttagtgttcatatgaataagatggggataaaaaaaatgcttatttcctcaaatccaagaactatcaatttagttgtacctttagtttatgtagcactaaggaaaaaaaaaatcctgccaactaaaatatgaaatgcctttcagagttgttaacatgtcggggggaaagaatgaactgtaaaatggattctaggattggtcttagaaacaatgaaatagaatagtctacttcctagtgttactgtgaacagtgccagatgtgtagcagttgctcactgtatttgatgatgaggatggtggtggtgacggtggtagtgtttgtgtagaaggaaacaggcctggaggctgaagcaactatgacttgatgtaagcaaaagctactagtcaagtgctctcgttgcggattttgctattttagagtagaggggtctcctgacacacaagagccctgttgcctgcaattctatgttaccagaggctgtgagtgtgtatgcttttaggtataatatgaccaagtggtcatatgcctatttaaaacctaaggggaaatgaagggctcaattttagagtgtggcttctaatcttgtgtgctcctaaactctggtctacatactcccaacgattaaagagacattttgcaacctgaaatggttgggttcagactagaatgcttgggtgctaccaaattaaaggccagtaggaagctacttggagaagcagcctctggcactgtggtagaggagcatttatctagagacgggcctcgctggaaggagatagccacgcctgtgtctcaggagactttaattagggccattggcttggctgccccatgatgacaggttgaacttacgcctgtggttctaagtcatgaaaccacccctgggaacagcccagcagaaccatgggtggcacctccaaggactggagagggggtagccctgcaggcgctggcttctgcctgctggcttccagctgctccctcctggggttccccacctggacctcacctgcttctcctgctgaagtgtcttctcaccgacctgggcacaggttacttctgtgctgtgctttgctttatttctcctttgtctgcagacaccactgggccagcaccagtccatcccgggtttttagactcgaactgaggtgtcatctcctgaggagcccctgtgatctgcgctcctctctgtgctccgtgatgccctaggcttctctctgtcatggcgtttcctgtcctaactttctgtctatgtgtgtgtctctgccctccttgaggaatgggaccacgtcttactcatctttgtattcactgtgcttttcctgtaggaggccatttacaaaaggacacgggaatggacagaggggcaaaatatcgaaagctgatatttggagggtctgcagaggaggtgggaggaggatggcttttctaagtatcctcaggaataaggagccacatatgcaggggagccaagaaagggaaaaggaaaatttacagaatctattgctttaaagagtgtggggagaaaggggaggtgggacggttctactcttgaccttggtgggagcatggattgggcgggtgggggttctgggctgatgatgcatgccaaagctgggtttcctaactggcctcagaggcttccgatttgaggaagggggatgggagggccgagtgagcacaggggttggtggttttcctccccttcagaggacacgtgtccttggcttcatttgtaggtctttgccaaggtgtctatgggaagcctccttgagcaaaggggctccaaggctgtggacgtgtgtgtctgtcagtctgtctgtctgtctgtcttagcatgaggtttagcaggcagcctcaggaaaaacttacagcccgaaagggagtgtctggccatgctgctggcactccctcttttcctagagacacgtgtgcaggtgtctgagtgcaggctaagtacaagttgcccatttcggctccagaacccagccaggcagctgttggcatagcatccctgagggaggtttcagcgttgggtggggagtggggcccagatactgatatccagtgttctcacctggctaaaggagagcagctgccccttggttacctggagaaaacaatcaggaaaggctcgtggtcacgtctcggtcccttggatcattaggtagttgcccttgatttccgtgagctttatctgactgcaagggtacattacacggtccccttggataccacgacaattgtacctggtctgtttcctcccaagaattttggaggactttaaaatttaacccgtgggagggcagggagggaagtcttggtacttacaaataaaaaagcattactgccttattctcccaccccctcccccaatatttacaaatataataaataatagctttcgtttactctctagagcaggggctcttcaatgtgggagtttacctcagaatcacttgggtagctgtttgacagtacgtatgtctagaccctgtcttcagagggtgcgtcaggaggcctggggcagagcccggatcctgagtattggggaaaggctctccaggtaattgtgatggacaccctagacagagaaccactgtgttagatggaaaagcttcctggtggcagagactgaggcctctcttggtgtcctgtgctgtgtatggcatacagtattttttttattcagaagtatttattgaacatctactatgtgccgggccctggaatacattcgtatcactgttcttggtgctcctagagccctggcggaggggccctaattgtgttggatgccaagaaaccagataggcagcttctattcattctcagttgtcattggattatggtcttcctgagtggtgtgaggtaggcacccggaattatagcgttgacgttgtcctctttcccaaaaattgaacatagctcaccaagcaggggcccctggaacgttgtagcacatgcgatcaatagatctaacatgccacccctgcctttcccattaactttcaggctaaagagctgagcttgggacaagactgggctggatcatttccctttctctttaatctaaaaagaacctgaagctggctacttccttggtgttcatggatgggtgagagccatcttgagcctctcctatctgctagacacaaaggacgtgaagatgaatggagcatggccctcatactttacaaatatcatagtctaaggggagtcagaaatgcagacagatgtgggccgtacagtgtgacaggtcctgaatgtatgctgagcaaactgtgaacaggctgtcgcagctatggtgagttgtgggaaagaggggaatcctttatgggacagtgctgattggacttcccaggttcctccctagccccggcctttgaggggtggtgtttgtagcgggtggctgaccaggaaggaagccttaccacccctcacctgggctgaggaggctctgcttcgtgcctctcccagcagtgtctgcacctttggcgtggctaggactccactacctgaccctgtggcctgtccagttttcaagctgatggtcacacgtatcttcccagctgcggggctccttttgtgttcacctgagacaatcgtagcttctgtttctaagagctagtgctttgatcatgttttcatcagaaaaacatggttcatgaacttgctctttgtctagatcctgtaataatcaggttgtgcaggcatgaattgttagtaaaaattcatcagtttacagaaaaaaaaaaaacctagaagaaaataaagggacacgtctaacattggtgttgtttctgggtagtgcgtgtatggggaccattttcctaaggtttttacttttcaggttatcctttcattttggaaaaagacgataaatattatttcttaaaacctacatgtgttggtgagctgttgttactgaaaccctttcctccaaggatgaaggttctgaatgataaactttttaatgatcacactcatcccactgccctctggcatcttattggtggctgggtctggttttacttttcactgaatgttccattttctctgttgattgacgatggcctcagggccaagaggtgactactgtcagaggatacagtgtgaaccaaattgtgcgtgtgtgtacgtgtgcgtgggagggtgtgtatgtgtgttccactcggaccttggggcacaagtccctcatcctttgctcttgtgggaagacactggaccaggctgcttagtatagaggagaaccagagtatcacagggcacccaggaggaagagaggcatgggagagttgaggggcatttccatactgcactagcatgaaagctgtaccacattcagaattttagaacactgatatcatgtgcatttagaacaagcttcgtagaaatattgtggctgctctgattcctccactaagccagagcctcatatttggtgtgtagtgggaggcatctcagccccagcaagtgggagggagggttaatgctctaaacaaggaacttcctcttctgttggaggcgtgggttagtgatctgtgctgttgtgtgggaagccttgttgatttatccccttgatcttgcctccacccttcagcttgagggtgtgtgtgtgtgtgtgtgtgtgtgtgtgtgtgtgtgtgtgcatgcgcatgggcaactttctaaataccaaaatatacattctaattataaactagtgccattcgttccttgcccccaccctcccttgtttactttcttttggataaagtgctgcttctttcgaagggcccctgtttctgtggcacagcctattccagatcactcaaacgggtgtttgtgcttttctgattcctaactctgggctgccgaatgctttttcatctcctacaattgagctcagagccagagaagggcttttgaaggttcatttctgaaatgtacacatgtgtactgtcttgaagtccaagcatatcctcgggacagctgtgtggctttgagatctactcagagtggccatcctacctgccatgtttctggggggtggtacttttcagtatgtgaaaagagactgcttctaatactctatggctcttattcaagttcaagttccatgggaactgaatcacaaggtctggttttaggagtaagagagagagtcaggaagagatgattccttaccattttgtgtgcatgtatttatttctatttagttgttgtatttggactctaattctgggttgggatagccctcactgcctgaagtaattgcttcttagaaatagccactgcatttgttgctatcttcatgttacccaggtgggagcggagcggcccaggtgttgtcccatcaatgcacttgagtagagaatccaggatgaatgctaggcacattacatggtccccttggatgtgacaacaatcatatctggtctgtttcctcctaagaatttctgaggactttaaaatttaaccagtgggaccagtacagtttaaatgtattagctgcttgccagtaggagccaaatcataattcttagcctttaatctcctgagaaatgagctgagcagcgccatgtgatttttaggtagcttttctggaattagactagagtggccattcatgtgtttcaatctaagtgtttcactttaaagggcgaccttcctaaatattatcagctaaaggcataccctatatacacatgattcccgagatgcaagtcacagaaatagattgagtgtcatggagaaaaacttaataaactataaattctcagatacacagaatgtgaactgttaaattactatggtaattgataccatttagctattattatttaattatttaaagtcccctcattcttctaaacagggcagaagggtactttaataatgcactttttattgtgcattattcatttcatcgaatcatccatgattctggttatatctcaggttcttaactagtgttgagttcttgtaaaggaattgcttactgagttcagttggcaggttaatattaagaggtatcctctaaaacaaagttcaaaattgctggggtttgttcagattcatttgaaataatgcaaagattacagcaagctttataaaatgaaaattagttgaggctcctaaaagaaaagcccgtagcctggatggtgcaaacaacagaaatttacttctcacaactttggaggctgggaagtccaagatcgaggtgctggctaatatgatctggatctgtgtccctgcccaaatctcatgttgaattgtaatccccagtgttggagatggggcctggtgagaggtgattggactgtgggggtggatttcccccttggcgctttgctgctgttctggttgatggtgagtgagttctcaggagctctggttgtttagaagtgtgtggcacctcccccttctgtctctccctcctgcttcagccatgtgaagctcctagctccctctttgcattctgccatgagtaaacattccctgagacctccccagaagcagaagctgccgtgcttcctgtacagcctgtggaactgcacaattaaacctcttttctttataaattatccaatgtgttagtccattttcatgctgctgataaaagacatacccgagattgggtaatttataaagaaaaagaggtttaatggactcagttccacgtggctggggaggcctcacaatcatggtagaagatgaaaggcacttcttacatggtggcaggcaagagagaatgagagccaagcgagaacggaaaccccatatcaaaacatcagacctcatgagtcttattcactatcgtgataacagtataggggaaaccacccccatgattcagttacctcccacctggtccttcccacaatacatgggaattatgagagctacaattcaagatgagatttgggcggggatggagccaaatcatatcacccagtctcaagtatttctttatagcagtgtgagaacagactaatacactgtttcatttggctcctggtgagggccctcttcctggtttgtagacagctgctttcttgctatatcctcacgtggtggagggagagatcatcattctcatgtcttttcttataagtgcactaatcccatttgtgaaggttccactctcatgacctaattacctcccaaaggctcacctctaaataccatcacagtggagattaggatttcaacatgagaattttgggggaggacacaaacacttagtccacagtagatggaatgggacttcattttataaagcttgctgtaatttaacagcttgaaatgggccaataatgggtatgtgagctgagagcctcatgctttttgtagggaggtaggtgcctgggggcactgtgtatcatcagaaggtccctgtatcctggttaaatttggacttggtaaggaccgtgtgaacgtgctcttgtccatgatgtatgcgcagtgggcttggagctgaccccagaaccgtctctgtcacagtgttgctggtgagtcttcatgtcatgccctctatttctgctcagtgcagaggaaagtaacttctgttcacacccatatgtgactaagtagtgtgtgtcctcttcttttttttttttttttgctgactctgcctttaataacacatgtgttgagaaaaaaggaaaaaactttccattccatgttttgtggcttcattttcaacactttattatgggaagttttaaacacacacacaaaaaagacaatactatgatgaacccccacttaccccattacgcagcttcagtaaccatcaactttctgctgttcttattttcagacatgttgccccccagcccaacccctttttgtgtcctgcagtattgtaaagcaaagtgcaggcatttagtatttcacccatatacgtggatgcatggactctgctaatagattaggcctaaaaacaacaacaagaccaacccataaccacaataccattaccacttctaacaaaattaacaatcattcattcacatcattagtctagattccattttcccagttgactcaaatgtcttgcatttagttcatatgttcctttaatttagtctaatttattacagccttcctgttttcgtaaaaatgccatttactggtcctttgtcctgtagaattttctgcattctggacttggttggttgtactctcatagtatcatttaacagcttcctctatccccatgttgcctgcagttggaatacttcaggggtggctctgaaggagcaactccatttttttttcctttttttcttttttcttttttttttttttttttgagatggagtctcactcactcttttgcccagcctggaatgcagtggtgtgaccttggctcactgcaacctctaccacctgggttcaagcaattctcctgcctcagcctcctgagtagttgggactgcaggcattcaccaccacacctggctaatttttgtattaatatttttagtagagacagggtttcaccatgttggccaggctggtcttgaactcctgacctcaagtgatctgcctgtcatagcttcccaaagtgctgggattacaggcgtgagccactgtgcccagccttcattttcatttaaaaaaaaaaaaaaaggtcctggctcattgtccttttggtagcaatttagagagatcgtactttttactcaaatgccttgacacttttgtgtgcttgttttcctcctatgaatggatttaggctcatttagctctcttaagaactttattttgcaagctggtctccctagctctacacctgtcctccttgccagttcagcctttattccatagctgattttctcttcctaaaggaaagagttggttttgagttcaagtatgctagccccactacttaagctgtgtaatgttggacaagttagtgagtctgagtttcttctcctgaaaaacggggatctatctcttaagataaaggagataggaaattcaatagtgcatgaaaaggacttaacacagtcagattcaatgctcaagacacattaggtttttttctccttctgattatatcattccaagttcaaagattttattttcttctgcctaccaaagttcaacctcctaagtaggttttcttctttgagcatttcagcgtttgttatacacacatctttccagcttctgttcccctgaactctggacacactatcctaggaacacactctttactttactatggcctttgtctacagtttccctcttggaatgtggttccctctgatctctgtctgatgcttcaaggaccagctgagatgctaccctttctcccacatcctcccatccctctttctctccccaatcagtaagcagcctattgcttgggttcagtagttccacagtgctttatatgtgccactgtcattgcacacatctctctccaacttgtattatgggtgtggctgtaagagtatttatctcccaggcagctagtggtaaaaagacagaaagctttcatctttatctttgacttttgcagagcaagtccgggctcctgcgcatggcgtggtgccagatgactatttgttgagtcgtatggattctgatcactctcacctgtgtggaggccactgtggcaacccctccctgttctgctgggatgaggaagggcgtatctgactctctgtgctcttgggaaccccgtgtacctccaggcctagcaaggggaagtctaaaccaaagatgccagaagtacattgtctttgaccactaactgttgcaacagagtcagcatctaatgtgttgtttcttagagttatttgcaatgactttgagaacaaaagctcccctgggagggtcagcagacttggtgtgtgcaccaggcagggctcctggcaggcctgcccagcaggtccccaagcgtgggcctgagccccgacagcagttgcagccacagggcatctgcagttatcaaaactctcatctgtacatcattttccaatccgtgttctgctctgctgtttagggggctagagagcagaaaagagagggtggaaaagtgcttcatttgggcagtggttttatgattaagaatagagtgcctttgatattaaagcaatattattaaattattaaattagttagaagtttcggcattggaaaactagagcccagtaccctattgtgttactttctaactttgtggccttgggcaagttattgaaattatctgaacctcaggtggttctttgctaaagtagacagaagatacttcatagggctgatgaggaatgtaaggaaattttaaagggctgtgcacgttgcttgtaacgtttactaatgggtacattacattatgcttgtcagatagtcatgtgagttacaccctcccttgttggtaacgtggttgagacctggaaatgtacgcagctggccaaggtcaccttctagtagcaattacgctgggttaggatcagtgttggtgacttcctggtgttcttggcataaggatatacatcatacttcatgtggtctagtatgaacctttcaatgtttatacttcatgaaactcttgtttttcttaaaattctccagaattttgattgatcatttctcctgatctttgaggagggaggaagaacttctctgctatagaactcgttaatatgcctcacattttcagaaagtcctctcaccgtggaaagtgacagaggtggagagagtggatgggaacatgtgcttctgtgatgctttgcgtgccagggaattgtttctttgctaatgatctgtgtcattaaaatgaacactggatgagcgaagacggtgaaacatttaactgtaggttaataattcatttagcaaatattctaaccttcaggattgtatcagcagctaccatcaggagcgcttcaggcctgtccctcctttctttggagtcgaggcttgaggaacttgctcctcccacagctacaggtcagcgacgatgatacacctcattaccctcgtgtggggtagcagtaagacgtttccagaagcatccgtctagcaggagctctggaatgtaagtaacccaagaagtggctgttctgtaacttctctgtgatggaagtctgtgataggaaggaggccttttcctgcaaccaggatgtctaaccgcttcctgatgggcatggaggggatcagtgagttaaagtttccggcatctgttgaatgcgatttgtgtctagtagttctgtcgattataggcatctcccagcagcctcaaggaaagtcacacatgcttgtatatcctagggggaaaagggagatatttttatgcaaagtaaatgttatgaatccctgttttatttttttgtgtttgttttgttttgttttgttttgagatggagtcttgctctgttgcccaggctggagcgcactggcgcgatctcggctcactgcaacctcagcctcccaggttcaagcgattctcctgcctcagcctcccaagtagctgggattacagacacatgccaccatgcccagctaatttttgtatttttagtagagatggggtttcaccatgttggtcaggctggtctcgaattcctggcttcaggtgatccacccgccttggcctcccaaagtgctgggattacaggtgtgagccaccatgcccggcttgttttttataagttagcaaatatgatcttttctctggtgatatgccaacatagttgtaatgaataaaatgttacagaagacataacatatgaaaagttattagctaactattttatttcaatgtgatggactaaaccacacactgcatttaggcataactttgagctgatgacttcctgtactgtccccaaccaattgtcacccctcagagggctgccacactaccctcttgttggcacaggaattggttggtctgggcttttaaaatcagattcatctttctgaattccttcctcagtttctttcccatctgcctagctcctgtgccccatccgggcattccaggccaacccccaagtgtctggccacggaagtgaatatgtttgggatttaaatcatcagttgcctttgaaagtcacgctgcaatagacagataacttggaatgcaggtgaggcagagaattcactgccatcaagtcgcagtgtaaataagatcacagaggtgatgataacctttcacgggttgatgataggttaatgaaaaaagaacttcagagcattttaggtggatattcgttaaagcagactcagtgggatcactctttagagttgctcttgatggctgtgtttttttttttttttttttgagacggagtctcgctctgtcgcccaggctggagtgcaatggcacgatctcggctcactgaaacctccgcttcccgggttcaagtgattctcctgcctcagcctcccaagtaactgggattataggcacctgccaccatgcccagataatttttatatttttagtagagacggggtttcaccaggtcggccaggctggtctccaaatcttcacctgtttctttttacgtgactgtggcctttagaaatttttaaacgactcatgtggcttacattgtggcttgttttgtatttctgttgggtattgttaatgtatagaagacattcctcggctgggcatggtggctcattcctgtaatcctagcactttgggaggctgaggcagatggctcacctgaggtcaggagtttgagaccagcctggccaacatggtgaaaccctgtctctacaaaaaattagccaggcatggtggcatgcacctgtagtcccagctactcgggaggctgaggcaggagaatcacttgaacctgggaggcagaggttgcagtgagccaagattgtgccattgcactccagcctgggcaacagagcaagactccctctcaaaataaataaagaagacatttctctactggctaagaagttggaataaatgtttaccgagtcccatccaattattaaacagcttatgattcttactaaacagggaggattaggagaagggaacccctggggtggttgaaatgggtgaatctagccaggagaaggtttccgaggggagaggtggccttggaactgagttttgaagttggagactgaaaatcctttagggagaagaaaattgacacaaccgggctttctgacagacaaggactggcccacccctgcctctaaggaaccctggggtctgggagaggacccaaaagccttcttctaggggagcacgcctggcagctctgagatatgaaagagagaacccagcaaaaacaggatgtcactgggtcctcgagtctggggatcagggtaacccaggctcagtgaatttttctgtctctgagcccctcagatgaattagcgagttcttcagggagggtctttttctccatggctggtactgtctgactgggtggagacttatgtcccaggaaaaccgaaataactgcttttcttgcaaatgctttcacatagctctttatctggtctgtggtttcagggaagggcccttctgcagtcaggaattgtccccagcctttatttagagggctaagctagggaaatggttctgaatgtaacatgtttctaactgtagtaatctatgcccctccccccccaccaaaaaaaaaaagaccatgtggactgtatttggtagccataggtaggtagagcagtaaaatacaatttatatgattgtgctgtgtgtgctgtgtatgtcaaagcatgctcttcacacggcatgtcacgctcaagttcttgaactgccacacgtgactgcctggtgctatcagcatactttgtggtatgttatcagctgaaaccagaagtctttttgaaaaatgtcattgttgcatggggctttaatactgaaatcctaggaggtggcctttcttaggtcataattttttaaattgctgtaatgcatgtttaaagaacgacagtacacacgagaagacaaaaagtggcctgaagctttgggtggaagtcaggtagatttgattcagcaagtaatagaagtcaacatttaatgaacacttgctttgtgccaagcacactgttgtaagcactttaaatatattaagttatttaggtctcacaactttgtatgatagtttattatttccatttcacagataaatgagcttgggcacagagaggtaaactgatgtcctcaaggtcaacagctactaggtggaggagttgaaatttgaatccgggccatacaccattgttaatcgagcatttgtgttaactaccaagtacttactgggccctggggatggctctggagcagtggataagtcagatagctccgatccttgcttgccaagccataccatcattctcagcttcagtttccccaaccgtaaaaccagcacccaaaccctgccctgcgcacctgctaagatttgtttgttaggatcagttgcattaatgcaggaaaatgtgatgttcgtgcatggcagaaggctgggttgatcaaaggctatgcatagcttccatttgcaaatgtcaggggagatggggtaaaaatggaaggatcggagagaagggcgaggaaacgcggcttctctatcttagcacgttctcaggatttggttgtgtcaggtccctgccctgcgccatatatggatgatctcattcttgtccatcctgtgtgttctgactgaagtcacacctagcatatgtgggtgtcaagtcagttgaagcaacaggagtgtggtttcacagccctttaaaacataagctctttggctgggcgcggtggctcacgcctgcaatcccagcactttgggaggccgaggcaagcagatcatgaggtcaggaattcgagaccaatctggccaacatggtgaaaccccatctctactaaaaatacaaaaattagctgggcgtggtggtgcatacctgtaatcccaggtactcgggaggctgaggcaggagaattgcttgaatctgggaggcggaggttgcagtgagccgaaattgcaccactgcactccagcctgggtgacagagcaagactccatctcgagggaaaaaaaaaaaaaggctcttcagcgcttctgttggcctgtgtgtagtttggccactgtctgggaataccttgtaccaattgctgtctgttaaaaggatgaaagatacaatgttcggagacagaccctgggtgacaatgctcttagtcttttccatatctaggaggctgccgtaagtttgataattgaaagattccaacctgaaacagctcagtgtttttccccaagcacaagaacattaagtcctgaccttgtgcctttctatgactcaacacagagagagccttgcgtcctttcttttggttgtcgtgctgagtctatgatcttttcgaggtcatagcagtaggaaccttaatgactgaagatgagtattgcagggattcacattagtcctgtgttctttcttgagtaacagtggtcagtagggtcattaccattaatggagcaccttgaggagtaatttgcctgtgccgggagctttttgtgtactctgtcttggctgaccctcaagacagccttgtgaagtaggtattgatgcctgaattgtatagccagaggtgccaaggctcgccagggtcatgtgattgtcacgaaagctggtcaggaagcatagctcccatctcagcgcccccgactccatcgctgctctgtgctgggggtttgttcagggaagggctgcttcctgctgataatgatggacacctctccttagaggtttccatgctttgtaccacacagggaaaacttttactgtgaaaggccacacagtcaatattttaggctttgcagactaccgtctctctcacaaccactcaacactcccattgtagagcaaaagcagccctagataatagataaacagatggccctggctgtctttcaataaaactttacttacagaaacaggcagtgggccggatttggcctgctgccatagtttgccagctcttgatttagggtttggtctaaatggaaatggttattgttaatactattatttttggaaagtttatgaaggatggcaggttgcccacaacagatagaaagggaaactctctgttttggagaagattaatctggatccattcctacttggagtatgtctcatagaggctggatgttgtagagctccttgagggtagtcccgggtggaccccatagtactcgatgagtgcagacctgggcccagtgggcattggataaagatggcattttcatcatggcgtactgatggccttgtggtgtccatctcacagcagtccccatggccttggattctcacattttctcacttacctttccttggaacaccgtctggtcagtatctgggggggggctgctatttgggatgaagactcttcctataatcctgagcctgagaggagagagtagggaaacggctggactttcttggagtcactgtgcttcccaccaactttgatgtggagacccccaagcctttccaaggtaatatatctctgggaaatagggctcccttttacaaatgctggctttatccctctactaaggagctgtgatgggctgctttgggggcctgaggagttaggggagagagggcaaagtgagcttccagtgagacgaaattcattgttgatgtggtgctgcttggaggatgtgaggttttcttaagcaactccttattttgtagcccacccaaaacttttgtaacagaagagagctaaagttaaactgcacccaaagagtccattgttggtgtgttgaaatacttaaaaaaaaaaattcaaaaacactaggtaatagtaacaacaaaccctttcaccggatcactcatctgcttctgaacatcaactcataatctttggagcaactctggtagctccttggtattcttttgccccagttttttcctctgttaataaaaggctttgaaatgctgggatggggtgagtcttgccacctcttgatttcagacattaataaagaagctgatggtccatgcccaccataaataggattgcagaggctatagaggctaaatctgctttaggcctgctggtaaactgtattccccttgctactcttgaaacgctaggttgattggagacatttgtttttaagattgagttctctcaggacatgaccccactgttggtgatgggttggatcacacagcccatggggacctgtaggtggctccagaggttcttgttcggcctctgattttagagagttctggattttaatgcacatgacttataccttgatcctgtgtcctgttatcaaggatacgtctatatagtcattcaggtatttcaaggaacttgaattgccttgcttatttttatagctgacgagctgtaacaattgaagaagtgagaaatgatttaattcttttgaaatgagctaaaacatgatggaagaaatagtaatatttcaacatgccacacatctttttttttatattagaacatgctttattgaggataaacactgttgttagctaaaagtacaaagttttaggatgaataagttgtggagatctattgtatagcatggtgactgtggttaataagaagacttgaaaatctctaagagattagatcttaaatgctctcactacaaaaaatatcttagtcgttttacaacatatacattcatcaaaacatagcatgtatactgttaacacataacaattttaatttctcagctatacccttaataaagctaaggggaaaaaagaaactttgatatctaacaaattccacccaaaagaatcgtatttcataaaaaaactctaaatctagatgtatccaaacatgaattactcagcacatacataagacataaatagtatgaaaatgtactttgaagtagtttttgaaaatgtaggtaaattccttttatttaaagaggaatgactgcgtggtggctcatgcttgtaatcccagaactttgggaagctgaggcgggaggatcacttgagcctaggagtttgaaagcagcctggtcaacatagtgagaccccatctctacaaaaggaaaatttaaaaattagctgggtatggtggcacatgcctgtagtcccagctactcaggaggctgaggtgggaggaccatttgaggccagagttcgatgggaggaccatttgaggccagagttcgaggctgcagtgagccatggtagagccagtgtactccagcctgggtgacagaggaagactgtcagagagagagagagagaaagatgtaatggtgcagattttttttttttaaccatgaggaaaatagcttttagctgcaggttatacaacatgtttatttagtgaaaaataggtgatacaaattttccttcaagatattaagcagtagctttctaatggctctgttctctgtggatggtttaaaactcacgggcattttgtcttttaaagcacttgagaaaccctgctttcatcacatccaaattcttctgtcttctcagtaatagtttaagtttctagggatcttgctattgcatttcttacaagttgtctaaattatgaaactgtggatataacttgcttttaaaagtcagtagaagtgtaagagatgccttatctaaagataatttgagaagcagcaagactcagttattctttgtgacccaggaaaatatttttagattttttaaatgaatgaatggtaaataaatgactctatggtcatttatttaccaagagatgctgattagatggcagttatattcattattacatgttctcccgattgtgaagtgttcagtatgtaactggctaaagatgagatggcacagccattgaaataaaagactaaggcttataatcccatttataatcccagccttgctaatattccagtgagatggacagaagaaaacacaaaggaatttgattcctggtttcccaaaggagcctagacaagttgaggtttcagcgtggcccaggaatgcctttaaaaaatgagttgaatacaattttttaaaaccctcactgtccattaagtgtttttaaagtgtgttttattttacatacttttttctaaatagacattcacagtggaaaggaggggagaaatacagcaggaataactagaattcatttgcatgagcagcttctgaaggaagatatcatagtttctttgaaatcgggtgagagaccttcgtgccctgaaagagcaaagattgttgctgtcaccacttaagccgaggaagctgggcgagggttttgtctctttgggaacatgggcaaatactttcattaacagcttagagtactcaaaatagtaagatgcttatgatcctttttgctttctggatacgcatgataaagggtttaagtcaaaggttggagcttaaaattgaaaatcatgctgagcgtcaaccgagaaaatgagatttggggacagtagttcaaagaacagaaaaaagagaaaagcttggtaaactggtgtgctttaagcttgtgataccccagcggaaacatatccgcatagctgttctcaaatcagcgtcctttggattctcgtgggaagaataatttgagtttatcctaagatttttgccattgatagggatcgtgaagatgggactagccacccaacattcattggagccttatattttcttctacacattgaaaattgtattttcttttaaaaattggtgacaaggtcttgctctgttgcccaggctggaatgagtagcgcaatcatagctcactgcaacctcttgggctcaaacagtcctcccgcctcagcctcccgagtagctactaggactacaggtgcacgccaccatgctggctaattgtttttcgttttttcgtttttgtttttgttttttgtagagactagggtctctccatgttttccgggctagtctcaacctcttggcctcaagtgatcctctcacctcagcctcccaaagtgctgggattataggtgtgagccactgcacctggctgaaaaatgcatttttgatgcactattttgagagggtctctggttcaggtgtttgaacagaaatgtccttctctacatttgggcctcaagacctatcaatgccacatatatagtaggcccccagtaaacgtttatggctcaatgaatctgtgtatgacatacctaatttcattcagtttatccagctagacattttcttagaaaaatgacttaaggggtggacacaaattccataaaatgttttaagccctcttatactgaatcataatcggatgacttaggtttctccatgtccatttggaattatctcctgatttcttcataacattctgccaatagtattcagacctcagggctttgctcacagcctctgtagcagtgttttccagtttgacatttgcaggttagatttaggcctggaaaccccaccacgtcctgctcaagggacctgaagtggagagagcaggtaaatatttagacaccagtactatttagcaaaattggaggcttaaatgtaatttccttgtttcattcacttggtgaaaagattaattatgtttacgtgatgctaaaattaaattgtggtaatatgaaaatcagacagctcagaactcaaatggtaaatgcatcaagaatctgttctctaaaatccattgtggaatgagcttggtgtgaagaaactcattaattagaaattctttcttagagaatgagcattctaccatgttctgctactgtctagctggcaattgatctcagggactttggagaaccaagactttttcatctgtggttgagatcaaagaagacagagataaggttgccaaggaaaccaaaatgctacagaattatgtgctgctcatgcatttcaatgtggtttgaggtttgggaggctttcttttttttcttttggcacaaataatagtacatgaaaatgagcaatgcccatgttcccaggtcttaaaggaaatgaccacaggcttaatgtaactcaaaccgtgggcctaaagggaatcctattctttctcttctttctgtactcaagcatcagcaattaatggcgtgcttccagttggcttctctttagtgtgctttgtccctctccatcacagacacatacccacacccacaaactttttaataactttttcctgactttaaataaattacttgcacagaatttcaaaaatacaaacaattctctgacaacatataaaagttacctgtaattttgccatttggaaatacctaatgtagtattttgttgtacttttctcctaatatttatagacacaatgggtacatactattttaaatatatttataacatgaaatcccaaagttttgagtacagattttcgtggttttttttttttttttttttttttgagacggaatttcgctcttgttgcccagggtggagtgcaatggtgcgatcttggctcaccacagcctctgcctccccagttcaagcgattctcctgctgcagcctcccgagtagctgggattacaggtatgtgccaccacgcctggctaatttttttatttttggtagagatggggtttctccatgttggtcaggctggtttcgaactcctgacctcaggtgatctgcctgcctcggcctcccaaagtgctgggattacaggcatgagccactgcgccgggctagatttttgtttttaaatgatcatattgtaatcatttttccgtggctgcaggaacaactcctatgaacacacaactgtttatttggccatttcccccactgttggttatcttttgcttgtagagttccagtattctaaatgatgctgcagaaggcattcctgtgcatctttttgcatatcttatttccctaggatggagtcctcatgtgggattgccgagtgagggccgtaagcatttgtaggcttctgttgtattgccaaatgcttctttggaagtcttattaacactaggggttaccaatttttttctctctgccaaattttattgatcaaagatactcagttttcccccttaattatgcagagaaaaagaagaatagcagctaccatggattgagaacttattgtatgtgctaagtctgttattgttagttctcacaatggctggctcaagtaggtttcattgctcctgtttcacagatgagaaaactgaggtttaacaccgtgcttaagaacccagaagagccgggcgcagtggctcatgcctgtaatcccagcactttgggaggctgaggcaggcacgtcacctgaggtcaggagttcgagaccagactgaccaatatgactaaaccctgtctctactaaaaacacaaaaattagccaggcgtggtggcatgcacctgtaatctcagctacttgagagtctgagccctgagaatcacttgaacccgggaggcagaggttgcagtgagccgagatcatgccattgcaatgcagactgggcaacaagagtgaaactcatctccaaaaaaaagaaaaaagaaaaaagaaaaaacccagaagaaacatggggctgtcttaacaactcatatttccaacttaggtggatcaatataaatatgttactagctaaggagatgcctagagatctaatagttgtaaagcctccttggacttaaggtgggtgattggcaggaagatgggagctaactgaaacttcaaagggtaggctgactttgggctccttctgttgaaaatggagatgtttttctttccacagtatagtgtcccctccctagtctttgggtgtgtcatcctagcatgtggagcttttgtaaacagaaaatttacagtgagtgaaagctttatctgctgattgattcgttaaattaaaaaaagccttcaatttctgcctactttccattcctatcacatccacaattgaaagcatgtattctgcacctgcctcgtttcagagtttaaatatcttctcagtgaactgcgcctgttatgaaatgctaagtacttgaaaccaaaaccacatggtggttattctggaactgttttcctttcaacttttggagactttctatttactgaaaactaagggtaaatgatttatctttttgctggatttagctgtctataaatttctctgtgccttgaaaaaaaatcacacttattctaatgtgtcctcattcttaataaccacaattggcgggaagaggggaaaaaagatttatctgccagtgagccagttttttgtttaacatctgggtctgatactttttaaattctcttctgtttatctcttccttttattcctactctggtctctccatgcttattggtaaaattagaatttattttcaggtggggaacactctgactccagctacagatacttgatttgttttaggggggccatttgagccaagcaaggtgataaactgaaggatttttacagttctgacatcagaccatctgtccgtctttctgtccagccatcagagcttcttacttcacagcatgttgctaggcactgtgggagagagataccacgataaatcaggtaaagagcccgtttattgagtaatttctgtgttccaaggcctgggctgggcactttccatatgttcttatttaattcctgcagcaactgcacaaggaatcttgttttaactgtacgtttcaaacaaaggaattgaggctcagagagaccctgggactagaaaagacttgtggttatttgaacccatcttaattgtgtctcaatccttttattcttttctctaacacggctttattttctgataggaatgttcactgttttcccaagttgctcacaggtatatggggattggggggtctggagggagctctcttaaccagcctgcactgggcctgctggccaaagtgactgtggtcttccattcccctggtccatttgacccatcagggcactgggggctgtgatggctctcttccttgtcccctgccatgtcccctcccccagatgagctctgtgcttactgatcagttgcgggttttcccccagacttgtttttttttttttgccacatgtacttgcttttgtaattatgtaaccaaaatagtacatacacggatgacatattagtgtgaaaagagaactcgtttttttgaaaactaagttatgtgttttggaaagagttgcaaaacaacttataaagaaattcctgttgtttaaggtgtggttgagacaatcagtataaataaagaggggatggtgtaggtaaaatctagaagggttgaggccgggcacggtggctcacgcctgttatctcaggactttgggaggccgaggagggtggatcacgaggtcaagagattgagaccaacctggccaacatggtgaaaccccatctctactaaaaatacaaaaattagccgggcatgggggcgggcacctgtagtcccagctactcaggaggctgaggcaagagaatagcttgaacccagaaggcggaggttgcagtgagctgagatcacgccattgcactccagcctgggtgacagagcgagtctccatctcaaaaacaaaacaaaacaaaaaaatctagaaggattttctactttgtaagtagtgaaactctccttgaaggaacctgaaatctgacattgcagggtgtgtggatggggtgtggttgttgccggaaagaccacagaactctagtcagcagatccccactctaaagagaaggccttggcccttcacaagattgaggaatgaatgttttccgttccagtaaattgtttaaggtgtgtgcgtataattttttagtcctttcctaccccgactttttaaaataatcgaacaaccatcacatcagagaaggcagctcttccgtagaaccagagtgactgcgtttctcagccttggctcagtgaaataacagtgggtagggtaatcaagaaggctgggtttgtatcccagcttgacccatctaccagctggtgaggcctaggggaggccagacattcagtttcctcctctgtaaaatgtaaaatgagatggacaactgtccagcactgcagctggggaggatccagggaataaatacctatagtctggatgaaagcacctttcacatagtaggtgctcgttaaatgtcagccacaagtcataaactgtttatattgttctgcctacttataatgtcagccaaatgtcataaactgtttatattgttctgcctacttataatgtttaccttattcactattatgattattagctattggggcaagaaattgaacgaaaggttaggctttgcagatgatgaacatttagttagtaatagtcatagcactacatagaaaagaaatctggggctgggcgcggtggctcacgcctgtaatcccagcactttgggaggtcgaagcaggcagatcacttgaggtcaggagttcaaaaccagcctgggcaacatggaaaaaccccatctctactaaaaatacaaaaaattagctgggcatggtggcacagcctgtaatcccagctactccggaggctgaggcacgagaatcacttgaatacgggagtgagccaagatagtgctactgcactccagcctgagtgacacagaacaagaccctgtctcagggaaaaaaaaaatctaagtaaggtaataccatcagaaagatataatagtgtatttaatagaatatattcttatagcactttataggaaccacttaaatttttgttttgttgtgataattttacatcttattaaggcaacacttttgttttttggagatggagtcttgctttgtggcgcaggctagagtgcagtggcgtgatcttggctcactgcaacctctgcctcctgggttcaagcgattctcctgccgcagcctcccgagtaactcagactacaggtgtgcgccaccaaagcccggctaatttttgtatttttagtagagatggggtttcaccatgttggccaggctggtctggaactcctgacctctagtgatccgcctgccttggcctcccaaagtgctgagattacaggcatgagccaccacctgggccaggccgccaatacctttttaatttagccccttgctacatacgcatttgaaaaaataaaattacttttttgttgtgacaatgtgtagtaagtgcttgccagttcagccttttgatgaattcaaactggcccgcccagttagttaaaattctttacctcatggagattgttctggatttccaaaatgatatttgtttgcttgtaacatgatagtgataattactagtgattaagaaaagcctcctcctctgctcctcattcttttgtggcctcagggcccttgttaccctcctgcatcctggacaaagaggtgggaaatgcgtctgtgatgggtgttactctgaagacccctaggttattaaatgggagatatttcagcttcatgcttgaatggtggtaatgagctctgtggcccatttctattctccggggagaactgagtagctccaagaatgtggggagagcaggtgtctgcttatctcatcacagaccctccggtttcctgacactgtaccgaagggcacggatctccgccggggaaggaaatttggaaatggaatgtctgtgtgtgatccccttcctgtttcagctgggacttttctcattcccagcttattttaggatgatgtgggcttcctttgaagcgccacttatcaacattactaaactctaagataggcccagtttggggtagtggatttgatcacaaacactgatgtgtaccttcttagctccatgggttgaagagagagacgcttaacaattgaactgcagtttcctgactttaagccttttgtagttgtgaaatttgaaatttccttggatctctgtgataaggtgaaataattctgattaacatctttgttagatttattgttaaaggccacattcttcaactcataggactataccatcagcaaagtcattgtcttctgctctaaaaagatccaggaataacagaattttatggggagaaagagaccccataggggaaatgtctcaggtgattcttctatacattaaagtttgggaagtactacgctgctcccagctggaattaatctactccccctaaactgccaaaccctgcttaacctccttaatttatctaacttgtgtgtaagtcttctataagaggatatgttctttgagggcaagttcagcctgatttattttcatgttcccatagcaacttttacacctgggctcagtaaacgtttgcacagaatgaacgaatgagcaagtgtatacatccaaaatataaccacaaaaaacagctgtttagcttgtgggggaagattaccccccctcacttagacacccgtcggaagcatgctgctttggggggagaatctgagacccaaatgtgacacataaattccaccccttctagggtgtgaacggaggaggtgaccacctgtttcctgtaggccccagcatgaaacagcagctgggccaaggccaaggttttgcgagtgatctaaccccctccctcctgctttctgcaagtgttcagcacccatcttcccaacaccagatacccagcttaccaccagcctgcccatgttggagccgtgggtctggcttcccctttcctgtgggagaagggccttctggggtctcagcccccaccccatgctgctcaggtttctctcctgtatattcctcactctagattggccatgagtgtgcatcactttaatgtcaccatcccaaaactcccctgactctgtctccctctctagttaccactccattttcctggtccctttcaccgaataaggttgaatgaataaataagttcactttaaagtctagccatcttatttgagctcttcatattgagggagtaggatggctctagaaaagcatgaaccaacacggatgcttcaggatctgacagttctggagccaggtgcttcttttgtggtcttaggcagggctgcgtttcctcatcttttagggtacacgtccaactccctgggtgatcatgctattaaataagggaacatgtaagatatagggcacacagcaaaagattgaaaattaattccttccgtagccatctttatggatgccagaggaaaatcccctcttagttcagagctggacacttctgaatttaataagtaagacctgggagaggataatttcggcagagtcagttgctattggctccttgcccgcagcaaatgctgactgttggttcctctgcagaggatcaaaggtcatcgtgcaaggtcccgatggggccaagaagtccttgtgccaaatgtaaagtggttacccttcaagggcaccctctccaatggcgatgggtgcttaggtactttcggattgtcaaggaagactttgagactcttggtcagctgtacctctaagtggacagctgggtacatttcctgagcaggagtatgaggcctcagtgatcatagataaatggacacagaggcagtcaggcaaataaacccacatttgtcacagctgtcagaatgatcatgttatgttctctgccctttggaaaatgttttggaggtaagctccctcagttaatgacctctgttacattttcctagtatttagagtctcaaacacatttagaaaatagagaaaggccaccaaactttggcggggtgcagtgactcacacctgtaatcccagcactttgggaggccgaggcaggcggatcacttgaggtcaggagttcgaggccagcctggccaacatggtgaaaccccatctcaactaaaaatacaaaaaattagctgagcatggtggcacacaagtgtagtccgagctactccagaggctgaggcaggagaatcgcttgaacctaggaggcagaggttgcagtgagcggagatcgtgccactgcactccagcctgggcgacagagggagactccatctcaaagaagaaggagaaagttagtagctgaggttccagcacaggaacccatatctgaggcagggctgcgctctttggactctgcgctcctagcctaaggagcctgtcgaatgcaccctgcaccctccaccctccagtgtgaatgtattggttttcctgcctttgtgtcttttaatgttagagagctgagtgttcttccttaaagactcgttcaggtgcttggtgtatgtaacagggcagtttatttggcctaaatgagaatattgaggcaggtaggctttcttgttgttttgtttagcaactagatggaaggcatgagagcaatccaataaaattgggaatccgggagccataaaatatagttgattccatctacaaatagggcaattgcttcagagagaataacagctcaggacactcacacaaccagtgattgagctcccgttgtctactagatcttgcagtgctatggagagtgtaaagatgattaagctactctccttagcctcaagcaacttagcatggcagatgggagataacctgaaagctgctgattagaatagaccaagagtgataaggaccttctgtgctctgggtagggaggcatgggagatcttataggaacagaggcgttccggcatttgcctgggatgtgtcaagcattacagatgtctctgttgacatagatttctctgctgagctttgcagtgaagaagtcctgagtcttctcagaattagataaccacatccatgtttctacaactaactgttgcacctgctacctgaaggatgaccaaaccagagcttctctgtgtacagactgctgactttaagagtttattctctaaggtgatctagagtttcctgtcatttgactctgttccctgtatttattgctttcttccttttctctgaaatgctattcctttaccttctcttacctttttaaaccctaaaagcaagaaagaactttacttataggaagaaagagctagaggaaggaagtgatgtttggagggtaaataaatggaagtttgggcagctttaacgttccaggctttgagctaggcattgagcgttaactcttacaataacctggggagaatagacagtcatttctttttgtagataagaacagagaatcagaggacagttcattatttcgtacaaaacaaaaagtgcattaagactagtaatgttttaaaaaatcatttgctgtcttttaaactcacagcatagaacggcacttcccaaactccaatgtgcatgggaattgcttgggatcctgtcaaatgtaggttctgattcagcaagtccagcacagatgggtccccaggacactgcatttccgtcacactcccaggtgattctgctgctgctgattcagggagcacactttgaataccaaggacatggactgtgcatttgctagcattttttttttttgaagctacaagagggaaaaatatttagatcaaggaaatcagaaggtttctggctctaatcagcccatcacaaaaatgagatgagtatttccctgttgtcataaccccttagggtgaggagtgtatccttggtgacagaccaaaatcaaatcatttttacaaatatttatggagtatggtttgagaggatgaagaagaaaagcatgtggaaacatggggcaaattgggactttttatatctctcatttaaataaagacttgttggctgggcagctcacgcccataatcccagcactttgaaaggccaaggcaggaggatcacttgagtgggaggagtttgagaccagcctgggcaatgtggtgaaatgtcatttctacaaaaaaaaactataaaaaaaactacaaaacaacaacaacaacaaaaaaaaactagccaggtatgatggtgtgcgcctgtagtcccagctacttgcaaggttcaggtgggaggattgcttgcgcccaggaggttgtggctgcagtgacagccatgattacatcactgtcctccagctggggcaacagagtgagaccctgtctcaaaaaaaaaaaaaattaaaaataaataaataaataaggactggtctatattttatccttcctactggtctcaaaggaagccacctagagtgggtcattgtttgacattttgatgaatttatactttgatacataaattttgaaccagaccatatcttgaagtgtgagagaagtaattatatgaattgcctttggaggctaattctacctgttctctcagtgtggccattactcaaacattttgggaaagcacttctagaaccaccgtcagaaatttaggcggtactaggatcaacaaacattacttcagaaggcactgaagggtttttttgttgttgttggtttttttttttttgagacaggatcttgctctgtcgcccaggctggagtgtgcagtggtgtgatctcagctcactgcaacctccgcctcctgggttcaagtgattctcctccctcagcccctcgagtagctgggattacaggcgtgtgccaccacacccagataattttgtatttttagtagtgacggggtttcaccatgttggccaggctggtctcgaactcctgacctcaagtgacccacccgcctcgacctcccaaagtgcggggattacaagcgtaaacccactgtgcccggcctatgataggttttcacctactgagaatggacttaatttttccttttaggaataagagtcagagctaaggcccaagactaaggcaagtgacaaagccactcaatactatatgtgatcaggagagtttgtgaaggacaaggactccttttattgagtcacttagaaacctaattctgaatgctgttcttaaagatgagttcccaagaggttttgaccaaacataaaattattaaggcctttgatgcctaaaatgacaacaaccctttggctggagaaatttccaggttgtggcaaaatccatctttaaaaatttttttttaattttgtaattttaatttcttatacagatggggtctcactatgttgcccaggctggtctcgaacctctggcctcaagcattcctcctgctttggcctcccaaaacactggaattgtagatgtgagctaccatgccccgcgccaccttattttttactgaccttatgtatgatatgtatgggttagtgaaaggcaggattgaggccgggtgtggtggctcatgcctgtaatcccaccactttgggaggccaaggcaggtggatcacctgaggtcaggagttcgagaccagcctggttaacatggcaaaaccccatctctactaaaaatacaaaaattagctggatgcggtagcatacacctgtagtcccagctacttggaaggctgaggcagaagaatcgcttgaactcaggaggcagaggttgcagtgagctgagattgtgcaactgcactccagcctgggcaacagagaaagactccatctcaaaaaacaaacaaacaaacaaacaaaacctaattctgaatgctgttcttaaagatgagttcccaagaggttttgaccaacaatacaattattgaggccattgatgcctgagatgacaacaaccctttggctggagaaatttccaggttatagcaaaatctatctttaaatttttttttgaattttttattttaattttttgtagaggtggggtcttactatgttgcccaggcttgtctcgaactcctggctgcaagtatttctcctgctttggcctcccaaagcactggaattataggtgtgagccaccatgcccagcctcatcttattttttactgacctatgtatgtgttaataaaaggcaggattgagaaacttgttccttacctttttttttttttttttttgagacagagtctcactctgcttcctaggctagagtgcagtggttatggtcatagttcactgaatccttgaactcctaagctcaagggatcctcctgcctcagcctcccaagtagctgggactacaggcatgcaccaccacacctggctaattatttaaatttttttgaagggatggagtctcgctatgttgcccaggctggtctcaaactgctgggctcaagcgattctcctgtcttggcctcccaaagtgttgggcttacaggaatgagccactgcacccggatgctccttaacttttctcctctttctctttgctttctgttaaaaaccaaatgacacaaccaccatcatcagcagcaggcccaaagctcagatctgttattccagtagctgcagtggaagagccgagtgggtggacaggcagtgggggaagcctgagctttgctgcctctgcctttggagggccgtgggtgtgattctgtaagcagtggagagccacccaaggcacaatgggatcagacccgctgtaggaggttggctaagcagtggtgctaaaagcagtttgaattggagagacagaagctggcaggcccgagggctttcatagtcagaacctgaatggtggctttgggagtgaagtgagtggactatggaggggatcagagaaattttagtgccagagatgctcagactcaggatgagatgaggggcagggtggcattgaccaggagttaaggtctggtgcacggtgaggtcaccaacaaagcctgggagcatggaggaaaaggagagttctgaggaggcagtggcctgcgggccaggacagggtctgagctgtgcagcagtgtcgggactgtcgtgtagcgctcgtcttttcctagcacgtggacgtactctttagggtccagaagggctcatgtcttgtgaaatcaggttgctgtgtttgctggctctggaagtaaagggcgttttgtgtcattagggagattggtgggtcaaggtagtgacctttgtctgtgctgtcctcgggagcacccagctgtggcagcgtgcctggaatccgagtccaggagacctggcctgtccccgtgccccaccttcccaaagctgctgattccttactctttgcctttgacctctgtgctgcgtgtatgtttcaggctcaagggcgaatcctcagggtgcaggccaatgaaatgctcaagtgctctcagtcctccttattttccctttcttatacacatgtttctggctccaggtgtagttggtaactttttatctcagtgatgatgctgccttaaatacatgtgtatttaggaacatgctggtaggtggcacagcattgcaatataccaagcaggttcagaatgccatggccaaaggcctccaaaggtttccataatgatgagaagtaatgagaggcagaatctggtgacttgggttctaagctttatgtgttgatagcagagccagctggtcattttttttgtattagattttgtgctaagtactttatttgcattattttaatttcctcttaaaaccaccttgtaagtaggtactgccctacaaatgagacagtggaggcaggttggggctatgtagctcattgtaggtcacatagaaagtgagtagtgtggctggggctggtacccggatgtttctgactccaaagcctgtgctgtagaccagtgcttctcaaactgtccagtgcctgtgaatggcctggagccttgttaaaaatgtgggcggtgatgcagtgggtcaggcagtgctggggctccatgatcttgctgctggcccataggccccctgagtcacaagtggcctttttcatcctcttcttcctcccagcctttctccacctcctctttcaggtcctcccctctgttcctgctcccaccccacccccacctttcctcccatgtggctgacagtctgctcgggtagcccaggctgcttgcctgttggtgactctgttgatggatggcttgccaaaagatgtggtggcccccattcagcccagtggcatggggtgggcttagactggggccctttagggtccacaacctctttgggctcagggaggaaataggtcacttctgaaggtgacctcttccaggggaggtagagggaagttaactctccctggtcatttaattaaatgtaaatgcctttggtctaaaagttttaagcaattttacaagatgaattatattccatggagcaggtgaagtatttcaagaagcttcagacaggattaagcaagcggggctgacgcagctggcttggccttgccacatctgtcctcagcgactcaattctttacagggtgatgagtcagcagccactgggcagtagctccatttaagaacgcacggtgtgtgtgatatgtttttaaaagatgacagttaaaatgataaagactggttattcggatgattcactttggaaaggcccctggttcttcccagatggaggggggtggccttgtggtgtggtgtctgggagagagaaccctcccctcaggcaggctgtggcctctgtgtgttacgatggaaactacctgtccagcctccagcaggacaggaggccacttaacgttggaggcacttggctgtctcaccaaccagggatgtgggaactcgtgtttcaggtctgttttagggagaggtcagatctcgggcttcagagttaggtaccgctatagctaagtatccagctccagaatttcttttttctttttcttttctttttttttttttttttttttgagacggagtcattcaggctggagtgcagtggcgtgatcttggctcactgcaagctccacctctgggttaacgccattttcctgcctcagcctcccaagtagctgggactacaggtgcccgccaccacacctggctaattttttgtattttttttagtagagactgggtttcaccgtgttagccagcatggtctccatctcctgaccttgtgatccgcccgcctcagcctcccaaagtgctgggattacaggtgtgagccaccgcgcctggccatctagctccagaatttcttagctgtgtaactttaagtggcttaatctccttaattcgagccttagttttctcatctataaaatgggggtgatgatagtgcttatgcacagggctgttgaaagaatgaagatgaatgaatgaatgaatgtgtacacagagcttaggcctaggcctggctcatgagtgcccagcacttgtgagctctcatgattaactcatttccctcctgccccaaggaccctcttgggaaataaaacctccctgaagatactttgggatcctgtaaaatccgtgtgtgttactttcagggtctgctgtggtgtaatggaagaagtgcagacttcggagctagacaccacctggctttgagtcctaggtctacccacctatggcaggtttctcttagcctcagtttccccatctttaaaatgaggatgggcaatgaagaattgcctcagagggttgttgcgaggattagatgaaattacacaaggtacttcttggagttcctggctcactgtaggcatttaatccatgcaacttattatttagctgacaaaatgcctataattagatgttagggaaattgctgtcatcgatggggaaagttccccaatggagttggaactgttgactctgctgtcctggcttctccaagtcctgccatcattttcttctgccccttcccagagcacctgctgtgggggctggtgggagctccaggttccacagctgagccgtggggagcagaagacagagctttcctgctaataaggatcataaatgccagccctgggctgggcaagcatcctgctgccggttcatatcactggatttagcatcctgtggcggtggtttaattggaagagataattggtgccgtgtcctggggagtatgatctgggagtcggatgataagactgacgcggctgatgtcttggagctcagactcgcagcctgggatgggaagcacccgttctcagcaaacttttggtttctgtttgtattactgacctgctctgtacttttcatcactgctagtttgttgctgttgttgttgtttttgagacagggtctccctctgtcgcccaggctggagtgcaatggcacgatctcagctcactgcaacctccatctcccgggttcaagcgatattcctgcctcagccacctgagtagctgggattacaggcacatgccaccacgcctggctaacttttgtatttttagtagagacggggtttcaccttgttggccaggctggtctctaactcctgacctcaagtaatctgcccacctcggcctcccaaagtgttgggattacaggcgtgagccaccgcgaccagtcactgctagttttctatctgtaagagtttttatgggaaatagcaatgccacagttttctttctaaagcgcagttcacactgtctccctgtgcttctctcccggactccctatggcctgtggaagctcaggctgacctttaaggcctttcaccctcctagctgagcttcctcttcttacattaccctttcagtgatccctgggggacccccccgccacccctggccatctcccagggctgcttagtctatgatcccatcgtgtctgctccatgaattcttcctgacaccctcctctactttcccggtcttatattgtctctgtctccttggctgtggccctgtgctgtggaggaagagttgagaacaagggatttgaaatctgatagccttagtttgaatcctggcctcaacatattttccctttgtgactgtggatcagcaacttaacctgcgtgagccttggtctcctcctttataggatagatgcctgccttgagggttgtggagaaggtgaaatgttgagtacctaatgcatgaagtggcactcagtcagtgttagcgaatgtaacgattatgccccagtttctcactgatagccagccctcatcttttgagtaccaacttgataactaaattgaaccaggtttttaaacactgtaagatgattccagttttttagatagctcagagggccgtggggacaccagggtcagaggccagaggtaccaggttgcaggggaggataagcacagccttaccttctcttttgagaccctggtggcagccttggaagcttttctcggtgcaaactttggtgtgagccacacagctgctgcctgctaaatgggaatgtgcacaggactcgaggaatgaagcaatgttgcgtgacaggttcgtgtccaacccctgtgtgcaggctgggcaggggctgggtgcgggctgctgactcaccagctgcagtgaacaggacctgccttgggagacctttcctagtgttggggcagcgtatatcaggctctgtgaccgtcaccatggagatgtgattcttgttgccttttccttttgtctgttgcagtagaggctggtgtgatgcccctaggaagaaacctggaacccagagtcccagacagaacttgtagcggcctgctgattggtcctcactgcaccgtaatcatttctaaccaccccattcccatgaccgggtgcacctcattatctcctcccaagggcaggttgaatgcctccccacaaaccgccttgttgaatggaaccttactagatcctcatcccacactctgcccccctccagcccagtggataagattgctatttctggatttaatgtttctcaaaatccttttgactggagctactttgactataggatcatgtttggtttttttatttttattttgaagcatgggtctctctaggttacccaggctggtcttgaactcctgggctcaagctatcctcccacctcagcttcccgagtagctgagattacagatgcgtgccaccatgcctggcttataggatcattttttagctcaagcatcctggcagaaaagctggtggtggactggcccaggccagtgctttgtgtgtagaatgttcccaagaaaagaactgacgaaacactagaatggctcagtgtggtgagaaataattccactcctggaagacctgcatacctgcaacttcctgtcccatagccctttgtattcactgtgctgttgactttgtcttgtcctttcatttatcctcattatgaccatccttttcaacatggtgccatggttaaaagacctggccctagagttctatttgggtttgatttgcagcctctccctttcagtcttcatcagactctgcacagtttcctgctgcgtatagtaggtgttcattatgcttaaactaaagtcacagcctacagaaaatttgaccctggagccaactgagaggggagggagagaggcagtggggaccttgcatggatataatcctgatgtctggatttcttggatgaaaacagtgttgtggatgagggtttgctcatgaaaatggatgtgtggccttcgtatcttgcagcagtgcctgggagtctgttcatcttgaaataaaaggaactagatgcatttaaagaaggcagcatagctacacttgcagctggaacatttaagcctctttcacaattctcaaagctgcagtttttgtgtgtggggtcagggggagtgccttaactggccttctctctcagagccgggacttggctgcttctgggggtagagttgcctcgccagcaggtggtctataccagctgaacttcgccatgaaagccgcctgtgttggagaactgaacgtctgtgtccgaaaatgctggtctgtctaaagtttcagcatttgcgatccttaggttcccaaccatgcactcatttccctggactgtaattctgccttcacgaatgagccagaattattttgataggtacagtgcctagattagaaggattcagctgcttgccaagaaacccttgctcacgtggagggctttacattttatatattctcctgccatgtattttcgatgatccttagaagaatcttacaaagcaggtacagagttccattttacagatgagcccaccaaggctcagagagatcaagtgtcctttccaaggtcatgtaactaaagagaggcagaggcaggacacgaatctgatcctggcagacgaggatgacaatcatttgcacaatgccttctcattcagtctcctttctggctcccgagcccagaatcctgcccagaaaaccatttctctgaaaagaaaagatttgcatttttggatctgaaatccacacacccaggccctgacagatttggggcacgtgttgttacagccgctgaggtctgtggctagggaaatatgggcatgtcatgtagaacatttatctatgaaacaaggacaatgggtgtcaggaaatttccaggcatttgccagacatctgccattttaatgtggagggtagcaaacagctttgtgtgcagacctcattcattcctgtgcccacacctccccgctctgcgcaaatccacctctttgagtcagcttcagtttcgcatttccagccgtctggtggttggtctccattcatctgaacagacatttatttcagcgccatcaacgtggctggcatggtgcagggatatttggccttccccctggcacctgagactcagccaaaccaaactgccttctcctgatttccctattatttgttggtgggactcccaggtggaggtacctgggcttcaagtgtcagactgccctgggatccttagccctgcctctgtcattactctggagctgccaggctgaatagacactgcccctgtgattcccctgtacccatccctttcttttctttttctgtgtcacgtcgtcaacctgagtctaggctgcttttgctcaccagttctctgaatgtctggtccatgcctcccagtttctctttttacaacctgggctgaggatcttctgaaaacgtcccttccctgctcagaaagcgggtgcactcttgctgtctgaacgcggagccatttggcttagagctctctgatagtgcaaaaataataaattgtgggcttgctgctttctcctccagactatggtccactcattgaggacgggggctgtcttcttcttctgtcctatatgagtcttcgcacagtgacaaaccttttcaaataggagcgtgagtgaaatgggggttgaaagtaagcctctctcctttgttttaagctggtgtaacagcacatatcagttcacccacacgaagcaatggttgatagcttcgatgagctgacaagaaaggaggcagtttccttactttcccagagaaaggcaagatggcagtgagttttagaaggtgcttagcgcgggccccgcaaggtggcttccgcctgtaatcctagcgctttgggaggccaaggtaggcggatcaccggaggtcaggagtttgagaccagcctggctggccaacatagtgaaacccggtctctactaaaaatacaaaaattagtcgggtgtggtggtgtgggcctgtagtcccgggtacccaggaggctgaggcaggagaatcgcttgaacccaggaggcagaggttgcagtaagctgagatcacgccactgcacactcactccagcctgggtgacagagcaagaccctgtctcaaaacaaacaaacaaacaaacaaaaaaacacagaagatccttcagtgtttcaggtgctctttggtttttttaggccaaatgcttaaattggacagttaattttatgcatttctctcttttgggccaatttgtgaagccagcaagtgtttattggacagatgagttgtttgggggaagggccagggcatctaactcttttaggtgttggatttggttatgtttggtaaaagaaaatgtggcattcacaaaattgagcctaaccacattttccaataatttttgcctttcctgttgctgctcacaaaggtggttgatcaataccttactggaaaaaatgtctgaggacatatgacaggttcactatagacatatgagcacagatacatgcagtttagttgtgtgtagtcttcgtaagaaggataaacgtgtgtgagttcagaagacaagaaatagggttgaagttaaacaattttcagtagggtaaccatactctgaaacagccagtcaaggcttgtgggagacttcttattggaatccttcagtcaagacagttctttggattaggaaccacttgagtgcttcctctcatcgcagtgacctgccctcctggaaggtgtgagaaaggcaagcaggctggatcgttcttactgttacacagggatgggctcgtctgtgctctgactttgccttgggccccatctccctactttccgggtcagggaagattgtcttttgtgtgtttgtgtgtatatttaaggtgtacaacatgaagttttgatacacttagtgaaatggttactatagtcaagcaagttaacatatctatcatttctcataattacttttttttttttttttgagatggactccctgctctgccgcccaggctagagtgcggtggtgtgatctcagctcattgtaacctccaccacccgggctcaagcgattctcctgcctcagcctcccgagtaatggattacaagagtatgccaccaagaccagctaattgttgtggttttagtagagacagggtttcaccatggtggccaggctggtctcgaactcctgacctcaagtgatccgcctgccttggcctccaagagtgctgggattatgggaatgagccactgcacccagtcatttaccttttttttttttttttttttcaatatggcaagagctcctaaaatctactgtcttagcagaaatccccggtataattcaatgttgttgactaggagtcctcatgcacattaggtctctgggcgatgcatcttgcatatctgcctctctgcgtcctttcacctacatctcccgtttcctccttcacctcccccacccctgctccttggtaaccactgttttattttctatgtcttctacttaaaaaaatatattccacctataagtaagatcacatacaagcaaggtcatgcagtgtttgtctttctgtgtctggtttctttcacttagcataacgtcctccaggttcatccgaattgtggcagaaggcaggatctctgtcttttttaaggctgaaaaatatattcatattctctctctctctctctctctctctctctctctctctttctctttctgtctctcacactttccttactcattcatcagggaggttcttaactgagagagtgaagccacctcgtgctggtgcatcactgagagaaagtaaaccaaacccaaacctgaaacggatggttcaagtgcccagaacccactttctggttgaatctttctgactctctaagggttagtaaggatttctctggggaaagagataggggctgggcgtggtggatcacgcctgtaatcccagcaccttgggaggctgaggtgggcagatcacttgaggtcaggagttcaagaccagcctggccaacgtggtgaaaccccatctctactaaaaatacaaaaactagctaggtgtggtggcgtgcacctgtaatcccagctacttactcgggaggctgaggcaggagaatcacttgaacccgggaggtggaggttgcagtgagccgagatggcgccactgcactgtagcctgggcgacagggcgagacgccgtctcaaaaaaaaacacacaaacagaaagtgataggaacccttccatcacatcaagcctggtgcttctatatgattggaatgacggtactgatgcccccctggcagacaccccttctgcccatgggcctggctttccagtccctgtttaaggaagactgcccccaccaagtgcctctccctcctggggagctggccccttccacttcacttctgagaccatggctggggctaatgagactgtcattaacagtgcctcaaacaaaacctaagaccattaaatatttaattgaattatttcactgcagggatattgtgactcatgttgaaaactaatcacctgcttttttatctggcccttaatagatctctggttcaacatttaaaggtcagagtcatggcgatcgcagtattgtcattgttttctttcctttgtgggtttgggtggaggaaaggggaagagtgggatgcgtgggaaggaagaggagtcattggaagttgcctttatcagtggagggattccaggggatcataggagctatgcttcttcttttctggccttccctggtcttgattccccagagggataccaggaaggggctggaatgtgggtgcggatgacctctgaactaggcgatcctgtttaatgcaagaaactgtattccctgtccagccattcacgatactgtttcattcgctctatcagagctcagtgaggcgttgaaattccattgttcttctttttaatttaattttttatgcaggaagatgaaaagatgttttaaaatcctcatggttttttcttcctcttctcagtgttattactatgttaacaagatagccattcctgccactaacatctgtgctcagcctgtggtcaggtcctgacttgagtattctagcaataaaatcggtgtacttaattagctttttaggtgactccagcctgtgctgctgcttgtaccatttgatgggaatttcaggaggaaggaattaaggcctgtggacgtgaagacatgtggctgacacagggtttatgttggtaaaagatcaactgtgaaatatttggagtgtccaatgcatgccgtgaccttgctagacacccttgggagttgtagagccagtccgatgccctccacaaataccttggattttctagagaggagcaaaagctatttctcttagaagattttagtgtagcattttcccacagacaaaaatgcccaagtttgggtatgaagccccaactgctaactttctttgcatctgttgaagatgatgaacaggagaaagttaaagcagtggatagaaaaacagttgtgctggctgggcgcagtggctcattcctgtaatcccagcactttgagaggctgaggcgggcgggtcacctgaggctgggagttctgagaccagcctgaccaatatggagaaaccccatctctactaaaaataaaaaattagccaggcatggtggcgcatgcctgtaatctcagcaactcaggaggctgaggtaggctttgaacccgggaggcggaggttgcagtgagccaagatcgcgccattgcactccagcccggccaagaagagcaaaactctgtcttcaaaaagaaaagaaaagaaaagaaaagaaaagaaaaacagttgtgctgtaatttttgtactgttattgcctggctgaaaaccaggcctgccgctgatggccctaaagggaaccgcatctgccaggacgacagagcgtcagcaatgtgttggactcatcataaagcagacacatgtttcctgcattatggagctgttgggccacatgacctagaagcccttctggtgccaggagtctgaattccatgatgcttacatccagccagctagtgattgcagaaaacctttaaaaaaaaaagtctgaaaagattaaccagatctattttgtgcaggttcatttgtgttcccattggctttaatgacacctcctccctcccaaatttcacagtgatttgttcctttcctctttaacgtcattcagcggtattttttgagtgctgctctgtgccatgcaccgtgcaagagaggggagccccacctgcaagaagcttagtcttggcagaggagacaaaaagtaaagagacaatggcaggacgggtgtgacggggcacaggggtctggtttaggcagagaggcgggtcccttggaggcagagcatgggaaatgctgctcagtctaggtgatacccaggcgaggtcttagaggtgcacagaatcctgtgagaagggcaccatcccagcagtggagtgtacagaagctgggaggtaagcagctgaacggtgtgtacagaagctgggaggtaagcaggagcaagaacagagcatttgggagctgccgggacgcctgtcacctgaagtgcgtgtgttggcaggttgtgatgatcttgtttcctgcaaagactctcagatgccagtttaaaagaacacttacagttctgcctttttgtctgttaactttaatagatgtcaactccatgaaattctggtgaaaacctccttgcatgaatattaatcacctgccgttaaccacgtacaagaaaattttagaaaggcaaacttagtaaacatctgtccaaatcatttggagcaaagcactagctccttagatcttccagccatgacactgttgtgttagtgtaaaatgacactgaggatgtgcaaaagttactgaatctaagattgctttgcatctgttttcctgtgttccttggaacctgctttttgtatttgttttcttctccttttttccaagtatctgggaaaagcccctcttctggtctggtgtttgttgtactgtggatgagcagacagctacattatggagagctgccagctaccagagtcattgcagagccagtgtgaaggcaaatgcaggaaacctcatacttggtgtctcctttggattggaaagaatgactctgagctcctgttcctagttgctgtccttcaacctggtcccaggtcataaagagcaagtgtggtttcagcagcatgttcaccgagtctactctgccagctgcccaagtattagttttgtcaactgcagattaaaaatgaaaaaattggtacacagaccctgccctgttgaagtcatctttgggaatctgtcttgtgatcatgtggaacgatgcaacagttgcttactcttggcatgaatgaaggccagaaatgttgtgaaacagaaaagtttgttttgggtacttgtccatttgcttgggaaaaattggtatgtagagggtggctgcctgtttgccttccactgaggtctgggactttgaagtagacaggcctgggcagcagcagcctaagagatttaggttataaaggctgaggagtctggtgtatgggctttggaggcacatgacctcatttgaaatccagatcccttgcatgttagctgtgtgaccccaggcaggttccttaccctctctgttcaaaggcatcttgagaatgttattataggaagtatttaggtagcagtccatttagaaggggtgagtactcttacatgatactttacccaagacagaaaacctgcataacccacgtaaataattcatctcccaaaaatagagtcagggcgtaatgagggctaatgtgccaggccacctcttggaagtgctatagcctttgtgtctcattttcctcttctatgatgggaatattcatgcctgccacatagagttgtcagggattttagaaataaagtctagacgttgcttagcaccaggttactacttcaagcgaggagtataaaacatggtggtaaattttgccaagtgactttcttggatctctgaggtcactgagctccaggtccactctgattttgagtggcatgatcaggtaggtgagctcgcagagggtgcccaggggcttgtggtggggctggagaatggcaatctgtggagatcccctgcacccctctcgccctgtgaaacatcccaaattaaaatagggggttgctgccgtataaaaaattattctcttgaaaatctctggtttaggtgagatctctctttgaagtgcaagatgatttttaagaaccttcccagctctcatggttctctcataagaaatgaaagaactgaattccaggctctttgtaattgaccaggaaaattaggataaatgggttaaaggagtcagaggcctttgggccaccacgtctgctcgcggtctgaatgggagccccctgggacccagcgggctctctggtgggtccttgatctcctagaaatggaagcaagtggtgagaccctgccccttaggggcagctcctggtttccttcacagaacagcaaagaaagagttgccccgcctgcctgaaaatcatttttcttgccgctggtattctgggaatgattctggaaaaaacattaggcatggactcgaagtctgacacactcatgtgtggtagcggtagacactgccctcgttctctgaccagacagcatttccatctgttggtttaccacttatggacagcatttccatctgttggtttaccacttatgtaatcctaatgagaaaaacagtgggatttgtggcaggccaaagttcaggtgaattgctagtctctagatgaaatgccagttaatctgattgttaatcgatccctatttttgtaaacttgaaatgaaaggttcaaatttgaaatgaaaaagcaatcaagatttcagcaactcagttgcctccttagcgcagtaggtagcacgtcagtctcataatctgaagatttcaacaagtgagtgcctcgttgctcaaggagtgaattgagaagggcttagttctgtccctgatactgtcagtctaggttctaagttgtagcaacagaaatcactgcagaatcagacagggaagttgctgaagaatgtgggggagtccaaaggatccctttctctcctatgttttgtgttcctctactctaatacctgggaactatccgtttccgtctgcttatgtgtctcactctctggtgagacctggactgacagcagggacagtcttgtttgcttttatttttcctctgcccagcactgacatatgggggttgggtcacataatctagccatgggcaggatgtcggaacatactgaagcatattggtgggctgagctcaagtaataaagctgattttttttttttttttttttttttactgcctgaaacaggcacacttaacaacagccgcagcaatgacaaaaacctcatgagaagatgcctgggtcaagggtcttacttccagcagcttccctgcaaatccagtgcaaataaacataggctctcctttgcagtttgttgcagtggaatcttgtctgttgcatgctgaagcgtaggatgttaggcctcttctgacatcacagcagagcgtttgcatgttcatgttgaatgtgttggtttggtttatctgtgccctgaatttggcatcatgaacttgcactcttggttcagttggaggcggaggtggcccagagccgtgtggatctgtgctggtgtcaccactgatggtggcaaagggaagagtgatgctgaggaggaagcaggagaatcctgaaggtcgaaggccatggggcccggctgccataatagccatagcgtctggggcactgaccaggagaagggtgctggcctcagcccttcctcctgtgatcctgaacggctggttctagggccaccagtagttctaggctgatctggttagggaaggaggcactgcttgttcttgcctcagtttcccctccagaatcatccccagaatagaaaccaaagctataatgagatcattggtttttaaaaaaattttaatttttagttgtggtggagtgtgcataatataacatataccgtcttaatcattttcaagtgtagagttctgtagtgttgtgccacagatctccaggactttttcctcttgcaaaactgaagctctgaacccattcagcaactcgcattttcccccttccccccagtgcctgataaccaccattctcctttctgtttctgtgagtgtgattctgctagacacctcgtggaagtggaatcacagtatctgtccttttgtggcgggcttatttcacttagcattatgtcctcagagctcatccagtgttggagcctgtgtcaggatttccttccttttttaggcctgaataatccattgtatgtatatgtttatctgttcatccccagcagatatttgggttgcttccacctcgtggccacatccctaacttttaatcctttccaccgctctccatttgccttggggtgagagctctgcctaccccccagcatggctttcctgaagccatttccaggcctggcctcctcctgcctctcttgctctaacctaatcctctcactgccatgccacatccctggcactctggccacactggactccttagagaccctccaggcacgcactgttctcttgtactgccaggccttttttgcacgtgctcttctgttcatctggaacgctgcatcttcccgccttctggaacctccaacatacactgtcttccttccatctcagcttagacaagcccttcttgatctcctcctatcacattgtgtcatccagtactgtttatctgtcattttgtaccactgcgcctgtgtttattttagggcaaggactattttattgactaatcctagagtctgtgcatggtaggtatggatgatttagtaaacacataaaatatgtcattctttcaaaggcaggagcctcttcctttcctccccctgcccttttccccttgtcactaaaatccatgtcccaggttgaaattgggtacttctttcctatagaaacattgttatgggacatggtcaggttcagtagcatctgatgcgggtatataatggattaagtttgcaggccagcctgagaacttaactaccattcatgacattgtttctttggggaaaaaacatacccatttccaaaacagctgaagcatagtcttctggatcctgcgcctctttgtgaagttggcctttgctggtggctctgccactggtttggaaatcagagatggtttttccatgcccatgatgaggacaaaggtgagtgtcccctgtctccacattgggaaaagaaacacacccatcccttagaaaggagagggaaatggtattgcggcctcactctcagatgagtaaaacctcctgagaatttaatgtgtgattgtttttataaatgtgacaagtcctggtgttagctcctggcctccaattgagcaaggtttcagtagcaggtaatccccctgttctttcccctagctgtgtggggcgggacccatgtctttgctaccacctcttgctatattcctaccctttttttttttttttttttttgaggcaggtatttgctctgtcgcccaggctggagtgcagtggcatgatcatggctcattacagcctcagcctattgggcttaaaccatcctcccacctcagccacccaagtagctgggactacagatgcagaccaccaagcctggctagttcttaaaaatgttttgtggaaatgaggtctcactgtgttgtccaagctggtcttgaactcctgagctcaaaccatcctcctgcctcagcctcccaaagtgctaggatgacagccactgtgcccaaccatatccctaacttttaaaccttgctgtggctgagaacaaattaatgtagtttgaagtttaccaacagggaaaacaaaaggaaagaaagggatggggcagcagagcaggcagtgccatgactcagttccactcagatctcattctggatttgactggggtagaaaccagactttaggatgcccatgactcattgtctatggaaatagcattctcttagacttgtgcagtcagctacctgtggagctgtacgtagcagcccccataggcttgaaggacctttctgtagctgtctttggaggcagtgatactctcctcccaattgttacacacatttctgcataggagttgatacatgaaacaggaaactcaaatacattttgcaatgagttgagaagtaaatccaaaaccagatttagctgagagtcttttgttgcatgaagctgtgcacacaaaggcagtgaagaggtctagaataagacagctgtaggtttgcgtgttaattgcatgatgatctgactacgtgtgcacagggcctggcactcagcatcctacttggattatctcattcaatccttgataacactgtggagcagctcctgttggatgaagaaacaaagattcagagtagatgtcacccaaggttataccattggttggagggagagctggaacagtgaccagggatatccagctccagaaccctgaatcttaacctctgtggtatactcctgttcggtgggttgccctgagccaattgttctgctctctgagtcttgctcctcatctgtaagatggtcctcgggcggctgagtgtattgagagacagcctaggtatagatgcataccttcaggaaataggccatccttctagggccacagaaatgcccctgagaccttttttcctgtcatagcaccgtgctctgctttctgagaactgaaatttgcagggatagcctgcctacggaatttgtccacttgtttagtggggctggatggtggttgtcctatttacttaattcacttgatgggtttcagtcttttgaacctaaaaaaaataagaaaatgggatttgtttaatctcgttttccaacacaacagttcttaatctgctttcgaatgtttgtttgtgggctgaatacaattcagtgttaatctagtgacctagtattgcctggtgatgaaatctgtccctgccgttaggttcacttgtgtttctttgtgtttctctctctctgtctctctttctctctcgtacacacacacacacacacacacacacacacacacacacacacacacacacacacacacattttaaacttggtctttaaaatctcagtttttcctgcttaagacaagaagatccctgatgccaagatttctacctgaaaggtcagtttcagctttgtaacaactgggtaattgtctcctaaaataaaccagcatctcagggactgcaagcttgtcttctcagttatgtgaatgcaaatctcttctctcctaatgactaccctgcctatgccgtttcctgtgggcatgtgcagtcatctggaaatggcggctgccagttccacagctggggacgaccctggcttcttttctgtaatgaggatgtgtctgctcctgccattgccccactctttgtcctctgccttgtggtcaggagctgctctttgtgctttcttttttccccagttgttactgctgggggaaactgttgggagtggtccaatgtcacccctgtaggatgctcaccaaatcgatactaattcctgcagcagataattcctgcctgaaactttaaagtttgctaattaagtaccattaagattatttgctaggttcttccccaaatgagtgctgggttcctgattgggaaccttggtagaaaagcccaggggctgcattctggcgttctgtgagccccacaggcagcagagctgtccctggggtaagctttggttctggggaggtccctgttcacaggtgccatcttcacatcaaatctgcttctgtgcaaatacgcttgagtgtctgagatcaagatcattttacgtcatgcaaatctgttttatttctccagtcttcttttgggatggtagacattactgataaggtactaagtaaactggagttttaaaaacagggtatttccttttaatatttctgattctctttctcatatgaaatgggccattaagcttgttcaggatggtggtcccaggtctcactgtgtcagcccggagtgattactgaaagatgccgatggtatctaaaggccatctgtaaagtgttgaggtgggtggtgagctgagggacgtggtgaattgaagggagccgagggtctgttctgcatggacagaatggaagtaggcctgtaggagagtatcccaggcacctgtcttggtggaacctcactgtaatggggggatgccagctgacagctggaggtcgtgtgttcaggtcggctgggcctgaaagtctcctccacaggtcacgccgctccttgtagcagcaacacatgggcaaggtatttacttctccttcagtggggcttgtatccacttttgtgatgtacgtcacttacccagcaatccccccagctcacccctggctctttctcccaatcttggtctatacaaatatattcccctgtgagttacctaagaatccatgtgcatttgtctcaaaagataattgatgggcagggccctgggagaagccatctttagtgatgctctacagaggtgactgttgagtcacatgctggggggggggggtctgtctggtgggtttgtgcacatgtgtactcaggcacgtgcactgtttctacagcatgtggatacaaggcacctggctgtgggtttccccatgcagccttccacatggttcatggaataccaccagggtccttggtgctgtttccatgtagcataacagtgacaaccatggatttccaggtggcattgaatggctagaattggaaactagctctgtattggagacctgggagaagttaccttccaggcatttttttgtttcgtttgggctccttgagctcatggcaggcattgccagagcctaaacctgctgcttggaaaggggaaggttcttcaggtaattactccctcccttcttgtacctctgttcacctcactccagggatgattgaagaaagctccctaccatcttcctcctggcatgaaggggagcaagttctctggtcctggagatgtttcaactgagtccagatgactatttggcagggacgataaagaagaaattctggtgtcatgtgaaactaggttacccctaaggtctcatgcagcttttagattctcctagatgctgacggttctttagaaagtggctttaagaaatcccagggctgactgttgagaataccatttggtaggttccccgcccttctttatgcgcagccaagtgattgttgtcatggcaacagatctgttcccgcgaaggcttttcttgtagcatataaggggacctgaagcttcagagattgttagtaattatcttctaaaaaaatatgtcttgagtactgtgagcattttaatgggcccggttccagccttatgggtacttttgaggtctgtatcagccccatgtcacaaaataaaacgacttgattcgttgttttgttttcatttttttcttttgtgcatgtctaatatggaagaagaatcacgatcctattgttaataccttgcacatagtaggtgctcatatacttaattttatttgacaggcaggcagaaaagctgaggattgatctaaatatcctttattagattagcagttacatatgttctttccctagatgaccttgaatcacaaactaggcaggcctcccggagctcacagctttatggtccagatctcctgtccctgttgtttgcacatcaccagggagaggggatccatgggtgagtctgatatgtatgaagaatgtctcatttccccccaccccaggagctcagagtcagctcagctgccaaaatgtcaggagtacctgctcttcagaataggatagtgtccaagttttaaactctttcccctttatctacaaacatcaattgagtctttattctaagtcatgcattttgctagatactgagaattcaggaatggctcacacgtagttgttcctccaaggtggtcgctgtctaatgaaggacacaggcccgtggagcagtaagcccaggacagcgcattaagtgtgagaatgcacttggtccccttagtctctctttccttccctgcctttgaacaaaggcatcccatcctatttgcaaggactggaggcctctgaaccacttctaatcctctgcaagggagaagataaaagcttactccttgcccacctttttataccaagtcactctgaaggttacgtgaatgtcctagacatgggaaagataggagcaggtgggaaccgagggactctttctgacccttaactcttctgctgtcgagccactttgccctgagacgttgtcagccctcccatgctctccctttcctctagaccggggttgccatttcactcgttggtaggaggacctctggttaaatggaagagtgtggtttgggatgggacactaaggcgaggggtggagaagcttcatcagcaggagactgtcccagcagcagaccctgtgtcctttagtggtgcaactggcaaacagtcatatttactgtctcaggacatcccgtcagctggatttcacctggcaggggctctgtgtggtgatgatgttctcagggagctggggaaagtattctggctggtgaaacattctagcccctttcactccaagtgtggttggtagtctagcagcaagtcagtatcttctgggaacttgtcagatatgctgaatctctagaccttctggatcagaatctacattttagcacaatttcctggtgatccttgtgtatactgaagtttaataagttgtgtcttgagctctcttttgagatcctaggcccagggtagcaaatacagagtctgcatccttccactgtcctgcggttgtagcagacattactagctgatctagccaatccattttccatctagcgcatagctgcccacagcaccctccacacagtgccccaggcatccatacacctgatcagaattagcccaagagataaactgatttaccatccttgcctttgtctatgaagagctcattctaaaaaagtaactaacataaaaaacaaggaaacagctgtttgcataggccttaagtgttgggaattaggacccccatcataccccagggcagtgggaaggaacactcaggcccactgcttgaaaagatgtcggcaacctgaacatgcacaatacagtggcgataaaccagaccctactggttctctgcagttgggcaatgaccttgtcggaggaggcgaggccatgatattgctggaggaggcgaggccatgatgttaccctggctccagtgctcatccatgggacatgtggtcagcccctgtgtcccacaatcccattgccttctggcaacttcctaactgatgactgagccacagtcaggtttcagtcattcattggtagttattcttatctgcattttgttagaagaacacagttaataaagtgggtgtggggaagaaaacagtgcaggagaaggagaactggaagaggaaccagagtggcttgagttatctagtaaagtcttcattacatgatgtgaccagctctcagaggggcatctaatacagagcagtttagtttaacctcagaaggtcatcagggtgctagaatcatgtcccattttcatggtaattgggcaagactgggaaaatgttttgggaatacacattttatcttccacttccagcagtggcttctaaccactgaggactctccacgttaccaatctctactgacctacctcaagctttgtaaaatcttatttaccgaacaaattacatttttaagtaataattaagcccccccttttctgtagagatatataataactgttaacctggggtcatttttatcgggctttatataattccaacagaaagcaaaggactgtgagtgcttaagttagcctgagcagtaaagaggcttttagacctactgagaatagtttttggattcacattaccactgcttgacctgagactcgatttgggagctagaaactaaaaccagttatgcccttccattgaatagatggaggctgggaggctcgggcttgtctagcttgtagggactcaagggcactttggtcgtgtcacggtgctgctttctctcctgcgcaagcctcatacttgctttctctgttgaatggtaaaagccagcctcttgtttgctattccggggttagaatttcaattccttttttaaaaactctgtttagatcagaaaccatccagacactcattcagaaaccatctggggaaggtatgacttgagatagaaattgaagagatagagaggaggagaagaagatagtatacgagttagtttaaatgaccccagatgagtttggccgggaaatcaactgcagaatgcatcctctgtccctggcctgtatccctcaagggcctttgatagagtcttggcttagttgcagccacttttcctctagaactttaactcagtaaaggtgtgcagtaaaaatggggaagagggatgaggaggagccaggagagaatcgaggaagagcaaatattacgagcgtagaacgcgaagcttggcatgtctgcctggttccacttactcacgtttgttgagctccttctatgtctgaagctgtttctaaaacgtcagtttctagaaaacaggatcctgaattcagctaagcatgattcccagggccatccctgggaagctgtcctgaagatgcctcctgctaagacaggttgcggaggggagtcagtggctgaaagggtgatttcaggatagattgtcctggcaaataaggaggggtcctctgcatgaataagcagtgtaccctgccaaaggaagctggcaggaggtgattcctgctgaagcctgacagtacatgtccaccctgaactcatggccttggatgcagaccggccaactgtacacagttgagcgaggaagtggcgacagcacggtttgaatctggctgataaaacagatgttcgggggaagggctcttattttctcccagttataggatcgggggtgggggaagaaaacctaattccctatctgccaaatgtttctgttggtaatgtcctggcaacagtgagatgcccccaagaatggagtggttgaaagttctagctatcgactcagccctggatgtaaattctgaattctgtgtgaccttgggcaagttacttaacctctctgagtacccttggcctcatctgtaaaatgaggataatgatacctacttttggcggggtgcaggggcttgtgcctgtagtcccggcactttgggaggctgaggcaggtggatcacttgagatcatgagtttgagaccagcctggccaacacggtgaaaccccgtctctactaaaaatacaaaaattagctgggcgtagttgtgggtgcctgtaatcccagaatcgcttgaacccaggaggcagaggttgcagtgagccaagatcatgccattgtactccagcctgggccacaagagtgaaactctatctcaaaaaaaaaaaaaaaaaacaaaaaaccaaacacagaaaacacaaaaattagctgggcatggtggcacatgcctgtagtcccagctacttgggaggctgaggcacaagaatctcttgaacctgggaagcagaagttgcagtgagccaagatcacaccactgcactcccagcactctagcctggacaacagagtgagactctgtctcaaaaaaaaaaaaaaaaaaaaatgagatacctactttataatggtacctataagaggagtataatgagattttaaaaaaatgaatacaacattcctgcaagggtttgtcatgttgcaagcactcagtaaatgggagctattcctaataatatgaaaaactgcaagattacctcctaagagatgataaagtcgctatattctggcatagtttggggatgtacagaaacctcttaaaggaataaagtagctcttaggccagtgacacatgcatgaaacctgattttaggtgctagcgggttcaaggatagatgtttatcacagggagttctgatctccaacgggagcccagcgcgagggcagggagggaggcagcgcgagggcagggagggaggcagcgagagggcagggagggaggcagcgagagggcagggagggaggcagtgcgagggctgtctccgcagagtcccagcttagagccatccctttgtcagggatagatgtagcaggctcttactctgatccctagaacactaactccctgattctgattccatattcatctggccaccttctgaattacctgacaacccaagaaggctgactgggagataatccctgatccagatactgtgagcatcttatctacccgacagttaaattttgtgaactaagaaaatgacatgtggtttctgcatcaggccacagctgcttcgctggcaggagctggcgtcatcgagtcgctcagacctggcttcagcaggagcatctttctgtgcccatgcagcagaggcagaccatggcaatggggggttcatggtggcagatgtcggggagacagctggcatttcccaggtgacacccccacagggtgttgcaaccagacaccattccatccaaaacgtagacagggaagcctccctgtcggaatgtgtttgctgttaatatggttttcccatagtgtgagcgtgtccgtgtttttgtgtttccatattaccattctcgctttgcttttaaaacagcaacaaagaggaatattggtctttgtggctgccagtacggtgcatgccagaatctcatgcttgctggtctgaagccgccagatggtggtaggattgtgtgtgggttttgtttcctctgctttttgaaaagtcgtgaagtgggagagactgagaagtgggagattggctggaagattatcatctgataacagtttgcagtgtcttccaccctgtgtgtgggcacaatggtgtcttccaaaaatgtgatgctgaccctacctagcatttgctgaatgtgcagtattagctgtcccgtaaacaccagctgggttattcattacatactcagctgtatacagtagctgaataaaacaggttttttaaaaaaaaaaccacacaggaaattttctgcatgtttttctcttccttgaagattaaaatgagttgttaggattgccattgtagcaaaagggaagttgtacttccttttttgggggctttatgggtttatttttgaatatcttttcaagttcttttacctttgtcctaaggaacctattttcacagcttaaaggactaatgtttctcttctcttagtttccttgaaatcagattgtgtgtttgttgtaagaacatttagatcaagcttgtccaacccatggcctgttggccccatgcgccccaggatggttttgaatgtggcccaacacaaattcatcaactttcttgaaacggtttttttttgcttttattttattttattttatttatttttaagatggagtctcactctgttgcccagactggagtgcaatggcttgatttcggctcactgcaacctccgcctcccgggtccaagcgattttcctgcctcagcttcctgagtagctgggattacaggcgcctgcctccacgcccagctaattttttgtatttttagtagagatggggtttcaccacgctggccaggctggtcttgaactctcaaccttaggtgagccaccatgcccagcctgtttgtttttttagctcatcagctatcattagtgtattttaagtgtggcccaagacaattcttccatgtggcccagagaagccaaaagattggacacacccgactgagatgatcttgtaaatggcacaggcaaaaaagtttgtgttttgcagccattttcaaggctaacataaggtatcaggacgctgctcagtgacttatgtgtgaccagggtctctaatgattggagaggggatatttgtctcgtgtgaacagagtctgatctctgtgaagacttgtgataccagaaactggttgcttctccatttcctccctctctgcctcccctccctgtagttaaacaaatgtagggcatcaaatgatgccactttcttctggttgtccatctctccatgcccaagggtaaaaataaaatgctgatgaagccagaggaacacagtttgttcatttgaagttcttaatatcctgagtgctgactttgacctttaatgaaaatgatggtccttttggcaggggccagctgcctcataaatgtgcagcttaaagaacaaggatgagtttccctgaacaagagaaacagcagcaagcgtggaagtcctgcgtgcatcaggagcactctgctaattaaaggcaagagtgggatgcctggccaggcactgtggctcacacctgtaatcccagcactttgggaggctgaggcgggcagatcacttgaggtcaggagttcgagaccagcctagccaacatggtgaaacctcatctctactaaaaatacaaaaattagccaggagtggtggcgcacgcctgtaatcccagatacttgggaggctgaggcaggagaattgcttgaacccgggaggtgtaggttgtggtgagctgagatggtgccactgcactccagcctgggcaacagagcaagactacatctcagaaagaacaaaaagagtgggatgcccaacagcaaggaactgctggtttgttgctttgtgagttttctaaggcaccttccagctctaaggttaccatgacgatccgtcatttccaattacaggagatgcccactctatgggggcaggcggctgtctctttacttcgtagcacaataattagaccaaggtaacatttcctaaaaatttgttgactacaggaacactgtcctttctccactccagcatcttggttgccaggaagaggggtcatccagtctaacctggagatcacctaagagatccaccttatagacccccaggctgatgtacccacctctagccgaggtctggctagccccttgcctggagcttccttactgatcagttattttgttggtctgggttatagttgtccacctactagccttttgggttttgccccttggtctagatcaagcttgttcaacctgcaggcctcacatggctcaggatggctttgaatgcagcccaacacaaatttgtgagctttcttaaaccattatgaggccgggcatggtggctcacatctgtaatcctagcactttgggaggtcgaggtgggggaatcacttgaggccaggagttcaagactagcctggccaacatggcgaaaccccatctctactaaaaatacaaaacttagccaggtgtagtagtgcacacttgtagccccagctgtttgggaggctgaggtgggaggattgcttgcacccaggaggcggaggttgcagtgagccgtgatcacaccactgcactccagcctggatgacagagtgagaccgtgtctcaaaaaaaaattatatatatatatatatatgtatatatatgagatttatttgtgattttttttttttagtagctgttgtttgtgttagtgtattttatatgtggcccaagacaattcctcttccactgtggcccagggaagccaaaagattggacacacctggtcgaaatctttgggtaaagcattgtcttagctagggcatcatgattgaacttttccaggcctaagaattgagcttcctcttctcttattagaattcaggttcacactctgatgccatttggaaacactcttactttcctttgaagactgtgttctgtcacttcaccttataaaataaaaaaatcctgaaacatgccagtgcgattgcagaagaggagtgcccagcttcatggtcaagtctgacgctcgtgtgtgcgtgtgtgcagagctgtgtagccgtggctagtgctggcctccaggcatcccccggggcagcagatggtgtacccagccttgccctgctcggtccagccagagtggcagtgatgcacgctgaggcaacttctgtgatgcaacacccgggcagtcctccagcccgccgtcaaggtgaaaagacccctgccaatttaggacttctgggctctctgagagcaggggcttgagaggaaggagagactattttctcatatagtgaaactaaaatattacaacctgccatgagccattgcagcagtgtccctaagtggccctgagcgtcccatgacacagtcccgagccctggattttgtaggagctttccttttcattcttggctggaaggaagctggtgatgcaactgttgtgagctctgaaatataaaaattaacagtcaagggggctgggcacagtggctcatgcctataatcccagcactttgggaggtcaaggcgggtggatcaccagaggtcaggagttcgagaccagcttggccaacatggtgaaaccccgtctctactaaaaatacaaaaaattagtcaggcatggtggtgggcgcctataatctcaggtactcgggtggctgaggcaggagaattgcttgaacccgggaggtggaggttgcagtgagcggaggtcacgccactgcactccagcctaggcaacagagtgagactcaaaaaaaaaaaaaaaaaaaaaattacagtcaagggaaacctagggtcaaggtcactttaaaaagctgttcagccaagggcaacggccttcctgttttgaaggggtgggggcagaggatggaggctcactggagttggttttcatgagcctcccggtcccccagctttcacttcccattaaataaccacgttgtggatgcgtaacaattaataagtacaaacagaaccttccaggcaagccctctgggccgctccttctaggcctttggtcttctgagatgtttgggaagaaggaataattctggctttcttgaaagctgccctttgcactgttcatttgccctctaagtactgatttgccagctccttagagaaagtggatattagatgtgggaggagtgggggtcatgatctgttgtccagtgtgtccttatggacagatgccccagcccagccacatttacttactccggcctctgccttcctgtaggactcagcttatagctacatcaccgctctgcctaatgggagcactgatgtaaccagtgctccttattttctctgtaaaatattccagcccctgccttcaggaagctcacagactctctctctagcatgcgcacacacacttctcacacctgggttgtaggcttcaccagcatccgctgtgtgcgcttataaacctgtaaatgccagttgcacatactgttgttaaataatttaattataagctatgtaaatgtttgcagtgtgaatgtgaaaaccaagatttgtcatttctacaaaagaagtagaatgtttagaaagatatgatattaataaaagttacttttgcaaaaaaaaaatgccatcgaattaagtatggatgaggcaactgtaaaagatttgggaacaaaatttgtaaaaatctaggatattcagattgcttcacaagaagcccgacatggaaatcacagatgatgcattttgggtgtgatttatgcaacaaagatagcatgagacactggtcagcatatttggttttttttttgttttttttttttttgtagtacaaccatctacgtttgagcctacgccaggcagacccttgcaaagaccacacagacagcaaatgtgggagctgggctttgaagccacattggctaatttcagagctaagcctttcaccctgtggttctctgcttatcctcctgctcatttagacgatagtaaggagtctctgctaagactctagattagccatggtgagagacactgttgctactgaaactctatggcttgcaggctgcgtggagtgtgcctgccatccaagtgtgtgggaaagaggagacagatgggaatacagctgccaaggagccccaagaccgttttggaggtcatttgggggaggagggggtcacttacctcaataggtaagtttttggtgtgtatctgttttagaaaaagattcctgatacagtcacaggcgagcctacactcacatttgttatatttggtgtgtgtggtagttatgtgcccaggaaccaaagatttccactttacttagatctttcatttcttttttctttttctttctctctctcttttttttttttttttttttgagacggagtctcattctgtcccccaggctggagtgcagtggcgtgatcttggctcactgcaacctctgcctcccgggttcaagtgattctcctgcctcagcctcctgagtagccgggattacaggcacccaccaccgtgctggctaatttttgtatttttagtagagacagggtttcaccatgttggccaggctggtctcaaactcctgacctcaggcaatcggcccgcctcggcctcccaaagtgttggggattacaggcgtgagccaccgcacccggctacttagatcttttaaacttgaaccctagtgggtacagtaatcaatttcactgtgggggaacgggagctgctgttcaagcgcacagggtcccttccatcagcaggcggcaagggcaatggggagggagcaaccactggtgttagggttccagctgctgttttgtagacatcttcagggacactttggggctggctgtttattgctggttggtgtccagacagaagtcacaagccattgagtggttggaggtggctttcttatccaccacccattcttcctccactttctagctgggtcccgtgaaggagctcttcctaaccagacagctgcggccttagatcctgctgatgcagctcctcaggctccctctcctagttatttgggtatttccagtattttgggcttgtacacaagctgcccctagttgaattaatgcatccctaaggccataggagagggggttagtgcctgctggctttgtggggaatgtcagttgtgtgttttcaaattagtgtttctttaatggcaagtggaacattttcttcattatgagaacatgtgttgcctattatctctgtgcttatgaagatgggggtaggcagtgaacttaatagcttttcagagcttctgcagcgagggtttgcggggaggccactggtgcagtgagcatgtcaggtggcttccctggaacagcactggaaacagtgagccctccttatggaaaaaggatgcatgttcctacgccagtgctcaccagggacgagtttgccccctggggacatttctagttgtcatgacttgagggatgttactggcatctagtgggtagaggccagggaggctgcaaaacatcctacaatacacaggacacaaaaaatgatcattcctttttttcttgcttttttcttttgagacagggtctcagtcactcaggctggagtgtggtggtgtgatcatagctcactgtagccttgagctcctgagttcaagcgatcctctcacctcagcctcctgagtggctgggactgcaggcatacaccgccacacccagttaattatttatttattaatttatttgtagagatggggtcttgctgtgttgctagttggtatcgcttaaagccagaagtttgagaccaaacttaagtgatcctcctgcctcagccttccagagtgttgggattataggcatggccatcatgcctggcccaaaatggtcattattgataacaaaaaatgatccggttcaaaatgtcagcagggctgaggccgagataccccactctagtgaactctcctgccctgcacccctctcctgcagagatgcctgagagcgttctcctctcctctggttctgtctggctcctaattagccttcgagcaatgtcagctctcgggaacagcagagatgcacagtgacttactgtgacggcggcacactttcaccaaagcagttcttcagtctggcttcctcagcccttcccctccacgctgcagaagctgggcctgacaaaacgtcttttcagtcctcgctcgccacctgcccacactgtagcccccaagaatgcctgccattagtcccctgctatgcagggagatggcagctgcctgcaaatgaggcagcttggagggacaggacaatgccactcgaaggacccaccgtcctgcctgtcgctgccaggtctctgcagcaaggggcaatctgacttcggactttagggggcaaggaaactttgcttttcttatttcctccctacccccccaaatatgcattaaacaatttgtattctgtttgtgactttaatgtgcctctttgtcctcagctgggaatgtctccagcttgtcgtagtgagagagagcccttggtatccgtagaagcaggcttggattttggctctactgctgaccagcaatgtggccctcagcaaggttgttaaccctcctgagcctcaggtgttttcatttgtaacatggggctgataatgcctaccacagagggttgctgtcaggacagtgttccctgcaccattttatctgtgtccatccaaccaatctttgtaagctgctcaagggcctggcacctgtcttcaccgtccttgaaatcacgttagtttttgctgcacggtaggatgtgggccgtggactgcggcgcacccccagaaagataggttgatgtcctaatccctggcgcccgggaatgtgaccatttggacacagggtctttgctgatgtaatccagttaggatgaggtcattaaggtgggccctaatccaataggactggggtctttataggaagagggaaatttagacacacacacacaggaatgccttcacacgtgtcttatgggaagatggacacacacaggccgtgagcctagcacaacagaggcagaaatttgaacaatgcagctgcaagccaaggaatgctggagtcaccagcagcaaggagaaggcaaggaaggactctccctgtaggttttagagggagcacggccctgccgacatctggatttcagatttttagcctccagaactacggttgctttaagccagccagtttgggttgctttgttacagcagcccccaaaagccaatacaaatactcagtggacgcttgtggatcgtgtgtcttcatatgcaaaatgtatggtgctgggcctcagcagtcatgctttggcagcccagcccctggatggttcacttcttcctttccactgatgattccttcacagatcacccacagatcatactggctgattttgtgctgctttattagaaaagcatttgcttgttatgggagaaagtttttacatgtaccacgttgaatcgggttatgtttttgccataaagtatttgtgcctctctaagcagtggcatcaagtgaccaacttagatttcttttagcaacacgttggttcctggttctgggaagaagcatgagaggccattgctcctttctttcttctcctttcaagaagcagaaccaaatcaaagtggctctaaaaataagaaaatgaatatgcttgcaaaactggggtgccaggcccagaggaagagcaggttcgggttggtggctaagggacatcactggagactcaggccctttctcttctgtccacagcagtgtcatcctgaggcaggtgtccccatggccataggatggctgatggcagcagctgcacagtctgcttccttgtttgtggcctgtggaaccctttggtgtgtttctcttaagatcaggaaaacattccccagaggcctccccagcagcctcctctccatgtctttgtcccatccctgaagcagccactgccaaaggggatggagttagcatcatgggcctagaccgatcatgtgagggcgaatgggtgctgcagtcagccacagtgccctgccacactctccagattcacaactcttacctttttttaatggccatgataaggatgccccaaagatgtccacgttctaacccctagaacctgtgaatgttactgtacgtggccaaaggggtctctgctgatgtgtggtgatgtggttaagggtcttgaggcagggaggtgatcctggatgatccaggtgggtcccacataatcacaaggattctcataagaaggaggcaggaaaattggaggcggagagagaagatgtaaggacagaagcagaagtcagagaagggagtagattgcaccgctggctttgaagatggacaaaggggccacgagccaaggagtgcaggcagcctctagaagtgggaaaaggcaaggaaatagattctcccctgcagcctccagaaggaatgccagccctgtggtacctgacaccctgatattagaccagtgaaactgattttggacttctgacttccagaactataagataataaacttctgttgttttaagccactaagctcgtggtcatttattacagcagcaaagggaaacgaatacagcattgtatctctaggctgaccaggaatcaatatagaactttgctaagattaagcatcttgtttttattttatatcttttaaacaagtatgtggggattaaacaagatacaaacccagtccctggtcctgcctccagatagggccagcctggtggtttgctctcaaaatggtaaatgtccgttcctttattcaacaccagtgctaggtaccgagaacacagaagtagggccttgtcttcactcaagctgctgtgtgtgcctcagccagccatttgtttccacaaatatgcccactcgcaaatgggagctcttccagatgtcttctgtctttgtagctcaagccagtttcctctgaagcttattcaaacctgctgatttttgtttaagttcttgcaagggttaggaagagcataagatgttaagcacttccacagatggacctatttttagggtgccccatgttgccgagatcagcagtgattctaatagctcagtcctggggtccacagaggatgtcatctgcctcctgtcttcgtgccagttggacagagacactgctgtttggaagttttctttgtggttctttatttcctctcctctctagggcttcctgttctacagaggcacatacattatgtctagaaattgtttttattgtaccatagttcagctatttcctttcctttcctttcctttatttcttttgttgttgttgttgagacagagtctcagtctgttgcccaggttgaagtgcagtggcgcagtctcagctcactgtaacctccacctcctgggttcaagcgattctcaagctactcctcccaagtaggtgggattacaagcatgtgccaccacacctggctgatttttgtatttttagtagagatgaggtttcatcatgttggccaggctggtctcgaactcctgacctcaggtgatccgcccgcctcagccttccaaagtgctggggttacaggcgtgagccactgagcccggccagttcatctgtttctgagaagccttgggctttcctggggataataagtgaccagtggcaatctatgggaaatacctgggaaggtgacagaagcagtgaagcagagaaacggagtgggggcactgacatttgagatgatcttttccaacatcataattctatcttgaggaaactgaggcatgaattatccatgaagcagctctccatccctgaactccctatagtagcttagcaaggatggagcgcaatccctgttggtactgattagacagggccaggctctagaagcaaaatatgagagctggctttaaagcaccaacacccgtaatagcgtgtagaccaataagtttggtgtacattgttctaggctctcgtctctgctctgtcccatctccctttgtccatcacaagtgccatatacctgaggggataaatgcattgacgctggagcttaagcctaggtttgagttccacttactagtgacataacctgggacaaatcacttgggcatttttcctttctataacatgggatggtcacagtactgatgcggctggaggtgctgcgaggattaaatgagttgaagtgtgcagagtactcacagcagtgcctggcacatcctaagcgctgtacgtcttcctgcaaccttaaacgttgttctccagtgttttaaattaccacgtgcaattccatcgcatggtggtgctctatggttgatttaaccagatccctgtaatgggattttgtttccagtcttttgacgctgtgaacaacatttcgatgactacccttgtaggtaaggactttctttcactcttaatcatttccgcaggttaaatttctgaaatgagaattgctgggtcaaagaaaaatatttcaaggcttttcttgatagacgctaccacattttgctccaggaaagtagtagtttacactcttaccatcagtgagtgagtgtgccagtttccttgtgtggccgggttattaacttttaatcaaacgaaggcccagaaagaaataggaaatatttcccggggaataaaacgttcctcgtctttgcttatatgcagtaaaaagctcagaacttggagagcgcagaaggcggggcagagtgtgtgaaaacggcgccctctgctggctctccctggtgtgaacagtggtagatggcaacgctgagatggccgtggcatcccctgctctttggaggcaggtacagttttaagagactctggtcataaaagtcagattcgggcaacacttggccctcgcttgggttcttttacagcactggtttcaacaggagtgatttgttgcccaacacttggtactctctggagacattttggaggatcacaagtctggaggtgaggttaaaggaagtctgctgttgacttctggtgggtagaggccaaggatactgctaaacatctcacactgcacagcccagtccagcccagcaacaaagcaacattcagcccaggatgtcaacattgtccagattgagaaaaccttgtttttagaggaatagaggccttgccctcagaaggtttctctcttcagactgaaataaaatatagaaatattaatatacgatatatatgtcacagttactattatttggttgtagaaacttgatggttttgcaaaatgaaatggaaaacatgtggagctgaaatagtaaatggggatttctagaagagagggcacaggaaaatccaacccatagtaatgtcacgagtactaataagagagggaatgttcttctaccaattcaacatggttaaacctgccacagatccctgtggctttcccctgaaggtcttgtctgttaaaaatagtgctttatttgacacttttccccaaattcacaaacaccagtgttttcgtaatgttcataattgtgccctccagtgttcagcgcagaactaccatgtgtggttataatttgctctcccacgccccagtaaatgctgattcaagcattgtttttaagagggagaaggaagagaagagctttaaaaataatgttagagaaggtgtgcctgaaggggaaaagtatgatgagaatttcgggaaaatcaaactgggctgcaacttccttcattatttgctgagcttgaagactggtgttgctcaagcccatttaaaaaatgtcctattactggctgggcatggtggctcacgcctgtaatcttagcactttgggaggctgaggtgggtggatcacctgaggtcaggagttcgagaccagcctggccaacatggtgaaactctgtctttactaaaaaaaaaataaaaaaatcagctgggtgtggtggcacgtgcctgtaatcccagctacttaggaggctgaggcaggagaattgtttgaacccaggaggtagaggttgcagtgagccttgattgcaccactgcactccagcctgggcaacacagcaagattccatctcaaaaaaaaaaagtcctattacctcattttgctttagccttgctattctctgaattacttgtattctagaacatttgtcttgaaataattagctagcgtggctgccttggctgttctaaataatgttaacgggattattttgtcagaattgttgagaaaagctacagctcttccctaaacagcagatactatattgattatctttcatgagaagtatttttcaaactacaggtcatggtcgatttataggttgtaaagtcaatttttagattacaatcagcattacaaaaaaaatcagatggaatagaaactaacagagtgtggtatatagtaggagcagcctttggtgatagttttggtgatacagaaatctgtcaccatacgtacatacatgtttacatgtgcctgtgtgtatgcacacatgggcatggtgagaagcttctaaagatggtggcttatattttacaatgtggtgaaatctgacttgtttgtaaagttctctaaagacctccatgatccctgctagtcttctatccctcacctttgcctctgttgctttttcaggtgggaccagggagattggatctgctctcaccaggatgtgcatgaggcacagaagcattgaagccaagctgaggcagttttcgaggtgaggagcatgttttggccccgatcgccaacacccttgcagatttcaggttaaggaagcagtcatgtgtggcacacagcatttaaatccccacaatctgtctgacttggctcattcattgcctgagtattgttaggcatctgctgcataccaggcactggtcgaggccctgggggtgcagcagatcaccagccagccaggcccctgccttcacagagcctgtgctcctgcatgggtctctccttaccctttgtctgtgcaaggagccggtgcagcctgctgaggtcttttgggcccccactgccctgcgggagcctcgcaagaagaggggctgtgaaattggagagtgagatgtgccttggtatcctgtgtgcatcctccagactcactgagggatgtggcagctcacagaccactccacaccgccagcttcccatctggcttccaggcatccagaatagggaagaaatggtagtagctggcaccggaattgggttacaaatgttcaagtgaaaatggacattgctttccaagcagatcagcatcattcagcagttttatgtgattctgtttgggagactgcacaaaatgaaggggcacaccttcagagaccttcacccctcagtaaccccgaggctggcagtgcagctcgagaattttctgggtctcgtcactcttctctttctccaggctgtgcatacttagtgtatatttatgacctgtcatgccgcatgcacagcagaatcttgtgggtcttttttaaaaatagtgatgctgggccccaccctcaaagtctccattgggggtgagataaggcccaggtgtctttgcattttgggggtccctgttgtgcagctctcagaggggtgacccctgtggttctgcaacttggcttgttaatacaaacactagaatatcacagggaaaatgggaagaagggtcactcccaccagtcacattgacagcttcttagtagtcattgaaaaacattcttggggccaggcgcggtggctctcgcctgtaatcccagcactttgggaggccaaggcaggcggctcatgaggtcaggagatcaagaccatcctggccaacatggtgaaaacccatctctactaaaatacaaaaaattagttgggcatggtgatgtgttcctgtagtcccagctacctgggaggctgaggcaggggaatcgcttgaacctgggaggtggtggttgcagtgagccgagatcgcgccactgcactccagcctggtgacagagcgagactctgtcttaaaagaaaagcattcttggaacatggctgttctggagccccggggtttagatgagaacgtttcgggtaattgtgatttaggtatgttttgacaaccacatttaaatcctgacaacagaatgtatctatttaatttctccctttttcccccccgcttggtaaaagcgctttaattgattgtctgataaacccacttcaagaacagatggaagaatggaagaaagtggccaaccagctggataaagaccacgcaaaaggtacaggggcgagatgtctagcgcatcactgcacgctggggggcgctgtgggaagttgccagctgctgcctggcccctctgctaggtttattggtgtcaccaaaacagccaagggcccactctgtccctactctcctgtaggcacgtccgtgtcaggggatgaggagaacaaagtgatcccgttgtgaggctgagtgctgtttctttggtgtgaaacaacattcagcagctgatagtctgatccctcagtggcatgaattgtattcagctgaattaagaataaatcacagggtgggcgcggtggctcagacctgtaatcccggcactttgggaggccgaggcgggcggatcacttgaggtcaggagtttgagaccagcctggccaacatgttgaaaccccatctctactaaaaacacaaaaattagccaagcatggtggtgggtgcctgtaatcccagctacttgggaggctgagacacaaaaatcgcttgaacccgggagtcagaggttgcagtgagccaagattgcaccattgtactccagcctggacgacagagtgagactccatctcaaaaaacaaaaaaaaagaaaaagaagaaatcataggccgggtgcagtggctcacacctgtaattccagcacttcaggaggctcaggtgggcagatcacttgagtccaggagtctgagaccagcctggccaacttggtgaaaccctatggctactaaaaatacaaaaagtatccaggtgtggtggtgcatgcctgtaatcccaactactcgggaggctgagacacgagaattgtttgaacccaggaggcagaggttgcagtaagcagagattgcaccactgcactccagcctgggtgacagagcaagacactgcctccccctaaccctccaaagaagtgaaaatcatcatggcaggtttaaatgccaaacatttatacttaaggcatttcagcacattttgaaagccagacttttaatgatataagcttaccctaggtctcctgcccattctctttgtgcgttgtcccaggtcggtgagacaagtctttgtgaactggttgagtgagttgtcagggaccttgatggtatgagaggaactaagtgtaatctgcacagcaaatagcactgatgctttcgagtgagagtgtttgtgttcccttcacacaggccaaccagaccttcgtaagagcttctcatcccctgttcaggtcattctgatgctttttacatgctaggcgctatgggggctacagaaggatgagtgtggtatctactgaaacagaaataaattaaccctgttacaaagcaaagtagaagactgcaatgaagacccaaccgggtgctctgggagtgtgaatggtggctcctaaaacaggcctctttgtgactatggggatggtttattctgcctgcttcaagctatatcatgaaaatcattctatgtccccagcaactatcagtagccaccagaaagttgccggttcattcaaattattcacccctcccctcatcatgcacctatgctactgagtacttaccgtatttcatgcccgtgcatgctctggagccacagaaataaataagttggtcttggtttttggtgcacgtcctttaactttgtctatcacagacaacagactcctgaagtcgtgtcttcattgttattggaaatcagtcttatgtagaacttcaacaaaccattttgataaaagaaccagggagggtgatggcttatttgtgttgagattcagaagtatgggtacaatagccaaatacttagcagttatattaaaaaagttaatataggccaggcgtggtggctcatgcctgtaatcccagcattttgggaggccgaggcgggtggatcacttgaggtcaggagttcaagaccagcctggccaacatggcaaaaccccacctccactaaaaatacaaaaaaaccaattagctgggcgtggtggcatgcgcctgtaatcccagctactcgggaggctgagacacaagaatcacttgaactcaggaggcggaggctgcggtgagctgagattgcactgttgcactccagcctggacaacacagcaagactccatctcaagaaaaaaaatagttaatatataatcttttatcccccctaccctaacttgaagttagggagagaggcaaattcagaggattaactggatcccattgtgtgttaatcacatcatgaattttcttaggctcacgggatttatccatctgtacttttcattgggtaaaagaaaatagaaccatttgacattttttttcagatggggaaagagttgatagtttatgtttggcccaattcactttgtgttggctgacttggctcattcattggctgagtatttgtcaggcatctgctgcatgccagggactcgttgaggccctggggatgcatagacaaccatccggccaggcccctgccctcagggaacctgctctcctgcgcaggtctctcctcaccctctgtctgtgtgaggagccggtgcagacttctgaggccttttgggccccaccaccctgcaggagcctccttctactctgttaaatgttcccctttgctggtacagcaaagctgagacttcaaataggatgtgtaaggccttttataagagtagttgtgctgagcccattaggagaaggcagcaggtcttgcagagaggtctactcatccaataaaacacaggttccttgattttcttggaatatttccccctccttcccattcccactgcatacagagaagcacgtctcaattttcttctttggggtcacatacagagatgaagagcctaggcctgaatgtgaattgagacccattgtccggcctgcatacctgctaagtggcctgtctgcacaggggccaagaggttgtggggtacaaagctcctaacccccagcctcggtgacacagcacttccttcatcttttcgattcagcctttaactcagggagcgcgacccgagtagcagccacacgcaacccactctgctagcccaagatgctcagacatgacccaggcactgctgcgtcccctggggagcttgtagggggagggaggagagactgtagggcagagcacaggatgttgggggagagagatacagggagccccagaggttggagaggtttggttgaggaattagaaaatgaggcaccatttggagggatcccagtaggtgtacatggtttcatcacgctgacgttagagcagtgaaggggccctagccagatagaaaactgtgcagataggcagggaagatgggggagtggccagaaaagagtggagagctgccacgctgcacagtgattccaggtgtgtataaataggcttagggccagtagaagggaaacctcagagctggctgcaagggagctggccaaggtgaaatgtacagcagctggcaattaattgactgtgagggcagcaaagggaaaagtgtcacaggtgaccatcatcccaggtgtctatgtctgggtgatgaggatgccagcaacagaaatggggcagtctgcgaatgggccagtggtggaggaggaagtgcttggcaggggatgtggtgcacttggactgcccctctgaggtgtttgtggtatctagccacaggattcatgctgaaagtaaggcagctggttcttcttgcccagtctccccactgtgtgatctagcttctcctgctgtatgagacactttttctggattttaacatctgcccagcatcttttccacataggggttttttgttttttgtttgtttttttgtttttgcaaaacactgtggatttgggcccggggaaagtagataatattgaaaaatctttccggatacttgagctgagaaattgtgaatttttttcatttttactaaagtattccccgccaggcatggtggctcatgcctgtaatcccagcactttgggaagccaaggatcacttgaggtcaggagttcaagaccagcctggccaacatggtgaaaccccatctctactaaaagtacaaaaattagctgggcgtggtggtgggcgcctgtaatcccagctactcaggaggctgaggtgggagaatcgcttgaactcgggaggtggaggtggcagtgagccgagatcatgccactgcactccagcctgggccacagaacaagactctgtcttaaaaaaaaaaaaagtattcccaaacggagcctcccttcaaagctggtatgagtgaatatgacagggcaagaccactgtgcattttgttttcgtgtctctagcccctttgttgtaaatgtcatcatgagattatcatattgtattctgataaagccattgacggcatgtcacagtttatgctttctgtgataaatgtaatggctgtttcctacctaacatattttctgttaagcaaagtggtaaaattgttccatattctgctttctcttagaatataagaaagcccgccaagagataaaaaagaagtcctcggatacgctgaaactgcagaagaaagcaaaaaaaggtaactcctaaaattctgccactgatgttacttcctgatggagtacttgatttgtttttgaagtgaaaggtgttcacttcagagacttccttaagtatgacggccctggaaaacaggtgggagcaaataggacctatctgagttcacattctcaaagtgcagaataggtattaatttgaggcctttgccaagtggtacttgacgtgttccttcccccacctttgtcttccaagtttgacagtttccatgcctattgtgcttcgtaatgatacctataaatttcttagaagccttgggataatgcagaaaggcctttatgcaaatgttctctagtaattattacagaaattatgtcattttctcctgcagctttcacagcctataatcttcaaaaccctttattaagtcttgtgagaatgctaggaatgggtgcaggggaagctgggagtcatggccatacaggggattttccatggtgttcatgagggaggagcttgataatctaccactgagcacaaccaggcaagatgcctttcccccacatccttgtttatcctccttcacaaacaaatgaatcgtcagatctttgacccacctttgttcctccagaatggactgggagtttgaagagaaaaatctagcagcatccactttgcaagcacttgtgacattttactaccacctaaaaatgtagggactttctcctgagctagagaaggtgacattccttccagtctattcttctttgacaccaagtttctgaatctgctgcttcacaactgataagatgggattcttccgtcaggctgctctgtgggtggtgtttaccattaatttgagacaaccttttcgagttgggatcccccagcctgaattttctctcccctaaaccagcgttctctgttggaaatagaagacacatttgtagagatgggattgtggagggtggtgtgtagtggggtgatgataggacacagtttttaaccttgaacatttctataaaatgagccccccaccctgaattttcacaacaaccataaacccattttgagataaaggcagcagaattttcacccacaatcagattttccatcagcattggccccagcagtttctttcgtatgttttattttagtctggagcttctcagatttgtatcctatctaaccagggcacctgggagctagtgtttgacaagtaatagggtttgtgacatagtaacattttagtgactgtagaggtaagcatttataagtaaaattactaccatattccatgaagtctgaggcccggaagagagcaggctggtcacagttcggggctgaactccacataactgacaggttggcagctttgagagaggaaggattcctgggctgggagaggtggtccagggaagatgcttaggcttagaaaaggtttgggagtttggtgaaaaggatgaaggaagaaaaagtggctgttttccctcagctcttccaccactcagttttcagaggccctaagttcttggctacagtgataatccttttatctaagttctgcatggaggctgaattggttgtcctctgtcactcaaagtcactggcattgcccaattagcagaatttatacctctgggtgaagcctgatagggtgattgcaatgcaacatcaaaagaagtttctggcaattagaccttcctagcactggctcgggctgcctgcaggataatgagctccctatcaaggctggataggaagatatgggacccatagaatgctggactgtgcataacatgaagagaggcatctggccctgggacttgggaatgattggcattcagttgtgtggtttcttagggcacattggcctgacagatgagagaatggaggttgggatcaggggtttctgaagcatctgtcttctcagccacagcctcacaccagcagtctctggcaccgtgtcttttccacacggtggacttaggtccacgagatcggtcagatccatagcttggaatgttctagagaatttctagttacttcaagataccaccagaaaataatttttatttctgtcctttataaagatttttttctaaaatcagtaagtgcagttttggaccaggtgttctatttgtatatttctgggatgaaagcagccttctgaaaggtactagagtcacattcggactggaatcttttatggagagctctcctaggaggcatatgtatggctgagaatggactgaagaaaacacaactcacttaagggctggaagaaatctggtcatttgaggctttcagttgtttaggggtctggttagctgacatttccctttctactagaacacctcgagggatctgtttcatctccttcaagtggcagattcccggaccctcggtttgtaaaagtgttagcagttccttctgacgcaccacgcgttcggatggatgaaggttttggatacatttttttttttgtcctgatagacggaatctgatgtatgcagccagataatcacttcctttttaatatgtttccaggagattctcaagcagcttcctgccatgcctttttcaaaaactctgatctttgatctaaaaattctctggactctccttttagcatttcaagtgcctttgtgcatgtaagcatggttttaccaccatccttgacgtgggcagacacacacggatgtgatttttgtgagcggctcactttccttcttactctgcagataccaccttttatcacattcttcgactctttcttactatatagagaggtggtttgtaatctaaaggtgtttaaatatttccttcaagaaactttcaatggtttgcctttggtaggttttatctcaaaatcattttttagcagcttgggatatgctatggctgtggatgagtgtgcctgtttttcttgaaggcaagcttgtcagatgcctactagaagtaaacacgaggcaaggagttagccagtcctcaccctcagagaaattctgggctcgtgcacagggtcaagagcacggggcagagccagcattgccgacaggtggagggacggaggcggcaggatgctggggagatggtgtggagcggacccagtaaccccaggctctgaacagtgtctcttgagccctcttcctgctccatgataatcagcttattgccttggaggtcttggagttgaccacgacccaatggggaaaagtaagagagagcatcagaaatgagaggcgttttacattgtatttacctacgtgtgccacccaaccgtatgaactcagcagccttattctcatttaactcccatgttactatcaatgtgaattaaaaattaattctgggctgtgcgtggtggctcacgcctgtaatcccagctctttgggaggctgaggcgggtgcatcatgaggtcaagaaatcgagaccatcctggccaacatggtgaaaccccatctctactaaaaatacaaaaattagccgggcgtggtggcgggcgcctgtagtcccagctactcgggaggctgaggcaggagaattgcttgaacctggaaggtggaggttgcaatgagccaagattgcaccactgcactccagcctgggcaacggagggagactctgtctcaaaaaaaaaaataaaaaaattctggtaaagccttctgtttccatctgtaactacaaaaagtttataagggatttttaaaaataataatggccagcattcattaggtacttattatggtcactgttccacttattaccatgacatcattaaatctaagaagtcttgattttttttttttttttttttgagtcagcatctcactaggtggcctaggctgacctcaaactcctgggcttcagggatcttcccgcctcagcctccctagtagctgggattacaggcacacaccactgcgcccagcagggacttttcttgagagagagagaactggaacattataatatgttaactgcacagctgacatgtaaatagttgactctctcactttccactagaggctgcaaagccaatgttataaatgtaataaacagactcacagagttctatacgagcatagtatttgctgttatactacaattttaaactctttaattttttttttccattttcatcccaccctaagctttgtttcctaggaatttcctagatatttttcaagtgatggtaaatgacactcgaaaggttttcttgccaaagcttggcttcttctgggtatatattcttcatctctctttttaaaaatccttgctgtcttctctaggggtggtcattactaactgggaaggttttgtttagatgagaaggaaggaagatattagtaaggcagagaaggggaatgtggatgtgggtttaatcagccctaatagaaaatttggtggcgagccatggactgtttaacacatgaaacaaaggtaagactgctgctgcttgaataccagtttgactttattattttcctttttgtgtcaattgtgtatcctgcactttctcaccgtgtgcccccccgccagtggacactcttggtaagtctaccatcccaaatctctggtggctgctcacggtgtggtccttgctgtgggctttccgtggttgtccagacctctgctagctgcccaggtttttctaccagctcaaaacaatcaactgtgcctacctaattttccacaactttaagaaaattgtgtgtgcgttgtgttttaattgttttcttttttggatgtttagccatttacgatgttagcacaacactctgagagcctttgaatcatcgtaattcaatattagactcatggaaaaaagaaatacagagtgacttaaactgtcatttccacagtcaataagcatttttgcatacatatatacctgcgtatgtatgtatgtatatatttatgccacaaacagagctgcaagcctcaaaataattctcaaatcagatttggttgtgttaagcttgcaaaacatctttaactttgtcctgtctgcaagaccatatagttctttccataaccaatgattcattttttaaaaaataaatcaaaagtatttcttatttcagtagagtttgtgaaatgtttcatttcagaagtatcagatcttccaattaagtaatcagaatgattcttcttgactgaatgttgaacttcactctgtggatgatcatgctgccaaaacttcaagttgcttttggagtcttgttgctgtccctctgtcctgggaggtctgtctgcgaggtgtctgtgtggtttatcttgcctgagtgtgcccaggtgttccctgagcattttactgaacagctccaaagaggcttttgaagtggcttctgtcatttacagcaaacccagtgcacaaaggtctcctttgatggttggggctgacacggcctctatttcccctcatggcgatgttgggctagtggttccccaactttaaaaaggatcatcctttccagttctcaacattgtgattatgaaacagcttgcacagtttctagtaaacctttggaaggaaggtaagacacagtcactgttttgcttattgcagtaaaattcacatcacagaatttatcattttagccgttctgaagtataagtttcagtggcttttagtacattcatggtgttatgcaaccatcgccactatctaatttcacaacattttcattatccccgaaagacacctcatgcccattaagcagtccctccctgtttcacagtctccccacccacgctgaccctgacaaccactcatctgccttctgtctctggatttgcctattctggacattttatacaaatggaatcatgtagtacacagccttttgaggacacagtcccttgagtcttgagttttactggaacctttgccgagagcctgacatgagtcagttcatggagtaaatagagcattttatttatttgaaatgatgggaggtcagtttggaatgaataaagaaactgtatagccttttgactttgtaagttctaaagattctgcttatctttcaaagagaaatctctgcaaccccctttaattttttctcttgtaggggctggttcataggcaaagccacagtgaatttgggtataaatacacaagaaaagctatatgatttgtagctctcataaatgtttaaaatatttatacagagagaaaaaaataattctttaattatttttaacagttggcttggctgggcgcgttggcgtggtggctcatgcctgtaatcccagcactttgggaggcctaggtgggcagatcacctgaagtcaggagttcgagaccagcctggccaacatggtaaaaccccatcacgatcagtgacacgatctcggctcactgcaacctccgtctcctgggttcaagcaattctccagcctcagcctcccaagtagctgggattacaagtgcctgccaccacacccggcaaatttttctatttttagtagagacggggttttgccatgttaggcaggatggtcttgaactcctgacctcgggtgatcctgttgccttggcctcccaaagtgctgggattacaggtgtgagccaccctgccagccagtgctgggatgaatataagcaaaaggtgtaacctgggggcagagaggaaggagcctcactaagcctgggggtagggtagtgataatgaggaggagcatgaggggtcagctgttgaagaatgaggaggggatattcaaggtggagaggacagcgtgcaccaacacatggctcttgtcatttagaaaggagcatcagcaacagtggtgaagggtagacgtgtcacactgtgtgtgtgatgctccagggacagccttgaggcagggctgtcgtcccaccaagggtggactgtgtgcatagagaaccatagtgacccctggctactcagcctctggcttcctggaccgcgtctccccaccccacactgacctgcctccagaatggttcaatcactgggcctcgattctgatcagactccaaagtggaccccaaatgcctctccacgtcattcttcctttcttggaaaaagcctgtgaaatgtgaatcctttcctctaggcacagtggtttgctcatcccccagccgtatccagcctatgcactcacccacaggaatgtttcttgtgtttacaaaaccagcagaaagcactctcagaatgaccctgagacctgcagtcaatggatcaatggctctgcctctatggtaaaaattgaatctgtgtagattccctgcaaccccacccccattgatttttgaggagggatagtactaggagctctccttcccacagggatgtcagtggagtgaggaggaagaacaaggagcagagggtgggatggttccagccagttcttcgaggctaagcccagggcttagaaggctgatgaggaaatacagaatgtaggcacagccagaccccttctgtctgggtggaagcagggatgctagaattttacccttagacctattgtgaccatcagaaagctgcccctgacctgaatccatagatgtctgaatttaactcagaaatctcctccaaggccgggcacagtggctcatgcctgtaatcccagcactttgggaggatcacttgaggtcatgagtctgagaccagcctggccatcatggcaaaaccctatctctactaaaaatacaaaagttagctgggtgtggtggcgtgcacctgcattctcagcgacttgggatgctgaggcagaagaatcgcttaaacctgggaggcagaggttgcagtgagccgagatcgctccactgcactccagtctgggtgacagagtgagaccctgtctccaaaataaaagaaatttactgcaaagggatgttgcatttcaggtgaatgtatgtagccttcagaggccgggctatttattagatgtattttataactgaggattctaggtaaacacaagccaaacagatccaccagaagcctagagctgtgaactcttcctttgcaaagcttgtctccagtaaaacctcacgtagacacaactccttgagtgccttgcccactactctggtctcagaatgccctgggtgtgcctgtacacaataggactgttaaggtgcagtgcacctgacttccctgtggctgcattcaggggcagggtagaggtatatagagtatggaggcacgccgggagctgagtatttttcttagcgttaattttcgaccaaatacaaaacagcagagaaggaaacagacaacttgcttgaaatatttattccttgcataatatggttttcatctccctagagaacactaacgggatgggcaaagcctgacggaatggcagggtggggaagcagttgctgcctctcttgagttgcaacccatcagccatttatggtttttgtaggactaattgattcacgcctggtgccattcttccattcataaacatccttgactgctgcagatgagtcctgcaaaacactccagcctccatttattagtttgttctttcattcattcattcaggaaaggggtatgacaagcctcctctgtgctagactctgttagctgctaaggaggtaaaagtagcatctacactcaagctctccccagcacgaagaatgcatttatgttccaacatcaattctctgactgcagctgctgtcctattcagttatgacacacctagtgttagtgtagaccccacaagctaagagttcagtcccatgagactgccccaaattcagtcaccagccacaagtggggtcctcagattcctcacacttctgcccagccgaccacaaatttggggttttctatgaccccctcgcccatcaagtttaataattctctagaaggacttgcagaacacaggaaagcaccatatttacaatgactggcttcttataaagaatgcagattgtagccttgtttactacattaaaggactctgctgaagcccttgaagcctttttggcttctagataattccaccgtgacagtgtgtatttggattagactgtggcttaactggacatccagttagcaagtggtggttgttgtctaggtgacagatgatggtggcctgggctcagggaagtgaccacagagatagagaggaagacaggtggattcaagagctacttaggagaaatgcaaatgaaagaaggaagagttgaaggcaatggtaaatttctggatccggtagtcaggttggcagatggtggagtatttctttaaccaccaaggaagaagcattttggagccgtgaggatgctctgttggagacactctggatggtgagctgcaggttggcctgggacgttttctagttgttctctgaaatgtctctttttatcctttgctttgataaacaactgattgcccagggaccagtgaagaatcttgatgataaaactcctacttgtagtgaaagaatcatgggatcttttgcattttcttacatcaaaaacgaccttgaactgaaagctctctttaaaaaacaaacaaacaaacaacaacaacaaaaaacccaccctaccctgcatactatcacctgctaaactacccagtgtcagaaggacaacttcagagatgctgtggtggcagctgatagtgcctgacatttagtgagtgctcagcacgtgccgggcgttgttctgaatgcttcatgtggattagttcatttccccttccagcagccctgtgagctcaatactgttattatttacatcccacaggtaaagggaaactggggcacagtaggttgaaaaataacggaaattgagtttgtttgaaaaattttaaggctaaaagccttcagtcttatctaatcacatctatcttttgatttcgggttggatttttcttttgggaatcagtcaaaacccactgtgggttattaagagtagaagatgacttataaagggataatgaggatagcctccttttgctgggaagacagaatttttcattccaaattctaatctccagtgtcaccttgcatgtccatttctggatttatattttgtattttagtatttatatcccatgtttcatttgactctgggatacaagcaattgtcagatgcaccattattttccagaccactaagaaaggaaaaaaaaaacctaccgattaaactgtgacacaccattgattgtaagacacaccctgattggtgaggtgtaaaaatgggggaaagtggctctcttagaatgaaatatcttagaatgaatttgtgtgagtcaggggcaggtgaaagtcattttgcaggattctaatggcttctccatacacctctctccgaagaaagaaaggacttggggtgttttgctgactcctggcagcattcttggcccaatgtattctgggtttgctcttccccgttggagagccctttgccagagaacagccactggcttgttgagccaggaagcttaccatgtgagtgcagcttgtgtctgaagaggctgggccagtacagataatacgaatcacatttcactggctttttgatcggctgtttagctcctggcagcttgttcccagcattcatgtttgctgtgagtaggaaacacaaagaacctcgtcttcagaacgagaaagacttggggctggattctagctgtgcccgtggctggcttagtgctcatgattgtggccctgtgcagaccactttgcctccctcagtctcagtttccccatctatcaaaacggatattcattcctgccttgaatgtgttatgtaataatgattaaggaaaataaaatgcaagtgttgaagttgatacaggatctttatttcattccagaaaactctgtaaagtttcctcatttaaaaattccttccttctgtggccgggtgtggtggctcacactgtgatcccagcagtttgggaggccgaggcaggcagatcacttaaggtcaggagttcgagaccagcctggccaacatagtaaaaccctgtctctacaaaaaatacaaaaattagtcggacatactgtcttgaacccaggaggcagaggtttcagtgagctgagattgtgccgctgcactccagcctaggcaacagagcgagactctgtctcaaaaaaaaaaattccttccttctttaggggtgctgccttggcccatgacatggtgcattcacaatgctttgccccaggaacattttctgcaaagagaatcatcatgatatcccctggggtggggggataaggggctcctggctgctgttcatcagaattccccagcgtgaatacacaagacctggaaactagcaccaggaaaaaaacaaaactcaagactgaagatgcctaagatattacagaagaaagccgaaagcaattctttgctcaagaattttgtctgggaagcccatcgaaggcaccccctccctcctcctcttggctgcttgatggtcctggaattgggtggttctgaagtattaggccatttaagggaatgatggttgaggccagtgagcaaacttggtcacgttgtatcaatgcttgattcatttacaaatatttgaacacctgccgccttccaggcaagtgtgctgactgaggagatacagtactgagcaaaagcattcatgggttctgcccccgtgggactgccccctgactaggggagactgacgtcaatcaaataactagagaaataaagatgaaattcaaaccgggggtagtgctgtgaataagtataagggatttcagagatcaagtaagagaagcctaatctggggagaaagttcacagcaggattccctgaaggatcgagaattaagcgagacctgtaggataaaaggtgttaggaatgtagcagagggacagcagagtgaagatgggaaggggcccaggccctggaggatgagagggagaggagagagggagagaatggcccacaaaggctgaggctatgaggtagacaggcaatgacctttcatgccttgcagggcaggccatgttaaggatattgttcttttcttgcgagcaatgggagctgttgaaaagcagtgagaatatttgcattttgaaagtaatccacagccgggtgtggtggctcatgcctgtaatcccagcactttgggaggccgaggcaggtggatcacttgaggtcaggggttcaagaccagcctggccaacatggtgaaatcctgtctctactaaaaatacaaaaattagctgggcatggtggtacatgcctgtaatcccagctacttgggtggctaaggcaagagaatctcttgaacctggcaggcggaggttgcagtgagctgagatcacgccactgcactccatccagcctgggcaacagagcgagactctgtctcaaaaaaaaaaaaaaaaagaaaagaaaagaaagaaagtagcccagggctgctctgggcgagctagtccaagtgcagtctggggtgagacattaggggctgttggcatctgttcaggtgagagatcgtgatggcccagtgagggtagaggtagcagaggtgagacgaggatggagtcaagtccgtgggagctggaatagccaggaccagcgctcaaggagtcagtggtgactctcctaacactgccgatgggagtgaagagaatgggcttttgtatatattaaatcagtaccaacacaactctctgaatttgtggacctcaaaagatcactctatcttaaaaccagtatatccaactgggacatgaaataatttctttcacagtttttttttataaatataattacatgttgtattagtgaatttaataaataaacattgtagttttagcttatcatctatcctgaatggaaatgtcttgactataattatagcaatctttacagagtatacttattttagaatgctacaatttgagagtcctttaattataatacacatttaaaataactttgctataatcataggataacttaaatttatattttccaaattagataacactgggttcagtggcctttttttctttcctatgtagatacagtttttaaagtcagcattattaattatggatagacatgtgccttataacttgtgaaaggaagtaaagatacatttttccaatttctgacaatcacaggctgttattttttaattttattttatctatttatttattttagatggagtcttgctctgtcgcccaggctggagtgcagtggcatgatctcagctcactgcaacctccccctcccaggttcaagcaattcttctgcctcagcctccccagtggctgggactacaggcgtgtgccaccacacccagctaatttttgtacttttagtagagacggggtttcaccatattggccaggctggtcttgaactcctgacctcatgatccgcccgccgcggcctcccaaagtgctgggattagaagcatgagccaccgttcccggcctcataggctgttatttttttaaattgctaccataatcaaagcccaccgagcaagtttggtcaaacacaatgtgtctcaatctggtgtctcccgacttctgttcaccatcctacacgagagttgagaacattctgaggtggtctgcagccctctgtgttttgttattagaacatcatagaatagatcgagagactagaagtagccctctagaccagccctgagtcatgtgacccaacaaggcccacaattggccatgctgtttggctgcttgcagaggaaaagcaagggtttacagctttccagagcttccctgctggtggactcgtatcatacacacattaagtatatctggattaattttgcactagccagcattttaaaatagaagagaaaactcacagttttcatagtgctggtggcacccagccttccctctgtaagccgttggccacaggtggtgggtctctgtgaacagagcacctgccctgaggcagattccaggagagaatgggagaatgtttttacaggtttcttgtctactaaaaacacatgaaaccagtggctcaggtggccagattaatgtatggtgatgattactcctacatccttgaggaagaaattgaaggcatggtaaagaattattctgaggggtggaggtagtgactacatggaagaatgggtgagtgggtcaccttgaaaatatgctgaaacacccaggcgctgtggctcatgtctgtaatcccagcactttgggaggctgaggtgggaggatcacttgaggccaggagttcaagaccgtctggccaataaagcaagacccaatctttataaaaaaaaattgaaaaactagctgggcatggtggtgcacgctggtagtcccagctgcttaagaggctgaggctgcaatgagctatgatcattccactgcactccagcctgagtgacagagcaagactctgtctccaaaaaggagaaaattatgcagagacttctcaagcagcaaatttcttatatatagtagttcccccttctcctcaggggatatgttccaagaccccccgtggatgcctaaaactgcagatagtacccgaaccttacatatactgtggtttttcccatgcatacatgtctatggtaaagtttaatacataatttaggcacagtaagagattaacaacaataataatagaacaattataacaatatactgtaataaaagtcatgcgaatgtagtctctttctctctttcaaaataccgtattttaccacaccatgggtagctgaaactttggaaagcaaaaccacagaggaggggccagtgtagtataatcgttgggtagcacccctccgtggacttagatacatactatctacacatttgtactcacttgactgatgagagttatatacacaaagctgtccatactgtatttactggccatctaaggcattttcaagggtgatctttgactataattttctcataatgtgctaacttagaacttattccctgtctgagaagtgacttttccttactaaaatctgactaccttttctattgggatgtgctttaagcctgattgcctcttgctccaaattaaactttctcctctgcttatgagtgaaaaatacagaatatgttcctacatccaaggcaattttccctgaccctttctttcttcagaccaaatggttcattgcatttaatgttctctacatcactaagagggatagatggaaactgcagggcccttcctgcgaggcggtggggcagagaataggttcagtgttaagggaattaggcagtgtggctcaaccctgcctctgtaccattctttctgtgaccttaggtgagtcccttgacttctctaggacttggtctccattgaaacatgagcagattggcccaattggataaccccttccagctctaacattttgtgttgaaactattaaacagacatttatcaagcacctgctgtatacacacatgacattgtactaggggctgtgctgggaaagaccaaaatcctgccctgaagaagtttaggaagtatctctctggtttgagtgataggtaaggcccctgcataggcagcccaaggtggaagctcatgagctggtgtcccctgctgtcaccctgctgtccccacctacagatcagatttgtagtagctgctcctttggacacagtgcctcttggtccatgtttatcttttagggcagcaggcttcttttgcaagaggccatggtctgggggccatactctgtgtcacactactctgccattgtagggagaactggtacaggcaatatggtaaataaatggatttggctgtgttctaataaaactttatttgcaaagatggtttgctgaccatgtgttagtcattcaaaagactaacaccctgtcttaaactccagaagtggttgcctgcacctaactggggtctgtggacctggccagataattcctaaacatgggccaggctccgcatagaccccactttcagtttttcatcatcagagacctgtctggaggtcttgttattactgggcttgttctacagcaagagcattcaagactctccactagagagtcaaaggaactgccaaggattcccatgggcccccagagccaggagagcggatgcttgccacctttgtctttaggagcagatccttctatccagacagaggctctttgattgagattgacccaacaaagccagcccgtgcccgtttttggaaacacccacaggctcttaccttgtttccacatctcttagcctcttcagaatgttctgcaaggaaagaatgctgtctggctctgtgttccagggttgtgttggcagaagagttggtgggggttgtgcagtgtgagaaggcaagtcatgaagagttgccccaggacattttccttgtcaggaataagccaggctaaatgtgccctttgggcattgaaaattggaaatggctggtcctagaaaaacagctgccttaaatccttttggggcatgaataaatactttttttacatcctggaaaattgtggttttgactccagcaaggaccccagggaggaggggcacttgttccagaagctggtatttcagcaagccgtgcttgggtctctgttttttgcagggagaggtgatatccagcctcagttggacagtgctctccaagatgtcaatgataagtatctcttattggaagaaacagaaaagcaggctgtccggaaggctttgattgaagaacgtggccgattctgtaccttcatctctatgctgcggccagtgattgtaagttaatggaaaactccagaaggtttaaactgctggtgtagaggtggcttccttctaattttatccatccactgttgagtcatggagaatctactgtcaggaatcatgatggtggtatctcctgtacagaccagcgattcagtgcaagttgatggccatgtagctcactcctcattcactgttctagtaccacttgttccccgttactttgtctcaccaagtcaagaaggcccagcagggtggttctcaaagtgaggtccccaggtcagcagcatcacgtgggaactggctagaaatgcaagttcttgggcccaacccagacccaccaagtccaaacctctgggggtggggacccagtcgtctgtgttttaaaggagcactccaggtggttttgagactcactgttgtagccgagtactaaggggtgaccatgagatgaatatccaagagcctcaatgaatcaatttagacttaatttttaaggaaatcatttgcatgccgtaattgagaacttgcactgcaggcgttctggaagctgattcgaaggtaccagctcatttcccttagccctagcaaaatgtctgaatttgagttgttcccctgagcacagaacttttccatggatcgttctagcccggcccgtggtcccaacttggcacttcgataaagcacatgggatgtttcttccatggtccccagctcctgtcttacttgtcttttactaagttgctggaaaagcacaagaaagaaggggaaaagttagcttctgttgaacacacaggcactgtcacaaagatctggaccaaaatatatccaagtcgtgtcatccattgaagctaagcaacttcagaaaagggccacagtatgaagagggctgtgctgcaggatcccgtgggaacacacagtcagaccatctgagcaggcctggcagtcccccaggccctgggagggaggcctgtgtgttccccactgtcccctgtgcacaggtcactcctccattatggcagatttctttttccatctcatttcccaaaagaaaaggcatgtagtgccttcagcaaagatttgccagtcccaacagtgccttttctgaaaaactgaaagggttatacagagaccctaatgaaaacaattggactagagcgatgaagggaatcactcatgataataacatttcatgaatgacttttccttcaggaagaagaaatctcaatgctaggggaaataacccaccttcagaccatctcggaagatctaaaaagcctgaccatggaccctcacaaactgccctcctcaagtgaacaggtaggcttcaggggttaagcacttacaggatcaaaccaaagaggtaaaagctcaaggccctgagtgttcctgtggcatgtgtcacgtcttaaattgtagtcatattcaccacgtccttcatgatgtaatatatgaaatcaccacagcgagctgttacatagaacctattgtgtgtcaggcactgtcccaagctctttacatagcctgacttcctccattcatcttcatgattatgcttgttttatagagaatgatgcagaggcactgagagatggagtcacttagccaggttcagctagctagcaggtagtggaactgatatttgaaccaagttggtcaggttccagatcccatgcacttaattgctgtgttcatctgccctctagaagtcaaccctcctaagaacacgtcgctggtgtgttttgattgacactgtcaaccattctccatttctcccattctaattgagcaatgcatggagagctctctcatcttatgaaaaagatgacatttttatgctttattcatttaattcacatcacacgcacactatgggaagagacatatttgggggaactgatgaatcacatgctggcttttgtgcttggtaacaatcttttcgtctccttggagagctggctcagagggcaaatttgggagctcatgttttctattctatcaaattatatttattagaccagagcatgcatgcattcacttgacaaataaacatttactgagtgcttcttatgtgaatgaaaggtggaccttatactcatgtggtcctttgtcaagcaacggagacagatatagaaataatggtgaaagaattggcttgttcttgattctgtcaggctttaaaatttctagtgctggtcaaatagggcagaaatgaccactgaatatcaagtggttaaaatgcgctaccaacaagtctgggaaccatgattaactttatggcattacaagaggaaaatcctgtaaattctagccttgggtataaatggctgttataaattattaattggtcactgtatttctccctctctcgactgatatttcatgattttccttttcccttcctttccttctccctattaattatagttttactttctcagtaaaaggattatgatattgatggatttggtactgtggctcttcaatttaaaaaaaatttttttaacatgttttgctttcattcccacccccacgatggcagcgttttgatgctttggtggatgttaagctttgatggctaacgcttcccctctcagcacctcattcacccagctggctctgtccccttaggtgattctggacttgaaaggttctgattacagctggtcgtatcagacgccaccctcttcccccagcaccaccatgtccagaaagtccagtgtctgcaggtgagtgaagccggggtccactcttgctttcaggacgggtcatttttctttatgctaatgtgagcaatggagccagtccttatctcttagaatggctcattctcaaacaggaaatgggatgatgagctgaaagaatggtaataattttggtcttgctctttagtctctggattaattttggatcagaaagaaaaccccattagcccttgacttgtggatgtagcttattctctctcacttgtatgttgtagggattttcctattctatgagatcacatttgattttcctgtttagcagagtgaaaaccttctaaggcctaaaaaatggtgaacctgggttgatttttacacaggctgatctcactgttgccagaacaaacgaaggaagtaacaatggcttatgccctcatttcaccccatatttttgtttcagggtttcataaagtaaatagagttcttgctctgtcagtcactgctactactaccaccactaccacgaccacacctgtattaattagtactgttccctattggaacaaaatctgttggaatagttctgccatctgcaaaactgttgtctagcaattttctgttagaagtcagttcttggcttgccgagtaggaaagtttcttttcctctccttgaaagatggaagcatgatgtaccatctatctctcttggtatagtagtcctgttactcttttaatttaactttcaaagccaaatgagtttccacttcctgtgtattagcactgagagtagagggcaggatgtatctgctcaatctgtctgtggtgatgttttggtgcacgctgatgcctatttcctttcactgcggagcttgtacactacacacttagcaggaagttcagacctaagacgctgcatcctggacattctgccccctgaagatattggtttgtttcttatcttctgtcgactgtgtgtgtgtgtgtgtgtgtgtgtgtgagtgaaagagagacctttttattgttgccaagaaaaatctctcattagtgtaaaacaaagttgcgtggctgtttttttcttccttataattttagtttgagtagaaaaccatgttgcactgacatctgcaactctgaggctgccggggtggagttgctgtgagctttactgtcggtccccaactgccgccttctggctgactggaggggaaagtcaaaaatcatgatatttattcctcactgcagcgatttcctccagcacgctcccctatgtctgtctgaacatttgcaccaagtaattctagtgtagaacagtcacgcggcccttgagtaccttattagctgccagattttgcaagccagagtctcttgcaggcttaggagcagaaaccatgacttttcctatcccagccctagttatttacttcatccctgctgctgcctctacaactgctctttttatttcagctccgtttgtttggaccatgggagtctgttttctgctttttatgatctaagttactatacagagtgtggagcattttttttttttttttttttttgagatcgggtctcgttctgttgtccaggtggagtgcagtggcataatctcagctcgctgcaacttctgcctcctgggttcaagtgattctcctgccttggcctcccaagtagctgcgattataggtgcctgccaccatgcctggctaagttttgtatttttatcagaggcggggtttcaccgtattggccaggctagtcttgaactcctgacttcaggtgatccacccgctttggccttctgaagtgttgggattacaggcgtaagccaccgcacctggccaggagcatgtttcttttgagtggagatggaaggcagacagaaatccagagcgggtgtgtcattatttgacatcctgtttactgtgccatttcaagagcaaacagctgagcattgattgcccttagtcgctgaaagctgcctgcctcttgccaagtgtgctattgtgccagacccacagatattttaacacagaaacagctggggtcagagtaaaaacattaattaaagcatcactttgttaaaaggtaaaacatatgcacaccaacatagtgagttgatttgctgatgttcttgacagcgggcttgaccagactcagctaggatgaaatcacctcagcaaatccatcggcagtgcttagctgggttggccttggtcatgtggacccagatggtccatccaagaacattccagtcatgctgaagccccagtggacttttgctgcaggctcatggttcctgcaggcagattaaccctgtcccttttcttgctactgacatcagctcccctcgttttggtggtaggcgaagcagcagagttgggcgcacttgacgttttagaaccccagacctccctcgtaagaatgccacatggttaccatcggagacctgagtcctggcagctgtatttccccctgggtcacctggaaaagcattttgttgactaccttcatgatttggtgttttgaaaacgtgttttgtggtttgcactgcatctccagggcagagagctaattgcattatgttgtgcttctctctcttctgcctcatctgttcccctccttcctccttcctcttaccactgctcccctttctttaccttccgtgcccacccctcacccctgcttgtcctccacagcagcctgaacagtgtcaacagcagtgactcccggtccagcggctcccactcgcattcccccagctcacattaccgctaccgcagctccaacctggcccagcaggctcctgtgaggctgtccagcgtgtcctcccatgactcaggattcatatcccaggatgccttccagtccaagtcaccatcccccatgccgccagaggcccccaaccaggtaagggtgcccttggctccaggagcagctgtcacacctggtgtcctgaccactgtcagtggccagaaccaaagaagcaccttggcttagacaatcccctgcccactgacttgagaaacctctggtttaatttctcatctttagatgtattgttcccctaaagggagaggtgctataagtgggtttgaagcctgtctccatggtggtaatggttgcattaccacatcgatttggggagctctcacgtaagtagatggattgaaagaggtttgaccactctcaggcgtccctgtaagtgcccagcttggcataattaaatgctataattaaagggcattgcacaatggggacacctcctcccccacatctcaggttctccctgaatggctgagattctatggttgaatagcgcttccgataccatcccttggcgctctcaggttccttttatcaatctgtgttgagaatgagaatgaatcatcagagcttctgcacataattctgttggcacttagattctggaagggaaggtgtggcagaatctcttcaactacagctgggtttaatggtgctaggcccagcccagcccagtggttccagctggagcagaacgcaggagctggccagggcatctgaacactcttcatgtgcatcatcaatgtatgtgatcctctctctgtcctctctcccttagtgtcattgggttggtgtcggccttgaacttggcaagtagctctacatacagaatgctgggtgccccacagccccacctgctgggaaacccatgtcagagctctgcgttcctctcctcacagctcagcgctcccattagcatttttcagccatcctggggactgtggcctctgtctgccttccttggatacacactcaattttaaacgcactcagagccaagagccacggctatagtttgagagtgcttgagagtgcgtgtcccacctggggtgcttggcttggtctgtaaggagctcctcttccccgctgtgtgcttcactaaaccatatgtgctgctcacaagcagagagggcaaagggtcgggaggagggctggaatgtgcagttcctccgggctgttctagtgtgcagcataattgtgtgtgtgtgtttaattgacaaattaacatagtagtgtgcactgacgcccctttctgaaaaggagaagccacgtgctgcagccttcccttccaagactgtgagtgtggatggggtagaacagagtgtttcccatggcatggagggaagcagaagagggcatattgggtttacttaaatctgaaaacctgtgcccaagacatgcgtggctagcaactctagggtagctttttgttttgtcatgttatgtttttaagacagtctcgctttgtcaccccaggctggagtgcagtggtgcaatgttggctcactgtaacctccacctcctgggttcaagcgattctcctgcctcagcctcccaagtagctgggattacaggcacgcgccaccattcccagctaacttttgtatttttagtagaggtgggcttttgccaggctggtcaggctgacctcaggtgatccgcccacctcggtctcccaaaattctggaattacaggcatgagccaccgcgcccggccactagggtagttttaatgagctcagggatgctacaaaacttaatagagaattcttattttttaagaaaggcattacgactgcttattattataaggtaaaggggaaattgaaggtcattgtacagatcacattagccagagggtacaatctcctgaaggcagtaacctcccctttattagggagaaagggggcatacatctaggaggcgcaggagcccttcatttctctactgagtaacacaggtctgagatgaaagccgagtgatggaatttgttcagaattctctggtttacctccctccactcttcaaattgtgccctcacccatctgtgcccaggagtggggccatgtcttcaatgagggtctcaccctagagccatttattccatctgagtcaagaggttctttataaaaaatgagcataattccaaagaaatctgaacctgcagtcctgcggtgggttactgttttgttgttttatttttgttcgttttttttgagacagggtctcactctgttgcccaggatgaagtgcagtggcgggatcataggtcactgtaaccttgaactcctggattcaggcaattctcctacctcagcctaccaagtagctgggactataggcatgtgccaccatgcttggctaattttattttagatttgagaatacatgtgccttgcatactggtgaggattgggcttctatttccattacccaaatagtgagcattgtctctgataggcaatttttcaaccctcactcctttcctcttttacattttttattttttgtagagatgaggtcttgctatcttgcccaggctgttctccaattcctagcctcaagcagtcttcctgccttggcctcccaaagtgccaggattacaggcatgagccaccacatctggctgttttttgttgataaagccctctaaacctcaaattttttaagttcagtttctcgactgggaattggcacaaatgtgacttaaatccaaaccttccatcttcaaatcctgggctgctaaccagacactgagctcagagtgcagctgggatgtccgtccaccgtggagtctctccttgctttgggtccactgagccccacacattgttgagtgtctgattgtctccttgcccttacaggacaggaaagcgaaatctctgttcctttgtagggacctttcttttgtaggtgaaagggacagaaatatgattctggcctccttgatggtgaatacaggaacactttcagataaattacaatagagaggagtcagcttatttaaacaaactgaggttaagccagagattgcagttaacagtgaaaaaatttaaagcaagtacctggatggatgcaaagcagtgcccaggagacccaacttacgtgacagagatgatcattgtcactcattcattatgttttgagcaccagccatgtgccaggtccagaactagaagaaacttgggtgtaggtgagatcataggaacagtccctgccccagctgaacatcaggaagccagactgggagcgcatgccgtggctgactaggactccagcagggacctggggttccatcagatcagtgtaaagcgatggtttcccaaatgagacctctccagagatggttcattccaccccacaatggccaccagaaacattgtgctgaccagagggcttcactgccccaaaccccaaaatcacactccaggatgagaaacctaaaagtctgtcttgatgaggcttcatagctggaaaccacccctcatggatccacaggctgcatttgatgaaaggagactccaggaagtcgagccattccaggcagacatgtagcaaaagcccgagctggggtccgccctcatgcaataaataacacctatgcacataagagaggtgacaggcggggcctccctggggacctgggcctgtggcacgtgaagaaacacccaagagagcacgaagtcccaatgccatgaccagatatttcggtgccaggcatgcttctgggtcccagcaaaagacacacaaatccgtgtccttggggacccacagtctagtgacctagggctggccgggtcgcacgcttcttttcaagggctcgaaagcctctgcatggatgcaactttgggggaaaagtaaccctaaccctctgcttctctcatcctcccctcttctgtgtatatgtctgtctctttctctctgtgtgtgcccttccccactcccatccccattcctttttttatttattatattttggtggtgtgtggctcggtttctgttggtcccctcgtgtggcccctcccctgctgcagaactcgtccagctcggcctcctccgaagcctcggaaacctgccagtcagtgagcgagtgcagctcccccacctctgtcagctcgggctccaccatgggtgcctgggtgtccacagagaaggtgaccgcccgggtggcagccacagcggccccactctccctggtccccctgcctgctgctcagacagccctcacagccgcggcaacctggaagctcagaatcgacaccaagagtggggctcctcttggggacagagggtgggacaaggctgagggcattttctagaatgagtgcctggctgctggacaatgaccacatggttgtctcaagggagaggaaggggtatggggaatttggaggtgtgaaggctttctcccagaccaggtgttgcgtgcctgtccatcctcctccctcccttcccgagccacccaccagaccgttggatgagccatgtcactgtgtcagaggctgtgtgcttttccgctttttagtttgcacccccacccccctgcccttgattgagaatgtgctcctgagcaatgcgatgattttggaaacctagaatgaacagattcatttgaagatgctttggaatttttaaatttgcataatgaaatgagcaaatcactatcaccattaaatgaggcttcattagttacattatcaaaaaccattgacaaggccacaaattgagggcactgatcaatttccaaacttctaaaacgtaggtcaaacatagatgcttatttgctgtcaaactcatgtgcattctttgcaccccggctcttttctcttgcatcacagatcatccgtgagcagcagagccccaatgtttgttttatttataaatattcaggtttcccctcccttgaatgtcaatgccattttgtatctccgcactcatcctgttatattaattttttttccttccccccccctttttttgtttgtttccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggtttgtgtctctccccctcctcctctccccgtcattgcctctgtgctcacccctcttctgttccaaccccctcaccccgactatcccctcatccccttcctttcacactctgccttcttccccataatgcctctccctcaggaaactcccattgggggagaagcagaaagcagccggcagctctaagacagcaatttccacaggtagctggggctgagggtcttccttcaggggactttggtcaatccctgatggacggcagtgcagtgtgcaccgcaggcagcggcaattccaagtccaaaggcccagttttgcatcaagttgaaatctatgggttggtccctcccgggggccacctgagggtgtcagcatgatcagagcttctagggggtttaggggggactttccttctggccatgtttcccattttccctaatgagctccctgctgggctgtggtaacagaaccataacccaaagcaggtttggggtgatcatgttgaacttaacagtacacgcagactttagttttagtcttgagtgttcaaacatgtttgctttaatataaagacgaactttgaaaatgatcccctagcaagtccgatcaatgctcctccaggaggataatctgctctcttttgagaggaggaccctaatttgaaaagtaggccccttggctgccagcgttttaagcaggttttgactttagccctcacaggcggtgtgggcctctcaaggcttctcggaatctttctactgcccctgggcgccttcctttccttctgagggcttgagagggcagggagcctgccatgccctttgaggctggtttcctgggaatggagggagaagggctgatgttgctttagtgctcgctggtggccattcccctaacgggaagccatctgggttgttaaggagcgctggtcccttcagacaggagaagcacgatgtactgcccactggtgggtccccttagcttacaccggtcacctgttaggtggctgccgggtctcctgctgccacctggtgggtgagggtttttaatctttgggcagagacgaggaaaagggaggtacacagggggctcccaaagggtttccattccttgccctttagagcctggagagggcatgcagagggcctgtggcttgtcccagccggaggttccccttaaggggaccagctgccttctctggggagctgtctatggggtccccgcagccctccagtggaggcagaggccctggctcctgaccgcacttgttttgcataggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccagggtgatgctcttgttctcagtagctggttggggccacctcagcctggctggggatcacattctggccagcaactggggggccaaggcagccttgcagctggagggacctgggctccattccctgacttcctgctctacagcaaagtccctgggaaaaaaaccttgtgtgggaatgagagaggcagaactttctagggtcagagtgggacccaagcaagtcaatagccccctggccccacagacatgtagtgctcacgggggcagaacaggagtgctgttgagccccccccctaaagcaacctgtgtatttctctcctccaacctgcagcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaaggtacgaggcagcctggggtgtgcacttaggctttctgagcagcaccaggtgaggagatagaaaactgctggtccattttaaccacaacccaccactcgctaactaacaggtgtcaggattgttttcgtcatctgggaatgctttggggagctcatctgtagttgtcaggtagctgccatataagaaagggatctggggtcgggcgcagtggctcacgcctgtaatcccagcactttgggaggccaaggcaggtggatcacgaggtcaggagatcgagactatcctggctaacatggtgaaaccccatctctactaaaaatacaaaaaaattagccgggcgtggtggcaggcgcctgtagtcccagctactcaggaggctgaggcaggagaatggcgtgaacccaggaggcagagcttgcagtgagctgagatcgcgccactgcactccagcccgggtgacagagcaagactctgtctcaaaaaaaaataataataaataaagggatctggactttcacagctttttgcgttttgcagcatcatatacagcagtctccaatttgaatggagacatgtgctgtaataagaatagcttcaggccagggcagtggcttacgcctgtaatctcaacattttgggactttgaggtgagcagattgcttgagctgcagaagttcgagaccagtctgggaaacatggcaaaactcttgtctctacagaaaatacaaaaattagccaggtgtagcagcacacacctgtggtcccagctactctggaggctgaggtgggaggactgcttgagcctgggaagtcgaggctgcagtgatccatgactgcatcactgcactccagcctgggcaacaaaatgagaccctgtctcaaaggaatagcttcatttttgttttagcactttgcactacacactttatggttattttctcatttaatctttacagccacttatggggtaggtattttcacccctattttacagaagtggaaattaaggctcaataactcgctcatattcacacaaccaataagtagaactggagtttgaacctaagtgtgttagagtgtaatgcccaagttcttaacctattccagccaaatcctctatcaaacctgcctccttcatcctcaagtccactgcacacacaagtcaggcaagatgaaaatctaacagctagaatatatctatgataattgaccaaaagctatgccattcatcattcaaaacctctaagacagtgagtcttattggagggtgattttattccccaggggacatctggcaatgtctgtagacatttctggttgtcacaactggaggggtactattggcatctagtgggcacagggcagggatattgcttaaacatcccagaatacacagcacggcccctccccaccacgtcctccataacaaagaactatccagcccaaattatcaatagtacggtggttcagaatcagggctgtgagctgtttaatctgtaagctcccacatcatcctgagattggtcttacaaggaagtgagcacatgacactgatggaaactgtctttgtcccttattgtcagggactcactgtcagtagctttgttctttgtctagcccttgcctctccagttaattatcagggagatgttatagcctaggctagtctatttgaggtttgatcttcacgttgagttctggactggagaatttgtcttctttcatcccccttattcctcccagagacgcttgcaggtagcttcgctgcagcctagcagctttaccttcttccccattgacgatatttgagtgcctaccgtgtccagcactgttctaggtacttgggacacatcagtgaacaaagcaaagatccctgccacggagttcttagttggtgaggctttctgaagatggtagagaagcctgggggaagcttgggatgagactgtgtgtgtaccctgccttgcgtgccttttgtcctcccagcccagaagaatcaaaaaagcacagctgctgtcttgaatatgtctaatcaaatcctataatcagtttcagattatgattatttctctgtaagtggtgaccaggaggcagatcagcaggagttcgacaagtcctccaccattccaagaaacagcgacatcagccagtcctaccgacggatgttccaagccaagcgtccagcctcaactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagatt

SEQ ID NO: 36319 - DNA, 551792 bp, Homo sapiens
cgagcatggagagctgccgccgcggccggccggcgacgctggcgacgctttcgcccctgaggtagtttggcgaccgcgaagaaggaaaaagggcgggcgggcggctgtcctctcaccgtcctcaccccgcgaggcccggcccgctcctccgtcgtggatttcgcggcgatccccccggcagctctttgcaaagctgcttgaaacttctcccaaactcggcatggatacgactgcggcggcggcgctgcctgcttttgtggcgctcttgctcctctctccttggcctctcctgggatcggcccaaggccagttctccgcaggtgagtggccggggggcgtccccgacgaacgcctggagtcctgggctcacgaggggtgagccaggtccccgctagggctggggacaaggatcgtggggagctctctctgtccgggggtggggaacacagggtagagggagggctgtccccagagttcgtgccaggtgggacgcggggcacccattgttcctctccgaagcttgctcggggctcaggctggcacggtctagccggagagtgtggggacctgctggcttcggcgtctcgcgtggcctgcgccgggctagtggggaagagagaaagaaaaagtagttacgactcccgtgacggcactctgttgcttgtggtgcgggtttgttgctgtctgccacttgggtgtttaaacaaattccctgggaagccattgtcagaaatgtggagattcgaagggactgacctcggcgcgctttgccaggtgctttttgtcccgggaataacctcccctgactattgtctaactacttccccgtccctcccggagtccccttttctcctcccccagctctgggttgctcccgggcttgccctgtgcgctcgggcactgcttggagcatgttctgtgtgtgtgttggcggagccctgtaagatgtgttgaaatgcggttctaaggacccactctgagcgttcatgggcatcgaggtctgggcgcctggtggaggaagcctgactcgcgcgtgggagcccgctcctcgggcaaaaccaccgccaggctggccccgcgctccccggatccggcctggggctctggccccgcgctccccggatccggcctggggctggaagcggactgtaaatgtctgccttctgccggagaacccaaaaggagacaagtggagcgtctcgctgtagccctgggggttctcggtcaagccgctcagagaagtccgtgaaccctggctctcccggtcccgccctctgttcccctccagttttgttatccttcgtgtaggttggttgcttctttcgttctctcctctgggggctctgaagtttcaccaggtggacgctggggagcgggctcccgagcacttgtctacctcccgccagtcctgacaacttttctggccaacctacccagcttcgcttggctggcgagcgcatctgctgctggggttcgcggtgcagatggagacgcagtggtggccagagggtgatggagaagacgggaaaagcgacagccacgctcctggctgaagccgcaggacgcaaataacttactttgtacctgacagtttctcacgttgttgtggaggccctgtttcctggaaataaactcaaattgttgttttctggagtaatcgtttatttcccttccattgctctcctacccccgccccatttagaactctgtaaagggagttaaacaacagattcaggtggcagcatgtgtcgtacattcaggcagagattatgaaatggcagcacgcagaggaaaagccctgtatataattgatgtacgcagagggtaacagctctatgcaaaaaataatccaatggtttaattgaattctttctggagtaagcattactgcatgcatttctgacatataatgcccgttagcattgaaaccgtgcttgatgtaactcattatatgcaggcaagttggagtgagtattgatttctgcacagtgtttgtcactgcacggagagcctacgcttgaaaaggcttgtagtttgttaattgaaagtttgaactctaccagttgcataattaaacttacatgtattcaagagttgcaactattaatgtctcaacagcgatggatatattttcagcagttagaaaactttttctctttttaaatgttatttaccctttaattaacaaataaatactacttttcctccagctgaatgtgaaaatgagcttttctgatacctggagtttagatacgtacaataaacaattgtgttcttagatatctagttctaagtactttaactaaatatgcctggcttttctttagtgacaaagcataacatttgacatgatgttgtatatttaattaatataatgtgcattcctaaaaagtacagtaatcacaggattgcatctcaagattttgccctttaggaatgtatgcccagaaatgaatgtcttttattcccagagtttaaagtcagattgtggatttgcctttctccacaaattataagtttgttttgtaaatacttccttttttttctggctaccataaatcatttgatattttattgtcataaaattctatggcagtcagatttgttgcagacatagattagagatgtattgaagattggaggtgtattccatattgctggtttttcttatattttactttaactagtgaacttttattccttttgagaaatttaaataaacccactttaaaagtccaagacaaattcatgttgagaatttaaaaatatctgaagtatgtctttcaaatcatactcattaagatcagtttactttccgatatcatgtggttcctaatgtagtaagcttcaaaagcaaattttgaaaggctgagcattgttgggactttgatgtgtcatatacttattcagttttctttgtttaaaccaaaaatgtaagagtgttttcattattgtgacttttttcttagcttttgcagttaaagtgtaaaactgctgcactgtgagcctctttaaaaccagaacgttctgtaaatcccaactcatacattctttcagtttcacctctcacttaaaatgacacccatgtcatatctgaggaaaccgaggcatagaagaataaagaagtattaaagtttattcactgggttgtatagctgtgatctcttgatataatgtaagaaagttttctgtagaaggacttagatgactgacgaaaccagatgcaggtaaggtgacttggaaactcagctttctcctctgtaaaatggggataataatacccaacttgacctttccacatgttttttatgattaaatgaagtaatttatgggaactagcactgtaaattgtaaagcactgtgcagctatctggggtgtaatcatcattaagtgccttagtctcagctttttactccttccaaattctctctccagtaagtgcaggctgttcaggatttgtgtgtgagtgtgtgtgtgcgcacgtgtgtgtgtgcatgtgtgtgtgtgttttcactcagccagtcattcatttaattattgtttaacatagttattgttaaacataaacatactagattggccagaccataattttgtcagcacaatgatcgattatccttaatttttttaacttacctcgtataaatccttacttgagttagacccatggaagagtcactattaacattcctggcatttctaactacagaaaaaaatatttttagtcagtttctttagctgtttgtttaactgttggttcaggttttcaactctgtgttgagaataatatgtagctttctagatgcagtcttatcaatgacctagagagggactattgtctctcttgtatgataggagcctggaaatacagctcgagatcctgctttgtctatagttcctgacatgtcaccctgttgatgtgcacttagaatgctgtaactcatctaagcagcacctgagcagtatctgactccttgttgtctctttaggtgagattaatttctcttatacttattacctgctaggaagatactttggagccagcttgctttaaggtttgcctgttagttttttttggttttgattggctaaatatccctcgatccctcaattcattaaaactccacgttctaatcactagcaatcatatgtagctggacatttccaggactgtttttttttctctctctagttctcttgcatctgactcttgattttcctaggtcgtgagatgtagttttgtgtctggcctacccagacggaaagaggagagtctggctgctgtttggacattggcatgtgtgctgctgacagctcttctctttgtgctcataaaagtgaatttcaaaaataaatcaacccctctgccactctgccccctcccacactccctcctactcttttctagcaaaaacagagccccacatatatatacacaagatcacagcccttttgtttttgccaaatatattttagtgctgtacatgtccttaagaactggaaatatgactcatccactaaccaaagctaatgccaacattcccaccaaatctcatatttctagcaatgatggtttgttacaggtttttctggcctttaaggtaatatttaattcatgtgataagattccatatagaaaaagtgtgttggctactaatatttttaaagtgcagtataccaggtctactcaaactggtattaaagacagtgaacatcatgctaaatagggatctgtgctgctcccatttcccctacttgcttttcatggagtgcaggaagagagatgctggaagattgagagcaggaagcatcaagaaagtttacagattgttcttaaagacaaaacaaagaacacagggattctgtgtgtgtgcacgtgtatgtgtgtgtgtgagtgtgtgtatgtgtttttgatcttttacttaatttttagaagaggaaaaaagtcctatggtatttttgacttgtttattgaaatcagcctttgcctttgcgcaaacacattttctagttctgtcaatgtaaaaatttccctctgtgtattcttctcagtctttacactttgatcatatgtatctggtctgtgttccttcttcaaatggtgtttctttttgcctaaaaaggttgtaattgcttttgaacatgacttgtttttttaatcaaaactcatgctgtttgtcatagtactgaaaaaaaaaagtacaagacatcaattcatgataggtcttaaaacagtatttgataacaaagtaagtgaataatacattaatcaggctattttttatttcaattgaagcaaaaagcaaacttgcatatccatgaactaatcttttaatgtcacagaacatttatttgttgctgtttctgaagtctttaagttcccttttataaatggggatagacaatttcagaaccacattgcttgatattttgagataagtgagataagttacatacaactatgccttggaaaactgaaaaaatgttatgatgtttgatatcagtgtgaactctgaatagtttgtaaacttcacactccacattagtgcaaatgtgttttgtgaaaatactcctaaagaaacgtagtttcacataaaaggtttttaaagtttcatgaagattctgttgtgggaagtatgtttattttccttttgtattcttgtgggaattcttttgatctgtatttaatattttaataatgaaaactaagtgtatgtaattttaaaacttagtttcgtgaggttttttttagattgttgaggttctgggaaaacactgggcctgggatctaaggatcacattgatcctctcgtggaacattgccatttccccacttaactctggttgaaatttttggcattctccttcgtgtgttgataatccataaaaattacaagtggcttattttgtcacttacagttgttttaggatcaaattaagttgtcctaaatggaataatccgtgtttccacttgatatgattattgagctctgataatgaaaatgatgaacagggcagtgctggctgaatcctccaacaggtgtcattctaggaattgttttaataaggggaattcagaaacaaggcaaaataaaatagtgcgtagtggagttattgtttgtatttattttgttgggaaatgtgaaagatgtaagtatgtagtcctctgtgtgaatacacacacacacacacacacacacacacacatcttaacaatgctaggacttagttgtagaaacatttaggttagaaagaaggtaagggcatctagagatggtatcaaaactccatacttaacatttttggaaagagtagtgaaaatagatcactactttatttcatagatgtagaaacaagtggaaaataagctgtatataatctatactgtatactatactatactgttatacttttaaggataaaataataaatctttctccagattggtatctattaatataaacccttcccagtgcagcctgttccttaaccagctgctcataggccgattctccaagcgctgttcaaggcagcagctgaccagccacagaaattcccttaatccgtgttggatagtggaggtgacctagcagctgcttaagtgacagactggcaacagttccttgatgtgatttttcttaggtcattcagtaaattcaagagtagagaggaaggctttctagggtcctcactacccacccagggattgatgactgattgcttcatggtcattggattcctcactgcaaggtgtcctgggattttgtggttcatggaccaatataattagcatcatctggaaatttgtgatgatctgtgatcatcagagtcaccccagatctactgaatcagaatctgcattttgatgaaatccccaggtgatttgatggaacatttaattctgggaaacactgctctaggacaaagaaagctcagtttaaaaagattgtcacatgaactttaccatagaatttcaagaatattgcaaaaggattaatgataacctgaaatacatttccttggatttatatttctttttcctttctttttctttttctttatttctttctttctttctttctttttttttttttggagatggagtcttgccctgtcacccaagctggagtgcagtggcacgatctcggctcactgaaacttctgcctcctgggttcaagagattctcctgcttcaggcttccaagtagctgggattacaggtgcgccaccatgcccagctaatttttgtatttttagtcaagatggggttttaccatgttgcccaggctggtcacgaactcctgagctgaagtgatattcctgttttagccttctaaaatgctgggattacaggtgtgagccaccatgcccggcccctggagtatatttctgatcaatatttacttgattattatttaatattccagacacatcaaaacaacagtactatacaagctttttaaaagaatgctcagatgactttgaaaaaaaatattttcataagagactaaaagtaagactagttttggttatgaatattttgtataagaatatttaaagataaacatactcttcaaggaaccaaacatgctatatgcaaatcatttttagcataatgttatgttgatacaggaaatactattccctctgacattactagtagcagtctcttgctttataattctctttttcatctaagtgtaatttaagatctttgtagtaaggagctcatttataggacagtcaaatttaatgaatgggagttggtaggtagaatgcattaaatataactggtgttctttttattatcttttgtgctcatatttaagaacagagattcttgtcagttttctcaagagaaaaattatgatgtaatagacagtgtacactattcatgtcaaaacacaattttacttgcattttatagcttgctttagcattcttttagaaaatgaattttcccagaagacctaattgccttcttattaatgagcctgtaagtgttttttgttatccatttactattctaaatgtgtctacttgtgctagctgtttcaacagtgttgtctctgattaaatcacaactgctatatttgtttttgccattcactagtgattcagaaaatattggcataatgacgtggttatggcagagactaataaaaaacaagaagtaaaaattaatgttcacccattacagttggctgtatcatgagatcagaagctggagtttgggataatagcaacgttctctatatttttgatactgtaaataaaagtctgcataacctatattgtcttaaatataaaatatataatttattgaattaatgaactgtaaatcagtgtatttccatatgtacttaatttagacactaatgtttaaagaaagatttaataggagactgatcactgttagaggagaagtagtggtggagagactctgagagggcactttcgtatatcttcaagaacttcacagttactttttctagtttgactccaaattctggaacttgtcttttttactagtactgcttttattcttatgagcaataattaggttcatttattttcttatatgttggagaagagagcttttcctaaagcaattgcaaaaataacaatatgagctgtaatttactgagagcccatgacctgctagggcctgtgatcagtgttttacataattttaaatcctcacaatatcctttaagatgaggatcatctccattttacaaactaaggcctcgaggggttaagtaataacttgtcccaagtggctatatgagtcactggtagagtcaagattcgttaatgaatgtacacaaatgtttaaagattagacatttctttggttgcatcttggcagaaaatgtaacccagactggttgcaacaaaaggtgaatttatttgtctctcctaactacagttcaggtggagcttgatttagaagttgacgtaattccactgagacatgatgtttctctgcctgcttagtttagttctagggtattccaggagcttcttaggctccatatagaggcacgatggctgtggcagctcccaccgaacaagatcccaggttcaagtcccttaaggaaatgtgaattatctgctggttgcacctgataaggctctaaggtttacagtgcttgaatccactgatcttgtttccaaccattgaatctaaggctctgactgaggggaagttagtgtgctgattggcttggcccagggtttgtaatctttctaatggggaagaaagaagatgggagatgatggggaagagacagtaggatcagattgttctctgttgtggaccactaggtgatctctaagtgggaaagcgtggaagagaaagagaggaaagaggcaatttgtgtctggcaggcttgtatacatttacagatcacctgtttttaatctgagagtgtttatttattggctttccctttaaggactactttaaagcatgaatttatattatttccattattttattttccttgtctcagtattgaattagtctaacattaaaaatttgtagaatttggtgttaaaaaagatcttagaaattaatgaccccttcatttgacgtaagttgcccaaagtcatacaggtaggaagaacttgagctcaaattaaagattttaatgtataggttagtgttcttactatatatgtatcatatattaatgtatactatatatatatcattttccttaacagtaatctatataattattatttaagattaaaaaatttttggcttgtattccaaatttctgaaacaatatttccaaatataaacctgacttagtgattggatttgattagaatagtagtctgcatataaggtgataatatgtctgtgaatgcaagagactatcttagataactgcttggttttcagatatcatgacagaatttatacatgtatgcatgtataggtgtttgcatgtatgcatttatttatttttaatagaaagcaaagggtaaagtaagctgtggtaaatgatattgacacagacaaaacctactaactctactatttttgaaaacctcaagagatgatggtgattttatttttaattttgatcctctaacctctgctgcctaaatttattatgtatatctgagcaacatgggatattaggaagagttgctataagaaatatcttggggtactgaataatgaataaaatgtagagaagtagcagctgtttgcctagctacctcctctcctaatgagagatttacccaggctgtcttaatcacatgttagtgctagtggatttgactgaggaccatggctgtgccagttgaggccaggggatagtctccaggcactttaatggtccgtaatggaccttcaatggccagggcagctggcctggcacataggggtgtagacagtggttgaggaggaaggtttactgacttcatcatgcttccctttgtcactggaggcttgttttcgtacacttttgtctattatcataaataacttatgataataacttatgactctttttctgtcttatttatgtccttatgtgatgactgtcagtcctaaatgatgaagtttgtaataatttgccctaaccacctggtcagttggagcagattgctatctggtgttgactcattatgcccctttatctaaaccaacacttaaatgctcaggaaatatatgaatgaggtgaaggggctggcagcaacctacctcagaaccaatgcctttggagatctatgcaggaggctgtttaatgcacagagcactggccttgctacaggaggacttatgttccagtcttaagctctgtcactttctgaaatttgggagcagtcctttctgcttgatctttcatttctttatcaccaaaatgagaatattacaatgaagaatgactttaatgtcttgtctagtctactgaaccagacacttttaaggtgaaatgaataatatatgtgaaagtagttttatatttgtaaactaccataaaaatgtaaattttgttaggaatagaaactttgacaataaggaaagtattgctgaaggcacaaaaagtgtgtatgctgaagaagggaaatgaaaacaataaataaatgcttcatatatttgcatgtttaagtgatacattgcctctcaatgttggggaaagtggtataataaagaagaatgagcatggttcttgtgaataatgggtgattctgcaatcatgtatcataaagagcagtccccccaacttttttcacatatatgtatttcctatgtatgtataaataaactttaatgctaccaggtagttcactagccctcccatatctctgggggatacattccaaggtgcccggtagacgtctgaaactcgtatggaacccacccttaaatatactataccatgttgtttcaatctgataatggaaatggctactgagtgactaacaggcaagtgggctgtacaatatggacacactagacaaagggatgattcatgtcccgggtaggacggagtgagacagcatgtgatttcatcacgccactcagaagggtgtgtaatttaaaagctgtttatttatgaaattttttcgttttcttttcttttcttttcttttttttttttgagatggagtttcgcacttattgctcaggctggagtgcagtggcatgatcttggctcaccgcaacctccgcctcctgggttcaagcgattctcctgcctcagcatcccaagtagctgggattacaggcacctgcctccaccatgcccggctatttttttgtgtttttagtagaggcgggattttgccatgttggccaggctggtcttgaactcctgacctcaggtgacctgccgcctcagcctcccaaagtgcgggattacaggtgtgagccacagagccctgcttgaaatttttcatttaatatttttggaccacagttggccaagggcaactgaaaccacagaaagtgaaactgtgggtaagggggtcctactgtatttgtatttcctccagatattcaatatagattatgtgattataaaataagttattaaagaaatgtaaatgtgttttaagtacttatatatatcatatatagaaagttgtgtgtatacttttttccttttaaaaattttcgtgataagctagaacatgctcttgccatctaagctgttctgcctggtttttaagagcatgatcctgatgaggtttatatcctttcatttattctttcactccatgaatctttgagcaccttactatgtgcccatgctgtgccaggttttgggtatgctggcaagtaagccagcagtgacttgtcccagtgcctgtgcagcatttataatgttaatgactattaaggcatggtaatatttgcatcgctgcccacatctagtgattcacaagtgaagcttggggctttgttggtaactgaccatatattttataactgaccatactcctgagatgtggcaagtgtcaaagctctgtctgtcttacagtttgctgattcacttcagaacttgcctaggataattccagtctatcagtagtctttccatagtctcaaaactacccaaacaagtaaaagcctaccgaaaaagaattacaaacacattgccacaatgatagtaaaattccgccaagtggaatttcccaaaacttgagtaatccgaaatgtaaacaaagtcaggcagaggagagagcacatttgttttctggaggtttgctgtcactaactctccctctggaagcaggatcaagaagattggtggacagcctcttagactacagtgtatgtcaatgtgcatttacaacctgaatattcacatgcataatccctggttgtttggctgcagaatcctgtttgctctgacctgcagctgcttatgaactgcctctcttgcctggactttgatcagccctctctctgctattgcttctgtagcccattgccctgtctagtgggcagccacaagagagggagaccagtggctggcagagtcctatcagccaggaatgagggtgggctgtgaccatcacctaattgccctggcacctgcatcccataaggcactgtttggtcattcattatgaaggggacaacagtagttatttaagtacactcacggtcttaccaggaaatggggattttgaacttctgtcttaaaagaggcccacatggcctctagagtgggcctctagtgtgaattaaggagagaaaagcaattttggagaagtgtaaatttttcctaagccaaattaaagttactagattacatatacccaaggttcaaaaatagaaatttaaaaaactgttttttgttagttgagtcactgatattttatgcccattttgtgtttaagcaaaagaatacttatcaaatgctgatctccacacatagtatagagcatagtgtttaagagtgcggacattggaacttgactgcttgagtgggaatatacattccaacatgtttttactacatgatctgaccactttccttcagtttccacatattcaaaatgggaaagtacccattccagatgtaggttttgagaaatattgagttacagtgcttaaatgagtgcctggcacactaataaaatttgtccattttagttattattgttaatgaaattgccagtgtttgcagaatatctaatctcatgctgttatctcttaaaatctctaactacattatcttttactttaaaataaaaccaccagagaataaataataggatgcctgaagtaaatcagctcaatatgctgattaacaaagaccacaagcatcactttatagaatataatccagtgtttatgaaaacaagaagcaaacttattctttttttatgttagaggttacagtgacttataataatttttttttttttttttttttttgagacagagttttactctgtcaaccagactggaatgcagtggtgtgaacatagctctctgtggcctcaacctcctgggctcaagcaaaactcctgcctcagccttcagagttgctgggaccacaggtgtgcgccaccatacctggctaatttttaaaaatttttttgtagagatcagggtcttgccatgtataaaaacctacccaacatctttggaaaatgcatttaaaattctctaggtaggttgagggaggtgggaagtttttggcctacaaagaattgcttaccttctagaacgatttaatctcagatgataaaatatgaaaattctaaattgggaataaggttaaaataagaattgaccagaaagtggaggaatgaaatctctgccactccaagcagtgcccatcccagtaagtattatgtcctatctgggagtagcactcagatttagaatgagagaattagaattaatcaacaagataagagggatctctttaatgcctaagaatgttggtatattgtttccccaatggttatagaatgagaaaggaatatcactattgcttctgtttgcatttgacacatatgctaaacaaatgcactggcttttagaacgtgtttatgaattctatataacatttttctttttctttttggaggttgcctagctatttaattttccttagttcacaaaacaatgaggtagtttcaaatctatttgaaccccaagactttttcaagctgctgttctctgggtaaagccacttagtcctggcacatggtggaaaggtctggctaaagttttgacaattattagctcatttgcagagttgctctttgacctgtcaacacagaggaaagcttttctaagctgtgagaaggattttatgttagactcgagctttagatttcttttatttttccaactttttaacactatcttttctagctttaattgacacaaacttctcttttccttgtgtaacacttgtgcactccagatgttagaaatccctgttaactttcttaccggagaagctctttgcactgcaggcttgaatgtcactgagataatgtccttacaatatttgcaactttgtgttctgactggatgctcctactaacctaggtcttctttgtgattgcggtggcagcagctgtcttcataaactcatcttcatttattttttattttatgtgtgtatttattttttttgagacagagtttcgctcttgttgcccaggctggagtgcaatggcacgatctcagctcactgcaacctccgcctcccaggttcaagcgattctcctgcctcagcctcctgagtagctgggatagcaggcatgtgccaccacgcatggctaattttctatttttagtagagatggggtttcttcctgttggtcaggcctgtagtcccagctactcaagaggctgaggcaggagaatcgcatgaacccgggaggcagaagttgcagcgagccgagatttcgccactgcactccagcctggtgacagagtgagactccgtctcaaaaaaaaaaaaaaacaagtaaatttcttaagttgttatcattttggtatactgtttgaccagattcagtctcaataaaaggagcattaacaaaacttcaaaacttctatggcacatctaaatttaaatatgaaacagttctaaaagcagggatgtatacttgcttgtcctggaccccagaatcgtgactcacttattatttggaaagcagactgctacatattttggtcacaataatacctaaaggatactgaatcagaaaatgagtaactgaaaatgggagatctctataatgaaaacactagatagtagtatacttaaatatgatagtgtacatgagaaaccataaattttaaccagtgtgattcaggctctggctttcaatctatttgcactagggtatcggacaaacccacaaccaggaaaggtgagcgcagatattgccagaagaacccaggtgctctgattgcttactccttaggcaacgtttcagattttgcaaggtacattgtgccctttcccggctaattcttatcaggaatgcacatcccagttgaagcctgctaattgctctgagggctgttgtttttacctttaatttaggttcaggagtctgtagggcaatcctttgaagttcttagttacttactgttcactgaagtatccacttgagatctttcctggactctctccacagtttgttcacaatttggcacaccattggctgaaagtactctatccttgctccttgctcattgacagttatactacaggctgcttccagttgccaacacattttagaaaagcatataattttattaagagtttttcctgttgctttcacatgtagtcaagtaaagggcaggggacagagaaggggcaggatgtcatgtcagcatttacctttccagaggctaatgctttgaaagaataagaggggtccttttaggtcaagactcttattgttcttgtcacctgatttgttggcattgcagttacatcacgtgttgtcttttatgtgagcaatgacaaaaaggatatatctattctgtacatttttatcaaatatgatatccttcaaagcttgttaaaacaggtgatatcagtctgtgttcttaatatggtcttgttggcaacaccttattggggcgggaaccattgatttgtgcatttccaggattgattactatccctaataaagttagtctggtaggcaaaatagcaagaccttatctctacacacacacacacacacacacacacacacacacacacacacaataataaccaggcatagtggtgcatgcttttagtcccagctattttggaggctgaggctggaggattgcttgagctcagtagttaaaggctgcagtgagtggtgattgggcactgcactctagcttgggcaacagagcaagaccttgtctctaaaacaaaatacataaagttaggctggtgagctagggtctcttcatttaacaaaatatgtatgacagagtttatctgatttctttcatgttagtttggttaagttaatcaaatagtaaatgcatgttcattctgtgccaggcagtgtatatagcacagagggcaaaatgatttagttgactaagtccctgcacttaatgaccttacagactatttagaagatctagaaataagtaagatataattaagagtgggaggtacaaaaagtgccatcaggacgtggagaaagtacagtcactcactcctgggtgattagttaagtttctcggatcaggccatcaattggcaaaatccttatgaatgggcacaaaatgtacttgggaaaatgaggaagtaatagcgatggtggtaaatgtttaataatcagctctcaagccaaaaagttcaggttttatttgtttgttttgagatggagtctcgctctgttgcctaggctggagtgcagtggcgcgatctcggctcactgcaacctctgcctcctggcttcaagtgattctcctgcctcatcctcctgagtagctgagattacaggcatatgccatacgcccggctaatttttgtatttttagtagaggcgggggtttcaccacgttggccaggctggtctcgaactcctgacctcgtgatctgcctgccttggactcccaaagtgctgagattacagatgtgagccaccatgcctggccaaagttcaggttttagcacttgccagtttccatggtataaatactaccaccatggctgaattcaaaggaccaatgtgacatcactgaacacaaaattaggaagagatgcatagtaacacacccttatttagtacttccaccatacagatacaagagaagtaaatatcctgcaaatataattaatagtaaaataattagaaagtgataagttttgatttattacctctgtttttaatataatttatttagctgtaagtttatataatttaattttaaataatggttgtgactaataactggcccacaaaattcctgaacattttagcaactgactttcaggagctggtataggctggtttcagcccagcccactactccatgccttataatttggcatatgggtgtgaggaatccagtgagataatcctctttaattatgggatctttctataacactttcctaattgaacagtttagtgtaagaaaacctggtccattttgaaactccctggcaggggtttagttatcaagaaactttaggttcgttgacacaaaatgttgatgtcagaaggctttggtgcatccactgtggagcttaatctcaggaataaatccccaagaagaagactgtttttctgtttaactcaagtttccccactatacaggattgactctctttggtctcaggtgctgatatgactattcaagctctctttaagtcctgttaacttagagcactgctaggactatataaaaggtaaacttttcaatgtctttgaactatggacatttttcatgctaaacaccatctttcccaaatactacacagtaggtagtgggttttcagtaaatgtagcttgtaaattactacatcatctttgtactaacaaacctcccgtggctcacaagagcacccaatatttaagttattcagaaatattggaagaatcaacatgtctgtaaaagtaggtagattttcatccaattctgctatacattgccactttgatggattttaattttgggtgtatgtatgtgaaattgttaacatctacaaaatatacattattaaatataaagcatgttttttcatcttaatactgcatttgggctttgatttaatggtcttttatcattattttctactgaattatcagttacttttaagcagttattactatttgttagctaaagttacttttgattatttcacttgagttttaaaattctttcattatttaatctctatcagtgttagaaaagtggaatgttgttttaacatatgctcttataatatttgtttatataggacaaaaatatttcatgttccaaaaaatgtcatgtaagattaatgtagcgctaaatggaaattcctgtgctccacatgcctttgttaggctccgcccacaaaaaacctagtgtctaaaactaagatattcacattttaaggcatattgtaagaaagttcttgaaattggcagattgtgaatatgttgtatatgtattttttcccttttaatgggaagggtgtgtgtgtgtgtgtgtgtgtgtgtgatttgagtttagtaatatatgacaaagtgctgacagtccccaagtgacttatgacttattttgggaaaatggattttctccatatgatttctctttgtatatcttatataaaatcttttatcttgtagcaggaaaaaaatttactttcccttatatatgaacaatttcaagaatttggaagcattccaaactttacagtttaaacatagatttcaggctgggcacagtggctcatgcctgtaatccagcactttggcaggctgaggcagatggatcatttgaggtcaggagtttgagaccagcctggtcaacgtggtgaaaccctgtctctattaaaaatacaaaaattagctgggtgtggttgcacacacctgtagtcccagcctacctgggaggctgaggcaggaggattgcttgagcccaggaggtggaggttgcaataagtcgagattatgccactgcacttagcccgggctagtcccagcctacctgggaggcaggaggattgcttgagcccaggaggcggaggttgtagtgagctgagattatgccactgcacttagcccgggcaacagagtatagatttcataataaagattcctcagactgtgcaaaacaaaatgtagatttttaactcttctcagttagtactctttctccttgaggaaaccaagtgggagaagacatagagacaaataatattcagaattaataaaggtgtagcactaagtcgattgtttcctgtacttaaatggttatataataggaaaaagacatatgttcatataaactctcagggatttatttttaaagagcaatctcttctgtgtgacctgtgatcagtagacgttaaactcaatctcttacctttatgcctataatactttaacaattaattgatattcagagtgatggctgaattagctaagcataatcaaaaatgtaattatgctgggtaaattgtaattcataaggctggaaagcttaccagtagtggccacagtgattgaaatgagactcccccccccaaattttcagttaatcacatgattgtattaactaggatgacccatttttagagcatctgtttctgacaacttctaatttgtattactctctatttcaacattctgtttattcagcagggcctgataaagatttttagttcatgtctcactatatttagccactccttcactgcagcctgatgacataatgacaacaatacatgagcatcaggattttacctgcctctgcatcagaaactgaagccattggtgtatgtttctctgggccatttacatgtcttgcctgagtatttcagaggtaaacattgtatcccttttgagtgttttgagtccaccaacctatagggacataactttaaaaattattttcaataactaacattttagtgtttactggtcctagcattgagctaagtatcagctcattattttcaaattgtatgtaaccacccatttggtgggtaccgaattcaattcagtaggtagcaaccagcttaaggaagaaaaccagaccaaccatgaaatagaatataacaaaaacaataacaaaggtaatcatacattttgtagaggaagagagaagtattgtttcatgaaactttggttttaatggaatagatttatgtatccttatatgtctgtgtactgagtcacaatgcaaaaagaatttctaactgtgggtctggccaaaaatatgggaaagttactatacttctctcatacaatgtttgctataaatcctattcacacaactttataagctccaagttttttctcttaactattatgtcgtggcacttcctggtacagtgcaaagagcatagagtttgcgtaatttggtaaatgagtaatttaacttatatagcctgtttccttatcctcaattcgtgtataatttctggatatttacagggttgtgagaatcaaactgggtaatttatgttggatattcttttccaaattgagctacacatatgtaagttactatgattgtaatgccttgccctttggcccttcaaatactaattgactactgggtttgacttaggaagactggattgtcttttaaaatatttttcgaacctgaagatttacagttcagtgttttcacttgtagagatcagtcctgttgagtactttttacacagtcttttgtttcttctttatgacaggatgttgtgaataaagctaaggttttttttttatttacttttcctattttggtattactcttgacaaaagcaatggaaggcaaatgtactttggacatacctgtatgaactcattattcacatttgtcttcaaataaagctgcattttgattttaaaacaaaataacactatgtaaataaaactcgatttaaaatttacgttgaaatacctattgtgatactcaatggaacattgaaataattttgaccaataaaaatatatccaagacttaacaacaacaaaggaataaaaaagatacacaaaacctccaatcaactgtaaaacttgtgagtagagatatttcagtaattgaaaatagctagcagagtagctgtccgctgcctgtcttctctctctctgccattcattctatttatctatctatgtgggtatccagctgaattttttgtcaagatatatgtttttattccatatttattctgtggcctaatccaaaatataatcataaaaatatatattttacattttatgtatcagtgtggcataaccttataattcagtatatatcctgaagactttgagttatgcacattgtcatacttagacatagttctcaacctttagaggatcagacagttatctggacagaggagcattgatgccactgttctccagcattcccttagcctcatcttgctaaaagcagaagaggatattgggatgcaaataaagtagaggaagggctctttgccaagtgctgtttattgaactgagtaaacgtctcccccatgggttggagggagctggttcgtttaagtgggcaagaaaagccagtattcttccaagtaatgaggtttcttaaataaatattccaaatgtagattctctgggctgcatcaacaaggggcaagcctgaaaagtcccctcagtatccaggagcccaggttgagaagggttctgttttgaaactggaaactgtccgtagtttggatgggagaatgcttggaatggaagctaggctgtgatttgtctttttaacattcttgacagaaaaagggtgttaaggaagcaggatgactacagtttcaggggatttatttacagctcctaagaaaattaattgtttttttgcttttgtttttgtttttttttacaactcagacaaacattatgctaatagaaaagtatctaaatctactcatgagaaaaattctttaaggatgcatattagtcaacctgttcttaaaactacttattgttaaaaatacttcgtaatatacacaacatattcttttaaaatgttctacagttcagattttaaagtgattcgtagtcatctcaccccacctccagttaatgagattttactgtttatttgttagctacatctaatagaaaggaaaaaaaaaaacaacctttttgataggtgataattacttaaaaatttggatccaaattaagagaacagagctcatcaaaatatggatgtattaacactggaatgtataataatgggaaagaaggtataagaatgacagagtgagaaattttaaaagaggggaaataggatgaattcaatcaaaacaaggaagccaaggtgtttaaatgggtgaccctctcactttgatgtttatctgattgaaatttgacattttctatttactcatttcaaaccaagataaaaatctcaagtatttaaagcaacctattttctgtctagtttgtgttcaaattattattattattaaagacagggtctccctatgttgcccaggatggtctcaaactcctgggctcaagggatcgccctgcctcagcctccagagtagctggtattacaggtgtgaaccactgagctcagcataaaatggttattttttaagtatatatagccaggcataattaaattaaatatagtttaaaagtgagtttaatgttatttttttcctcctcttcctgggatcataaaatgattaatgttaaaattagtgttctgctactgactggaacatacatgtttattatttccctctaatgtgaacacttgctggtagtatagaatatagtcatcttcaattccgacagttgacataaggcaattttataagtgattaatcacatactattgtgcatgtaggagggttttggcttagagttattttggtgtactttttggatgttacgatttttattttataagtaaactcatgtttgttacctgtaatgttttactgattccagaacaacttggccttctttggtttattgtaatgccaagcacaattatattttgagtaagattttgtgagaaaaattatagtcttcttggtttataaataattgtgttatgagagtaattctaaaagccacacctgaaaatgtcacattacaacatcattagtttattataccttgtgtaacacttttgcttttcataaaccaagaagcaattagagttagattatacaatatttgtttagaagataataaatcttacaggatgctaataatttaaaaagctgcatatgttgttactaatgatcaaactgaaagaaattatatgatttcaaacatgactgtctttctgatcgttcaggacaggaccatgtaaggataacatctggacctgatctcacatctcaaggtcttaaagttgtcacttcacttaggtttaatattttatcttaaaaatggttattcatcaaatattcattaaatgctaaccatatttacaacattctgcgaggaaccatagggttacaaagtatatgacaaattccttagatataatatataataatcagaggtggaattttacaattattattctctattctctactttactactggactgggttttaggactagcccccatccctgctctacttttctgccttaagatttagggaaatgttttttctgataatcacattgctggaatctaagatgggcttcctcatcaagtttgctttttttcttgagattttgaaagacactctcagtcttcagctgtatattgagcaccttcactgtggcatgctttagggactgaggtcatagtccttttcattgtggacttttcatcctggacttttacagtctggggtagatggatgtgaaacatatacttgtcaatatgtaatcctaagtttggaaagtccagaaaaaaatatagggggtttagaagaatgtgtcttacccaaggagtgcacaggaattttgacattaggaaagctaggcaggagatacaagcaaagagtcccacctgtgtgaagacatggagactggagagaatgcggtgcattggagagaatgcagtgcattgcagcaactgagagaagcccactcactatggctggggaagaggcgtgaaggagagtctggtgagagtggccaaagcttcaggtaaaagccagagcatgcaggaccttataactaacgatgacgacttaaaggaaaagacatgatcaaattttcataagtatcgccctcagtatagtgtgaaaaagggtttggaggggccacgtggattttggtgagaccagttaggaggacattgttgcagtctaagtgactgtagggtgagagaagtgtacaggtaaaggtattttgaaggtgggagtgatggagcatgctagtagatttgtggggacttagagagagggaaggatgagagatgctgcctgagtatttggtttgaactgtaacatttaaggaggatttttttttttaggctcttgcctccacgaggatttaaaaacaaatttgcatattaccttttccttacagttcacataattccttttttaggcaacatggctatatattcttttatcttttccctgaaattgcgtctcttattaagatttaaagtatatatctatgtacatatgcatttgtttaaaatgtagtcatttaaaattcagttctaaacaactgggtccttaccccaggcacctttctatattgattctcctttaacttccttgagtgataagctttgctatttttgaagttctttgcctattcactttctcttctttagactgtgtatgaatggatagatacacacactcacccacacagtttgttttaaattgcacagagttgatgtataataaaatatgaagaaaggaagaaatatttttaaaattcttatattttctttagtggtttgtcttagaaaatgaacacataccggagagttgagaactgagatttttgtttattttatttatttattttttgtgagaatagcaaaggctttacaatgtgactgcttactaatgtcagaaaaatagcaattcagctcttactttctcccctatactttcagggcgttatgacagttttaatgtgagttgtaaaatgtagggaggtatactctaattctctttcacacacataaatcaagtttcaggctcttttggaaatgtttactagaaaaaacatcatgggcagattttaaaatgcttttggattgcatgacggcgtggtgccacttccattgaagtgttgtaatattttattttccttcccaaagcgtcaagataaatcctgtaaacattttttctccttttgttgttttggttgtactattgtgtttggctctagccttttgcccccagggaaacaaaagtgtttttttttaactgcagtgctcccgctgagtactccagctgttgggcagcagtttcaaagttgttccctatttacacactgcaagtctggcggatcacaaagcttcctacatcttatctgaaacacaatatactaatttcagggatatatttagaaggaaaattgttgtcaaaatttactataatgtagcttattttatcttttaaatttaaaatctactaaatcattatatctttaaaaaatggtgatggtgaatgtcagcataacacgtaatcttatcgaaacaattaaaatttatcaattagcaggttcaagtaactacacttttttttttttttttttttttaagatacagggtcttgctacattacccaggctggagtgcggtggctgttcacagttgaggtcatggctcattgcagcctcaaactcctgggctcaagccatcctcctgcctcagctgcccaggtagttggaccacagacacctgttctagtaactactgtttgtctatatttaacgttaaccaatgtggtaaaccactagtgtgtaccagcactatgttaggctttgtttaggttttgccctctaggagcttcagtctgtttggagaaatggacatgtagataaatgttataactcacgtagaaatgaagtgcttagagaaggcagatgacagagttactggctgtatctggagaagttggataaagcatcatagatgaggggacagttacctttggagtttccagatgaagagatggaggaaaagtgccttgatgacaccaagtcacccattgtgcttgtttaccatgtggttaaaataaagcatttgcatttggtgatttctaaactctcttctagttctatgaattgaccacagtataagtatagttgtttctgtgtgtgtgtgtgtgtgtgtgtgtgtgtgtgtgtgtgtgtgtgtgtgtgtgtgtagggggcgggaggtactttttttttttttttgagacggagtctcgctctttcacccagctggagcgcagtggcacgatctcggctcactgcaagctctgcctcccgggttcacgccattctcctgcctcagcctcccaagcagctgggactacaggcgcctgccaccatgcccagctaattttttgtatttttagtagagacagggtttcactgtgttagccaggatggtcttgatctcctgacctcgtgatcagcccaccttggcctcccaaagtgctgggattgcaggcgtgagccaccgcgcccagccagttagcggggggtacattgactgggcttgagatgttcgtatgtaataaatttttaaaaattgcagttttaatttccagtttttagtgaattttggtcaatagaatttgctcttaggaaaaagtaaaggaggtgaatgctggctttcttttgcaatagaaacagccaactcactcattcatttaacatatattgttgagtgcctaccatgtgccagatattgttagagagcaataaaaacacatattccggcttctaaaatacttacattttggtggcacatgggacaccacactctggattgggggaaaatttggggtatgggttgccacaaaaatgagcaaacatcagtgtctcctgccctttccaaaaagcacaagggggctatccaagagaagggagaaagcaggtctaggcttggaaaggataggtggaaagtgtggcactagcaaggggtttttggaaggcaagggtttccatatgcaaagattgggagatggagtatttcagctgaagagaaaacttaagactattttcaggccaaacagtccaacttgaagagtgggttatattcaatagagtagtaggagatgaattagatactgagcatgaaaataacagctatgaacttgtcctcatgccaggtgctgcggcaagtgtatttacttattaaatacttcaaaatcccgtaaaataaatattattgtgtctccatgttacagcttctcttggggccatatgagtaataaaagacaaataagtttcaagctcaggtctgtctgatatagaaatacttgatctcaaccaccataatatattggaattttcatttttggatagttaggctacaaggttctcttgaaaattttgagtaggcagttgcttaaatatgtacaatgtaacagtatgatatatcccataatagtgttagatttggggtattctgggaacatgctgaagaggcaaactactcagttgggggtggatggatggaatttgcctaggaggggatatcagcattgagaccaaagacatagagcagttatcagagccaatgaggagggttttcttgatagagaaggcagcatgtgaagggcccagaagtacggtactaggaactgctactggtatctttgaagattctgtaatagagatgaatgtggcaatttgttgggactagatcatgaaacccttgggtgttatgcaagggaatgatgactttatcttggaggcaacctgatgatatggaagagttttaggcagataggcaggggagtgataggatcagacttccacaattagaagattatgttaaattcatttaaacaaatgtgaacagtagtgaatcaattcccaggggaagtttcattgccaagtattcttcctgccgtgaagattagcctgttagttaccaagccgctttcgttttcagtgtctgtgcttgtggtcggtaacttttgctgctgttgttctgctgctgtctgccattccattcgccatctatcacgcacacagaaccctggccaggatcatgaagggcgattgaaaaggtaacaagagaaaaaaaatgatagattaatgtaagcctgatgtttgttttagtggcagattttggtgttcacatgagtgcctgagcctgtctaaattaatctcatattctcaccacagtcttctagcttgagaattgactgcaggtaaaaataattggaaattattggtgtagccgaaactgcattacagctgccaagtgtggatacaccggagccaggctgcttttgtctgcttcctcataaacattctttccgcattctttatcagcacataatcctgagacacaaaaagcctttgtgtcccactgggaatgtgagaaaatcaaagctatctattggttttgctcctgttaggaaccactaacatttctatattaaccacccatgttttgaattgagatagatgttatcagcaagatgtgtcctccatttatccccaaagatatcactgtcccaatacaagaaatcttaaagacagactgcaaatgtctgttttcatccacttgatgctgtgatttgtggatacttgttagacatgtgaatttaatggggcttagcctaatagtaagcatttatatagaacttcccatgagccaggcacttgtatagtaatacatctaatcatcaccacagtcatgtgaggtagctattattgttttatactgtttgttatgcactgaattgtattccccaaaattcatatgttgaagccctaacccccaatgtgattgtatttggaggtagggactttaaagaggtcattaaggttaaatgatgtcataagagtgggccctaatctactatgactgatgtccttataaaaagaggaagagactccaagaatgtgtgttcacagaaatgaagacagaagaccagaaggtggctatccagaaatcaaggagagtcctcaggagaaaccagccttattggtatcttgatcttggactttcagcctctggaactatgagaaaattaattaattatttaagccttcaagtctgtggtattttgctatgttggccctagtatactaatacatacacattttgctgtgtgggaaaatgaaggcacagagaggttgagcgactgccccaaggtcacatggctagaaaatgacagaattaggatttacacatggggagtgtgattgtggaatcaatgctgttaatcaccatgctgtactgcttctcatgaagacagaacttcccagtattggggcctgggcggtatgaccatattctgcctctggcatctttcctccccttattttctgtacccagccctctgcgttctagtgtataatactcatggactgttcaccttgggctatactatgtaggaatgatgcatctgcagaatcctttactctcgtcatggttggcagtttgctctggtttgagcaatttcatggctcagaataagtagggtcagcaaacatgttaacatttttcttgtcacgaattaacttttcaaataacagcaaaactcagcttcatttttttccccagttttagtctcattgattcagtaaaagaatgcttttgtagtctattcttgactgtcatcttttggaaaagatttttttttgtgaaaggacaggaagaagaaaagaggagagaaaagcagttgtttgaattaaagtgaccatgttaacacctatgactggtctgatgaattgagtactttttaattacttaaatatgtttagtatgttacatgttttaaaatagttcttaaaatgtagtagcgttttttcgtagacacttaagcttcagcatacctgaagaaatgatacagttgtaaaaatgcaatacaatgaccatcgagggtgagtaagtgtgggaagcttcctgaaaatgcagatgcagaatggattatactgcatacatatctacattagggttgatctgggaaattataaaaagtttatttctgagctcattaaacatttcctgcaaatttaaaattgagttggttgtataggaaaacaaaacttataatgaatacatggactcttttcctgatcctccttttaatgaggtaattaaatgaagaacagacaatgtgtacatggccatgtgcctttcatatagtgtaatttaatacagatacatggccacatatgaaaagaataaaattagattttattgattttatattttccttaattttatatgactaagagagttatatgacaagtattgtttaatttctgaaaccatgttactatcactttagttatcatgattcaggccggagcatatgcatcatttccaggtgaagtttgttccagctcatggatcaagccattatctgctctgtgtgcaggactcttaccaggataagaagaaacaggagaatgcattgagctttactctaaactgtgaaaataaacataaactgcctttggaacaatttatgcagtttttttccatcatgaagccaatttgttatctatttctgcatatcagtaaaaacatgttccttattcaaaataaaatatttctctttatatgttactttatttaatacctgaaggtgcactcctcaacttatggcactaatattcgttgctgtggaaatattttcagaactcaagtttatgatttgtggaaagtgtactagagaatcacatgaattattaattaattattttttaaagtatgcttttttctcctattcatggtaaaaataaagaaatgtaaattatgagaaaaagattattttaatatatggtagagtttttttctttctcattagagatcagtggctttatagcttagagtagtttttcttattttttttttgtgtgtgagtaaacttatcctacttttaaaacactctatttgttggtacaagctgaaaaagtatttattgcattttcttcatagttgaaatttacttttaagaattccctttagatttcaaagaattaaatgacatttaaatttatttattgcaaaacttcagtaccattatgccaacttatgtatgatgcttttcttcttgaaccatatgcctttactgcctactgccagaaatcctatggaggttttgctctgagcactccagtaagcaattttggaatgtaattatccagcatattcaacaagaaaggtgaggtggaacccttatttcaaagaaaattatctgcttttgtttatgttagaaatcgcgtattctattggctcctagagagtaggcatctggcttgtggatgcccagtatctattctccattctgataacagcatccagattttgctttgggaattgtgatggttaatatctagtggcaacttgatcggattgaaggatacgaagtattgttcctaggtgtgtctttgagggtgttgccaaagcatatgaacgtttgagtcagtggtttgggagaggcagaccctatgtctgggtggacaccacctaatcagctgccagcgcagctagaataaagcaggcagaagaaagtggaattaacagagttgctgaattttctggccttcatctttctcctgtgctggatgcttcctgcccttgaacatcagactccaagttcttcagcttttggactcttggacctgcaccagtgatttgccaggggctctcagatctgtggccacagactgaaggctgcactgtcagcttccctactcttgaggttttgggacttggactggcttccttgcttctcagcttgtagacggcctattgtggaacttcaccttgtgactgtgtgagtcagtactccttagtaaattccccttcacatatacaactatcctattagttctgtccctctagagaaccctgactaatacaggaatctacacctcattgaatgcggttttgggggcagaaaagtttgataccttttcttactggtgataaggctctcatctgaccgctcctattacaaaagacaggttaacaagagaaaagcatagcaaatgtatttaatcaagttttatgtgacctgggagtcttctgaaatgaaggcccaaagacgcagggaaaactctatttttattcttaggattgatgaagaatggacactcccccatcactctgttactattagatcattcccttttgtgaacacctgtctgttcattcttcttggcctttctgtagtattgcttcctcttgggtatgctgctggacccgccctggaatgaggctctttagggaaggatggagaagggagagggtgacctttctgggttttatggcctgttttggaggagaggagttgccttggggaaaacaaattttgttttctatgacttgcttcaggggagatagagggataggagacagaagggcaggagaaagtcagaataaggctttgcttctgaggctgtttttgaggccttcccagtttcccagtgtgccacagtgccatacttctgtgtcattttctgaagcccaacacagtcctggagggactttcggtcaaggtgtcctgccttcttttatccaggaggtgggttcctgagctacaccaggaaaatatgagtcctacttcagaaagccatcctctcacaggtagtgaacattgtaaaatttaaaatgtcagcgctcacaacatgcagctttcctgccatgtgaaacaaacagtagaagagaattagggagaggaactggaggtactctgccatgttaacattccctggttcagttgttgttgagagctagcttctttcttgtgtatcctgtggtttaactattcaacatttcctttgattccacaagtcaatacattttttctttttttctgagctagtttcagttgaatttctgtcacaaccaaagtgatatctatgtcaattaaatattttttctgtgttcatattcataaatcctccctccctccctttttatttttttcctttcttccttccttccttccttctttccttccttccttcctttctgtctttctgtctttctttctttctacaggatctgcctctatcacccaggctggagtgcagtggcacgatctcagctcactgccacctccacctcagcctccccagtaggtggatgctgcaggcacatgcctccatgcctggctaatttttgtatttttttgtagacagggtttcaccatgttgcccaggctggtcttgaactcctgagttcaagcaatccttcagtcttggcctcccaaagtcctgggattacaggcatgaaccaccttgcctggccatattcataaattatttcaataattataatcagagtatagatataattgtgttttctgcctttttgaagtaacatgattttttcccctaaactttttctttatgtttgtcataaaaaccatataatatattaattggtgtcatagttagtttaccactttatccatgttactaataaatacttgggatttcaaagcagaagagggatgttgacaaggtccaagaataaacagaatggtgcttctgctggaactatgttattaagtaatacattaataataatcagacaagcacaccctttttattagttttttaaactaaactaactaaaaaactgtcaccccctttttattagttttttttaaaaaaacaaagataacagaattttgtgcatttttggtagtattctgtgggttaatttttaacagctggattattgagaaaatatgaaactatttaatgaacatacattttagaattcaactaaaattgaacacaaatgtaaactctgccagtcactacttaagtggcattaattaaacaattgcttcttgatcaaaatgaggatagcttgtcttctgactttgttataaaaatgaaaagatggtatgtagattttaaaaagtgtgtttatcactcaagaaagacgctgatttttctttgttttacaattatttttcgtagaatcagacattgcttatctggtcattattaatttattacttaataacatatttccagcagaagctccattctgtttattcttggaacttgtcaacatccctcttctccttcgaaatcctttctttggtggtgattactttcagtcttggtccccttagaagagctactccatcgctcttccatgggctcttccttcattcgctagcattcctcatggggacagcaactgtgcaaaatagtcttcttttatttgcttcattttatttatcatagcaacacacatgagacacattatctctgtgtctcttcatgactgggaacttgcctttgtaataacagtgattgttatatattaggcattatctgtgtgtgtgtgtgtgcatgcattttcaatgaatgactttctaggtaaaacattttaatgatatagatctatgtaaggctacattggcatgagatgccaggagatttttccattcactctgttttcttcccagtgaaagaaatggttgaaaatctgatggcagcagaactacatgaagactaaatagcacaatagctggttacttacttagaacctgatgataaatttgtgatgtgtactaatataaccaactgttctaaatttttaaaactgattatgggttgattgccacagagtcataggttaacatttttgtagacaactaggtatttctgataattttcctaatcatacagttgaattgtaattatatagcttgtatttatttgtgggtagcattaaaactgcgtataatttacatttggtatatggacctcattcttccttttcattgtgggttcagagacctcagtctaatgcatttgatcccatgtgcctcctgttgagactgtctgcttcttaaaatggaaatttaatttttatgatatttgtatgtgttttgaagcaaattaaaattatagtagttagagttgtggatttgatttgcattttctgaaaggaaaggaaactattgagtttaaaaatgtgattcgatttgaacaaactatgctaattaaatttattttcaaggacactattagcagaaaaaatataaattggtgcaattttccattgcctcattttgtatttcagaagtataattcaacattttctcaacactttgtttttaaaataaagcattaacaaaatttacaagtgacttatttgtgttttaaaagtttactttataaaatattagtcaggaaatagtttcttccctagtttacttgtaaccatggggacaaatatatgtaagtattatcacttgataactggctcaacaacaatgaaattagcatcacaaactcagacttattcaaatttgttgaagctagtttaaagcctctaggtagaaatttattgaaggttaataatttactttaaaatttaagattacaaacaggattgaaattaacctgtagcaagcattatgttttcaaaatagttataattttactgttggggtttaaaatcttgctaagcatttatcattaaggcttctagagaaggaagtaaaaagaagggttggtggtactgaaacctatatttttgagaaaacataggtttgctaaaagatcactgtactttagtctgtcttcagcataatttaggaccaagggtgatgaataagtccattaataccaaatgagaaaaaaatgggggatttttgtttgttttatttgatacacgtggtaaccataaggtgtctatctaggatttaccagttaattatatttgaagggcactttggtcagtagctaggatatgtttctgaggaattaagggaaaccagggatgcataacagaaccacgaagaggggaaaatacatgggaaaggaaatgactgaccctggaaattattaggacatcctgcccaggatgtcattactaaatctgtgttccattattttcataaaaagatatcatctatacacaccagaggacaatggcaagcagacataattgggctgtgaacatttcatatcacgttagcctagtacttttaattagagtttcagtttaattatagtataattctaaactagttgcaggcactgactatctgatgagggagtgcagagattttatttgggacaggttggttcgtcatatcaagggatagctgtgattgggtgcaaaatgacattgaatgcattgtgcaatgtctgagacctgagattaggggaacgtgtcagttcctttagtcacattagagttccattactatgttttggaccttcccttgttcaccttaattaatacatagttacccagaaagagagtcaggttcaatattactacactttacctatgcaaatttataatatcagagggagaagaagatgaaaaggaaatgaaaaatcaaaattaatattatttttgaattaaattatttttataagaaacatgctgctttttgcttttaaacacacaaagtagcagatgtaaatgaattaataggataaagcaagttgctagaaaaaaatacctctcataggaagtaaaatcagaattgtattattgaattaaattattttaatgaaagacatgctgcttttttgcttttaaacatttcgagtggtagaaacaagatgtaaatgaatttgttggataaaaaaagttgtagaaaaaacacgacttttgtaggccttgataatgtaataaggtactactttgctcaaacttttgaaaataaatagataaattgctgggcctagtgttgttggcattactacactgttgagggcttctgtctaaatatttaagagacattcagattagtataattttattttattaagaatcatgcagctaaggaagttagccttagttggcccagctaagaaaaaaggacaatgttggtgcatcaagtggttttatgagcaggataccacctggttccgtgctctgacttcatttgttgttgtctggaataataactcttcattggcttaatgcctttgcttgtaagagacagatgctatctgatccctcctgtcagaagaattcccagaataagccattcaaccaagaacaattgctgtcttgttgattgcaaacagtagaagagggaattctctgtatttcctagcaccttgctgtttggttggtgtgtgttcatcagtagcagaaactgttcactgaccgacgaactgaagtggtacatgggtggcttttgaggcgcttttctgtgatttggctgttactactttgagttaacttctcactatctaagatgtccacattgctagtttacttttagcctttccattgagtctgtttcctaaagtatgtttctatccacctcttctggtgtataaattttattttaaacaggtctctgtttctagtccttcttttctttctccaccccttttcctcccatgtctcatgaccacatctcattcataggcaggattttctttaaggccgctcccatttcagagtagcgtaagcaatacattgtggctaagaacaaatatattacagtgcaatatgaactatgagaaaatgtaaacagagatgcaactccgaaatgtatttccaaattcactgtaggcttgggtggatattatagccctgcctgtttcacttatacttcacgtcttaaaagatctggggaatgttttccaacatcattcagcacagttctaggtctcattagggccggcagagtcaattttcttgtttgaactgctaggggcaagtcctaaaaacaaacaaccaaaaagaaacagtgtaaattgctaattcgtgtcattgcctgaaatccatgcaagcaggattcgttcattagttcttatttatttatttttgggatagcatatttgattagaacaaaattcagttctgagaagaaaatgtacggtagccaaacagttcattttagaaccccccttcatttagttagccagcctttgtagtgtgcttgttttctgcaaaatgttgtctatgtagtcctggaaaagataaaagacctataagacccaattctttgaagtatgtatgtcttgctggatactcttaaaatgtatattcatgaaagttcttggtagaggatgaagactacctatcaacaagtcaacagtattataattataattataatattttcaatcagaatatctccaaggcaactgaggaatgatactgaatcaggtcaagaaagagggaggtagatttacaactagaggagaaaaagatgtggaagggattcttaataaaggaggtcttgataccacaatccctgcaatacaatgttacagtatcacatggggaaacagacatcattatggtaggaaaataatgaattagttggtcacttaaagagtgagtttccattcatttatctaatctttgttcatcatcttgaaatctgcattggttagtctattggggagttttgcaagttgtaaacatccatcaatgtaaagcaactaaaatgcagagcatttggtatgcaaaattgcaaatatgaaaaaagatatagaatttcatattctaaatcttggcaatgaggtaagggaagtggccagttaacagttgaacctaaataattggccacatatttcatgttaacagctgaatgaaattaaagactatgtatgaatgaagaaaatacattttcaaaattacttcaaaagataaggtgtaatttgagcttttagttttttttttttcctctctctctctgaatttagaattgaaaatgcaaacctatttgactctttatgggtcttgcagtttgttctcagggctgtaatgtgtataaaagtaaatgactgtccagggtatggtatgtgtaccaatctagtagcggagatatgttggtaagaatgtgacaaagagaatgacttaaggaagagggattatagcactgggtaaagagaagtgaatttggagaagcagtgaaagtatttttaatggcttgaatagtacagtgtaagattttaggttttgttccctgtgatgtatgaagagtgggccttggccatgggtggctgatgtggtattggaagcattctgataaagtgggcagaacactggactggaagtcatgaaccctgggctttgtagccttggcttcacgtccaattatgtgaacttgtggaagttaattcacctttttgagccttagcttttcatcaggaaaatgagggtgttaaactgctctgtaagatgccttacctgttgtgtgaggttattctgtcaattcagaactgagaagaaactgaaggtgtgtggatgagctagggactaactaattcatatgtgaggaataaggacatgagctggaaccacatttaaaattgaagaggaatggatagagcacggagatatggtggaggtggaaatggtagttttttagacaggacgaatgttgataaagaagagaaagagtcacaaataactttatgagcctaggggtttgggaggacaaaagtaatactgaagattacagggaatttaggaacacttgcttattgttgggggaagaagagctcaggttttcacctatccaattttagttgacatgtgagtgagatgtcctgcaggcatctggaagaacaagcgcgaaaggggaatgagagaggtcaagcctggtgatggctcctgggtttcagccacagtcaggctgtcattagaacagaaagtggatgagaacaatgagctcactgaggaaggaatcagaaaaaagaacattggcctaaggtgtggtattggagtgggagtcggggcagcactttcgtgtaattcagagccaacatgtctggaagttggaagtcaagggcaaacatttagagaaatgggaaaggcaaagggaatctgagaggttcagaaagccaccactgagtttggttatgagatatagtaagtggattctgggcaactgccttgagccttgagctatttcttgaatattgaagtgaaagaaataattttgtggaggaaatgaagattataagaatagagtgcttattttaaccaaaaaccagaagttagacattctagcaagtaggaaaatagtgttaagtaaaattcaagacacttaatttgtttgctgtgagaaaagaaaagcttttttctccttttaattctgctttcaacgagcaattaactatcccctctaatcatttctctttcaaattctacctatactggtttaccatctatccaagtgaagcatctctctcttaggaaggcagagagtgaaaacctatgtgtgaaacctctttcttaatactcctattgcaattaaaaatgtaccccctcccaatctgtttactacaaagaggccctatgccagcttggtgtcatgaccaccatctgtaaacactatgtgtgaattaagatggattttgttacagtgaaatttggacattgactgggattgagtcaacatggaattttataactccatttagttcatacggcttaaagcaagctcgcagtgatctacatgaggatggccaaaattactgggttcccctccccctaatttttagtgtcataatcatttcagaaataaaatgcagaattttttttttccatctgagacattgaattagttgcaataactttgcaccagaatcatacagttttattgatgctggggaagtaaagccctagtgaactgggccattgaacacaccataaactttgtggcaggacaagttttctgggctagtcattaagcacccttttttcaactggaacaataccagctacactctagtagagtcagtgtttgctgaggctttattccagcttcaaatctatccccctgcccactgagaacatttggcttgctttatagctctctagggaggagtgggagcccaggagcactggctgaggaagagtcagccagctggatggctaaggtgaagttggtatggagctggttgctcaactcacctgtgagtccaggaagaggaagtactataaggaattttgtatcttaggaattttatttcctagcaatatatcttaacctaaaactggagatgcttctttatttgcctgtaaattagcaaaactttaatattgtcttaccaattttatttttgtatccataatactgcttttctctgatatgggcaagtgaaaatgaaagtaactgaaaatgttctgctgaatagcaaacacccaaggcatcgtcatctttacttttgctaaaaaacaaacagaaaacccccaaaactcacatgtatttgaaatcatctctttccgagagtggcagagtatcataaaaatccaaaatggcctgtgcctatggtcttgttttgtaacattattttgtttgcatttgtcagcatgaaggtcactttagggctacctgaatatctgtattgcactctccagtgtggagagaagaccaaagaaggttagagcagttccggaactagcacatcaaataaaagtaccaagcagtacttgaggtgtggtcagctgcaactctttgcagccaccaatacttaggcacagtgatgggtccagaatggatccagtgagaaggcaaaaaaggaaggtctcatgtatttgctggtattctatcagaaaacaagagttaggaaggagagtgtaagtaaggcatgaaggagtccatgagccataagcaaaatcacatcaatttttaaactctttgatctttgttctgctttttttccccactgaatggtagatatcagaacactatctccaaagattgtctgaattaattaattcccaagtaggcaggaataccaaaccctctctttcaatgagtttaaatgacgttccacacatttgccctaagtaaggtgatacttaaattgtatctttacacgtattgtgcagttcctatcctaggcctcttcattttggtggcagtggcaatggcatatggagagtgatggctggagaaggagttgttaaattatcctcaaaggcctcagaattgaacattgtttcttatttctgtcctatgaaaaaagacggattttaattatgatctttttaaaatcaggttgggtttttactaataaaaaaagtcagtgtttaaattgtatatttgaatgttttctctctacatttttttaatcacaaatatcagctacatgttacacagtttttcatttcttagtctttttgaatgaaataagtagtcttttctttggtgcttttaaatactattagttgaaacttggtggttattcttgaaatttagcttttagaatttaatttattctaaagtgtacagaaaagagattgcaactttgtggtgaatgttgaatgcagctatgaaaacaatgttaccttttttcaagatctcttgcctagctataatacatctgctagttactaagtgtaactgtgtatagggtacagaaaagagattgcaactttgtggtaaatgttgaatgcaaccatgaaaataatgttaccttttttcaagatctcttgcctagctataatacatctgctagttactaagtgtaactgtgtatagggtacagaaaagagattgcaactttgtggtaaatggtgaatgcaaccatgaaaataatgttaccttttttcaagatctcttgcctagctataatacatctgctagttactaagtgtaactgtgtatattttctttaatagaatttgttagcttcctgaaataaaattagcttgctttatttgccacaaatttgttactttttctaaaatttagttcagggtaatttcacaccaaaatgggtaaacatttttatccttcttggctttcatgattgctctgacttcttcataaaatttggaaatcacgttttaactttttattgcctctttattaagtgcttggaaaacacatggaagcctttttattttacatactgtggtaacatcctagtaagattttattcgttttcactctcaagattgattttttttttttagaaaagcagtttagaaagtacccatactcgttgaaatttgtcatcatctagaccttaatatcacatatcctaagttccccactaattatttgcagatttccaggacttaaatatgtgctaaacctgaaaactatgaatgcatttgctgaatcaaaccaaaatgaaattgttttcttaactatgaacgagactaaataattttaaaacactactcagccacagtaaaaagagtgttgaaataaaactaaatatatatatggtatacacttgttgaactaagcctgctttattaaaatgactttatgattctccagtgtattgtttatacatattatttctaaagattcatgtttagctgataattcatactgcttacatatttttggattggttgacctcagacaacaaggatggtttctagcacacaacacattctgaacatatcatgagcaagatgctacccaagttgttttgtttgttttcttaaatatttaaccaacaacaaataaaagtatatattcaaggtactaatatgatgatttgatatacatatacatgtctaatgatctccacaatcaaatcaattaacatatctgtcttcatccagagttatcatttgtgtgtgtgtgtatgtgtgtcccaagatattgttgagggtctgattttatgaccccagtaaaaatgatggacataggctcttgatatgaggggaaaagtgctgtaaacacaaagactgccttatggggtgagagtgtagttcttgggtgacagaagtaaatctgtactgtgaatgtcctctttggagaattacaaaatgacatgatgactgaactgtaatggaaaacttgttttggtaagatatcctttctaaattttttttaagaaaaagaattctaagtgctgagttcaaagacttagtagaatgctactgataggaggattttagtgtcagtattaaatactgcacaaatacttgacactgaacatcgtgtataatggatatggccatatactgtctttttaaaggaagtgcttcctgctttttctccaaaatagcaacatatttttctcattagtgaaatgatggctctcaaataaatatcccagcccagtcctctgtttttcagcccagcctgtgcttcagatttacctaagaccataacccacagtgatgcccaggagtacctcaatctcagcatacttaaaagcaattgtattatttgtgcccaaccttgtttcttatgaattttgcagagttttagttacctaaacttgaaacttgccagttggccttggttcttcctaccttccttacatcaaatcttgcactgtctccttaaaatctctcatacctatgtcttctgcatattccagtactgatgtagttaagaccttcagagtatcattcctagaccgtggcagtagtctcctgtcttccactttagttgcacagataacatcccctaaccaatctatctttcgctgttctcgcgaagtgatctatctgaaataaaaatctaatcatgggagtctgtcttaaatgttcactgcctccctattgccaacagaaagtagctttacctctcaaatgttttctatgcacaagtcactctttaaaaatattatattgtataatccaaacagcaactaaatgaggtacttacctttattatcaccattttataaatgaggaaacaaatacagagaaaataaatacctggcccaaggtcacatagctgataataacagggccaggattcggcccaagcagtctgatgatagatgccctgtgtgtaaacactatgcaatgatacttctaatttcttagcttcccacaaaggcagggtttgaatttcaaagtgaaccaagagaggatgggcccattttatatcatcctataccaatgaatgtggcctgccttgccacactgtgtaaaggagattgtttcacattttatggtataaacttaatgctgaaaggcagtagttcttatcgcctgagttggtacaagtactaatggttcttaagctatttattacattgtatggcatcagttttagttgagacattgggtgtttgtaaatgcattcgcaacacccatacatgatcttttccttttagcagcatcttttcctgcccttgtgctgttgacagtttggggcatacattttgctgcaaagaaaaagataatgacagtgagcattggtatgaaggtatttcccttcttgcttctgcctgaggcacttgtgagttttcagttgttgcagaagttctgaaaacttttatattttgatggacagagccattgaaaaccttgtttcttgaagttaagtttgatttgagaaaaggagtatacagatacttatatagccatatgttgccaactccttgccatttattcagtccacagcttgttcttgttctaagcatttattttattttctgaggtcattggtttttctcctaggatcaggtgagttaggaagatcattttttttttccattgaagaatgtagtgttttctaggacacagttcaaacttttgtgaatgtcttaagtcagtttctgatgtttctttcatatgagaacccttcatctatttgatgacagctctcatgtcccgtgatgtcacctctgctttaaataaacattcatgtttctcttacaacatgactttcagggtttgtttgtttgtttgtttgtttgttttcccctaccatcctgctctccctttgaattaggagactcaagggtataattgaatatggtttagtgttacctagcaaaacactggcagtgatcttacaaataatttagttatcagtccctacaccttgttttattatttctcgagcctaagacagtggttattgcatgaagatctgtggcccgttaggttacatggaaaggagtgattcatgaacagactaaaaattcagattatacaaaatatgtcaggttttgtttttgttttactttgtctttaatgtttgttttctactttgtttattatagaaatggatgctcattctagaatgaaaataatggagtttcaaaaatgtagctttttaacccagtagtagctttacaagataggttttgtatgctgatcagcaggagattctggttatctgagtcttcagaacattcgttcaggcattctgtactctgagagactttaagatcatggaaattaagagttttgaaagttctcaagttctcaaaagcatccttgaaaaataactaggaggtgagtcatttaatatttctgaacatctgatttctgatcgtaaaaatcaattaggaaaattaccactttgcatccataatagtaaatattgatttgggaaagaataatcattggatactaaattggaattaatagaaatttgacagagagcaggatatttgcatggtcttaaagcacttccctacagacattttgttaattgcaaggcaaaaaaaaaaaaaaaaaaaaaaaatagtaaccatatagtggaaaaactgaatgtcaaaattaatatcactgaggggaggcagacagatatcatgtgctttcaggtatgatactataagaacacaaaaccacttttgtagcattctggtgaagaatgcattacctgaatctcatcatgaggaaatatcagacaaatccaaatagagaaattgtctaaaaaaatacctggcctatattctttcatggcagtgtcatgaaagagaaaaaaggctgaagaactgttttgcattaaaggagatttagagatgtgagttgaaactaaatgccatgcaggatcctgggttgaatcctagactggaaattatacttaaaaaggacattatggagaaacttggcaattgaatatggactgtgaattatatcaggtgtttgaaaaattttaaaataaaagaagaaatacatattttagaatttgcaggcaatactgttgtctcatgcaacaactatccaattctgctgttgttcacactgctgccacaaataatgcagaaaagaaggggcatgattttgtcccagtaaaactgaatagatgaaatcaggtggcagactagatttggttcacaggtttgtcaaactctggattatataactgtggtgtatcaatgttaagttttcttaatttggcatcaatattgtgattatataagagaatattgttacagttggaaatatatattattgaaatattggggttaaagagcaagttgtatgcaaccactctcaagttgttttaaaaatattaatatgtagaattatatataataaatggtaaatagatgtaaagatgggaaatacatagtagaagatgttgaaaattggtgaacttgggtaagggatattcaggagttctttgtgttagtctcgcaacttttctgtaagtttgaaattatttcaaaataaaaagataaaaacaaattcagggagttccctaagctaaagggggggggggtgtcaaaaattcagggagttccctaaactaaattggggagggtgtcaaaaaacaaaacaaacaagcaacacacatgtgcacacacccacttgccgcatgtagctcgggtgcaccacctgtgacataacgaaccatgtgaataaacagaagcaacacaaccgggcttctgaggcactattcaaataaaacacagaattaatgaggagaaaatttcagagaaacaaagaacagaattagaagcaaaagctcagcagaatcacctgatttcacttggctttatcctctctggagggaagaagcagccttggagagatggcaaggtgtggctgtgttgctgtcaacttctactttgccctcttgaactgtctccttcatctttccattctccaccctcttctttcccccctctcttttcctctctctctctcttttgtttctgcaaccgccttttttcagtcttcttattttctttggctatgttttattgcccgctcataagctggcacacagacttatttgcttctgctatgttcttattatacattagctcaattaaagtaattgaagagaaaccataatcagcatgacgatattcaactcatttgaaacccagccccaaatacagtgtgaaaatacccattgttaacttcatgcacactccacatacacctgttgggccactagcttataggtaaaaataaaaaagaatgtattttatcagtgagtccatttgcctggtccatttcacagccaggccacattctccttattaattgacctgcttttgttgtgagttttttttttttttttttttttaggttgttttgtatctagtgaatgcctttctgatttaaatttttcagtaatttataattgctttcctttaaggcttctcttttctcctctgtaatattatccctgtccatctctattgccccaaactgttcttggtaagtttctatcattattatttttttctggaacaggattgtctgagccttttcttctcatcttccctaatagctagaatcttctgcccattcacttttcccccccattcatttcctgcctcagtttctacttccaaatgtcttgaaaagtaaaattttattttgttgagtaaaatgtaaaaagaatctcacagtacttatatcagaaaactggatgccctgtaaaataccttgatgtgtggcatatttcttacagtggctgggaaaatgttgaatatatgtattctctgaccgttttcaactattggccatgactatcattttctcccaggaatattaaattcatttaaagcccagagaacagtgttgcataaaatttgcttttaaatgatgtccttcagtgatatttattgaaggcattatcatatattctaagaatattttgattctctaacttatagaaggcaacctagctcttaatgtaatgtgattttaactttccttgtcttgtttattttcagtttggtgacttactctctcctttaaaaaaaaaaaaaaaggaagaaagaaattcactacatggttaaatgcagtgaaaatgtgtactatagtttcttttttttcctttctttttaactgtggatgttaagctgtatagcccagacttgtaatagtttgcaggaaaggcttcttagccattaaaaaaaaaaaaaaaaaaaaagagagagatattgtttcttcttctagataatgcctcattgaacctgtaaaatctgtatgttaagaattatttaaaagaaaaattctgcacaatattgatttctttttttgtcttgcctcttctgacatagaaaaaagctgcaggcaagtattaactgaaacactttctaagtttcaacaccaagttctcttacttgaacttagtgtttttgaaagatgatggtagtgctatagtaaagcagagactttgttagaggcccaaagtgaaaagcactaggctattatgaataattttgtgaacttacgttggattgattttaacatgactacttttgtttaaaaaaaaacgcattagaggttaagaaaacgatttcatagaaaaagtcaaagctcaaacaacacttcataattagcattcaggacacaaaaacacttgagaactctagaaaaccttagaacattccaataaactcatatatatatatatatatgaaaactgagacccaaggatgaataactaattgttttaatggggtctgaaatagaccatgagttccccaaactacaagttatataagatggttagtttattattctgcttaggaataacaggatgtataatgttttcattgttgttagtttgttgttctgttagttgttgaagtatgtattatactagttttctatggctgctgcaacaaattgcaacaaagttagcggcgtaaaacaacacaaatttattctcttacatttctggaggtcagaagtcaggagtctcactgggcccataaaatggtctgcagggctaggttccttctggagtctgtaggggaagatccatttccttgcctattctagtttctagaagtcacctatctttcttggctcatggccctttttctctctctttaaagcccacactgtcatctcttttctttgctgcctccctcttccacatttaaagacacttgtgattgtattgggtacaccttggtaatccaggacactctccccatctcaacgtcagctgattatcaaccttaattcctctttgccggataacctaacatattcacagtcccagcgattaggatatagacacttgtgtttgttgggggcgcattattcagcctaccacaagtctaatctaaatattcacattaaaataaaaatatgacttgaagcagccaaagtcttatttgtttggaggcatagatatcaagttaacttgattgttttactcttctgtttcttctcctatcctcaacacttgtgctagaatatctctttaaagctactccagggtgttagtaaataacaataatataaaaaatggccagcattttgtttcattggatttgaaatggatttctatgttggaatatacattattttggaggtatttttaggttattggaagccgagtgcatcaagcatgctctctttgtgtgcattctttattaatttgtaacagcagcttcccttggcatacatctacagctaagtacacaagctaaccttttgtttcttgatagatggcttaatatatgctttctagctagataaaataaatggaggaaagcacttccttatagtagtcatttctgtttcttcaatgttagatactggtttgtttttgctcatcttgccatggatatagtgatctttttttcctacaaatgtgaaaagtacatttatcgttgctatcacctaaatacttcgtttcaaaaaattgtgagatttctttatcaatgggaacttctgtggaaaagaaacttaccctatgttggtgaaattgaatacattaaggtttttttttttttttttttgaaaaggtgtttaatgtgtatattgaatttccctggcttgaggcagtgttttcatttcgtacagagattttaggaaattatttctgattgaaacagaaacattggaatttgtcaaagggttagagaaatctctgactaaagcaaagtgccaaatactagttaggttagagaaaatttaggagaaaataaaacagaaccaatggaaatttgcttcttgggtgggtggacatgtctaaatatgaattaccaacatggaggttttggtgttgtccaccgaagtcatggaattgctggaggttttggtgggaaattcttttctgcaaatctattttagaaaaagttttctactcatgacaatttatatcaaagataatatttaacagtaatacaaacttgagaacagaaaaagtccaagtagaggcaaattccttgaaaataaacattactgataagcaatgttattgtattgtattgtattgtattgtattgtcaggctcttaaatgaaggccctaataaacttccattgaagagtttatttaactaaaaacttgaaattcaggatttgtgtgatgctgccagactgaaatttggtctaagattgtgtgtgtgtatatgcatacatgtttagtaacatatgcatgtcagcctgttaatattcctacaaattgtgagccccaaattcgtttgtactggtggctcaatcagcagttaaagtgttgccctctccatcatcaactaagatttctctaatcagaatagtctttatttatttatttgataataatttgtgtgtccactaattgccacgcgttgtgcgagatgttagacgcaggatactgaatataagcaaatgtggtccttgacctcatggagtttatagtgacactcaagtcaagaaatcaattaggtagttggatatataggtgtagagggcaaaggattatatctagattatggaattttaagaattttaatgggacagttacatttgcttctaattgaagctattgatactaaggaaaaattccaacatttaatggccaatgagaggattaatgggacagttacatttgcttctaattgaagctattgatactaaggaaaaattccaacatttaatggccaatgagaggattaatgggacagttacatttgcttctaattgaagctattgatactaaggaaaaattccaacatttaatggccaatgagaggactatgaatttgcaaaggaaacctacgagtggccagaaaggttggaagaaactagtaggtttacataatggaagccaagaacatgaagagaagtaagtgatcaccggtattgaattttgctgaaatatgaagaagagtgagggctgcaaacatgcttcgcgttggtgatatgaaagtcatcagtgaccttagacaaagtggtttcaatgacacagatctgtaagttttcttacggttaggatgtagttcttctgggagtggatatctaaactcactggaagtgaacatttgctattttgtagaattctcatctatgtgcagggtttactttcttctttttgtatgtgatatttatcttaccctctcaacatcaaactgagtaacattagcaagataggatttgccattgttaacactgcactaggccagtccaatggctcctgcttataattttagcactttgggaggctgaggcaagaagtttgagaccagcctgggcaacgtggcaaaaccccgtctatacaaaaaatacaaaaaaattagccgggcgcggtggtgctcacctgtagtcacagctacttgggagactgaggtgggcggatcaccctgggatgtcaatgctctgcagtgagctgtgactgtgccactgcagagcctggaagacagagtgagaccctgcctcaaacaaaccaacaaaatgcagttcactgtctgccttgatataagcataattttctttaatcctcgtgtccaaaatataatagtaaaagcttcttttgttatttttagtatcattcagttttagttgattctcaacttcagtctctctgatattttttaagggtttattcatttgtatattatttttctcttacatttcatttaaaatttatgtatattaaatgccttagctgaaaaatattgtgtgcatttctttgaagcatactctgccttttctgttgattcattttccttgtatattcaattaaaatgagccatattgtatattgtgtgcaacattgtatattgtaaaatgagtactcataaaatccgtttttctcatcccaaattaaaataatttatttttaaatgtctaaatatctggccatgcctactatcccccttgctagttattaggaacctaattgtcttgtgtttctagactctgacatttcaaagacctgaaatgcatctacttacagttgttaccctgtacctgtaggaggctcttgtacattatgcatagaaagtgcctcaaatataattgctttattttctagattaagaaaatctgtgttagaatattcgtctttgacaattcttgcctatgctattgtcttctttaagcttcagaactaatttgctttgcacttagtatggattgtctgacacatgaattaacaggtaaaatattgtatatccagtgtgttttttcttctattagatttctttatctgtaattgtggcattgacaaagacttggcagtagatactatgaagacagattcagccaagtaaactgacagtagttgctacaagaaaacattcaggaaaaaaacatttagtaatttttttcccttagtctgagtaacaactgagtaacaagtcatagtaacaagtatgacttgcttcctaggcaggcaaccagtgcagtgacacaggatcccaaattcagaagagggtccacacttggggtttaatatcctgttattactgtcttgaaatttttattaattttatctttgattttggttttataaatgaagccccatgagacaatgggccgagagcttgaggcttggaccctctgctcacatatggtctgcctcccatgcctcttgccttcctggggtgggttagtgggagcttgggcacaggtgtgggtatggttgagtttggtaagtatttactgagttatgatacagggccccaggtacctgtgagggtctctaatcacctcatggatagtcccatgcccaagagagcttgtcattcaatagcaaataaaaaataagtgacaagttgagagagacacctgggaagaaagataaaggaattcattttcctggtgtttgaataaaaggcctgcattttcattttgttctggacaagtgataaagtcagccctgacaattgttaatagtgaactagtgcttggaaacaagcttcacctttggaacttattgattcgtttccataatttttacattttttttaaacatggtatatgaatagatttggttgtacttagaaccctaaggaattcccaaatattttataataagaattgtctttccacagattaaattgtttgaaattgagctatttatagccttatagtagtaacaaaaggaatttgaatttaaaatatggatttgcaaaattaatatcaaagttttacaattatttttaccctgaaattgttgaaaaaaaagcaacttgtttaattaaaactcttcatgatcttttaaaattttcattttatttcatgatttagtgtgtgaagactttttttacgtaaagcttttctatatcttcactacctttccctgggtcccacgttcatttcagccttgtctttactctcaattggtttaacataccaaactgctcttgttggaaattataaattttatttgactgctttattgtaggacatatttgctttgcatgaggacttttaatacatcagaatagtgtagggttgtccttggcaaaatcccaaaccttttttcagagcaaaaaacaaacccgggagagagaacaaattgtctttaatctttccatccatagcctttgtgacctctgttattgcaactcctgtagacctgcagtgttttttttgtgttgttattgtctttttttttaaatctcagtgatcttattttattttcttctaaattaaaaaaaaataacattggtgttatggctcgaattttgtcctttgtcacaagttggaagagttggttatgctggtgttacaggtactcacgggggaatgtgctggagctgttgtgtgaccatctgttgtatatatatatatatatatatatatatatatatatatgtgtatatatatatatatgtatatgtatatatatatatttaaactaaaataaaggctttagatggctcctggtgaaatatataataacatgttaaaaattcttaatttattacttttgatgtatggttctatcagcacagcagatttcagagatctgctttgttgattttttccaaattaactttttccttccttttatatctcctaaggcagatcacacaaatggatattttgggttgttaatgcactcttttcttactcaaaagtcctagggaccttaagtaatttactttgccttctgtgccagctttcatctagtttatgtcttcatattttctttccatctagagactagacgcctgtttgacttaatagttgaatttatgactttttacttgacttctgttgaagcaactgtttagctacatgaagagatttttttttgtgtattttttatagtttggctcattgcctaaaatattatgcaatagtgagtaggtgctttgcattccaggcataatttagtttatctaaaagtttgtcatgtaattcatggaggaatcatttatttaaaagtaaagtttggccgggtgtggtggctcatgtctgtaatcctagcattttcggatgctgaggcaggcagatcgcctgaggtcgggagttcgagaccgcctggccaacatggtgaaaccccatctctactaaaaaaaaatacaaaaattacccgggtgtggtggcaggcacctgtaatcccagctactcaggaggctgaggcaggagaattgcctgaaccctggaggcgggcgttgcagagagccaagattgtgccactgcactccagcctgggtgacaagagtgaaactctgtctcaaaaaaaaaaaaaaaaaaaaaaaaaaaccgtgaagattgacttttatagagaaggctgaattattttgcagaaactaaataaaatttgaataaaatacttcaatttctcacttcctaatagctatattagttttatgttgttatctggaaaggtgcatatctttaaagtataaacttgttttatataaaactacttaagataaaatatcaatgttatagagctaaatgctgatgggggccttgaatggttggtaaacgttggatagatgtggcatcaaggtgcatttcacaggtaaattgaagcctttgtggtttgaagaggtgaatgtacatcacaggcattcaacatgtgtaagcagagacccccagttctaaactggttattaaccctgggaatagcacattggaggctgccaggtgatccaaacactagcatcaaacacttaattttaactgttgtaagagagacaatagatagtataaacaagcagagagaatataggacaaacttggaagggcagtgcttgacttttctagttgtgaataaattctgaaccttttcttccacactttatctgcatttgtcatatagggggcatcactttctaatgtacagttttttaaatattttaccttttgtggtgatatgtttattgaggacaggcatttattgttccttttttatagtccccttgataacccaattaattaattttccaagtgtcatgcacagtgtgataggggttctaggtgtagctagatgtgggactaaaaaatatttaacgaagaaattaaaatttacctatttttgactgggcacggtggctcccatgtctgtaatcccagcactttaggaggccaaggcaggtggatcacccaaggtcaggagttcgacaccagcctggccaatatggtgaaaccctgtctctactaaaaatacaaaaaattagctgggtgtggtggcaggtgcctgtaatcccagctacttgggaggctgaggcaggagaatcgcttgaaccctggaggtggaggttgcagtgagccgagatcatgccattgcactccagcctgggcaacaagagcaaaactccatctcaaataaataaataaataaataaataaataaataaataaataaataaaatatacctacttttttcccagatagccttccattttccactctgttttcacttcatgttcctcatcctttctagccattcctgtctttctctgatgtccctccactctctagatctattttgagccattaaaatgtgggtagtctgaattgagatctgtaataaatgctaagttacatcacgggtatgataagaacaaaagagtgttactatctcattagtttttatattatttacatattgaagataatattttggctatattggattacataagtattaaaataaacaacatgtgatttttcctttctaaaatacagtttactagcaaatttaaaattatgtatgtagatttaattatatttttattggagaatgctgctctagagtcttttattgatttttttctactaactctcttaagacacctttttgcctaatctcttctgctcaaaaaatattttcatgggggcctgaaattagaagactgacaaatctagccaagcacagtggcccacacctatagccttggctacttgggaggctgaggcaggagcattgcttgagcgcaggagttggagtatagcctgggcaacatcgcaagaccctgtctcttaaaaaacaaaagaaaaaaataccaacaaatcttctgaaacttgtctttaaaaatgttagatgtaatatgaaaatgttagatgtaatattattcatcaatgatgcactgataaatgcaatcacaaacattatgctaaaataaacaagtcaaaatagaccttgttctatataattccagttatgtatgaaatgtgtagaacaggtaaatctgcagagatgggaagtggttgcctaggaaagcagggaggaggaagtgaggaatgactgctagtaggcactaggtttcttttaggagagagaaaggtaaaatcagagagtggtgattgttgcacaactctgactacgttaaaagcctctgaattgtacgttttaaaagggtgaattttgtggtatgtgaattatatcttaacagcagttaaaacaaatttaccttatcctttattaaaatcaactttgctagaatttaagtgtgtgtttttgttaacgtcaattgtggccaggtgctttcatcttaaaaaatgaaaaaaaaacaggtcaatgtgtgctggaacttttgtaagcagttaattcctttttaaaattggtgtgtgtgcaaaatttattttaatgcagtttttcccccaaggggacttgttaggcaaatgtatttaagtgtccttttaatgcattttatagcttcagtttattcctttataccacagtgatgttccaacatctgatgaattctggcttttcattaggacatctggatttcacacacacacacacacacacacacacggaataacaaaagataaaacatttttcacaaggtggttatacatatctatactacaaatgtataaatatgttttttcctaacaaatcttgacaatacagaggttgatgtgctgaagagaaacacttcgattaaattggtccattataagaaatgaaaaaagatgaatgtaaaggagtattttaaaaaataatttctttccagcttcatttttttcttttactattcttccttaaagatgactgtaaactggaatatcttaggttaatattatttttatatttacacctctaagtgttcattattttatatctgtccttcattttgacatggctaattttaaccttcaaaataaatatataaataaaccaatgtaaaactaatatcaactttgatcagcttgaccttaactaagcaaatagtggagaaatgaaagtttcttacagaagtttaatgtcttaaaatggggagaagcattttgctttcatctgctccatcagctacactgggacagcagttgtgtctccattaaattaggtgtgctttgattctccaaaataaagaattttctagacacttgacttgtgtcagtgacttaatagagaaggaacacccccaaattggcaactctgtttatctttaatgattacttcttttggaaggaaaagggcattctttcttttttttttaaagacaggtctcactttgttgcctaggctggagtacagtggtatgattacagctgctcactgcagcctcaacctcctgggctcaagtgatcctcccacctcagcctcttgaatagctgggacttcaggcatgcatcaccatgccctgctaattttttatttttagtagagacgagatctcactgtgttgctaggctggtctccacttcctgagctcaagcaatcctcccaccttgaccttccaaagtgctgggattacaggtgtgagtccccatgcccagctggaaaagggcattcttgatgattttcaaaccacagctgggacatacaatgaatctataatcaataatgtattattactctccactgttgacatggttttgatcggtgtccccacccaaatctcatgttcaaatgtaatccccagtgctggaggtggggcctggtgggcagtgattggatcatgggggagttttctcatgaatggtttagcaccatccccctagtgctgttctcctggtagagttctcatgagatctgattgttaaaattgtgtggtacctccccacttctttctcttggtcctgctcctgccatgtgagatgctgtgctccccctttgccttctgcatgattgaaaactccctgagccctctccagaagcagatactaccatgctgcctgtacaacttgtgggatcctgagccaattaaacctcttttctttataaattacccagtttcaggtatttctttatagcaatgcaagaacagactaatacaacctctttgaatcttttcccattaattatggacaactgttatctccagtgtaatgttattattctgatagataagtaccatgattgtcttgtttattagaaatggcagcccatgaaggtttcttacttggaggaacttaaagaatgatagcaacagactatgagcattttcttgcagtctatagagtacagggccagacttctggcctgtgctgtttcactggttcaaatgactccatttgtatttgctgtggatgtctgtgttttagtagcagctttgggtataaagctgtcaaagccatcacttcagaattcataggtgatccacagagatccaggtggtgggagaatggctttcaaggtgaaacttggtgaggtggaacaaggtttccaggtggttgtgggtttcttgcctgtcttccttttttcttttgtcccattgtaagtagtgggcataaaagctatgggctataatgaactttgccaagttttgatgccatgccctgaccattatagaagcccggtaaattaatttagtgtgatcgtataactataagaagatgtttttgatttattggatattaaaacttgaaggaacatagggataatgaaatttatcctactcattttccaaatgaggagcctgccaaagattcccaacacatttaccattaatctttttcttcctttgcaatagattcctgatacttttaacctgtactgctcatatttaaacattccaattttcaagccatgaggatggctttttaagtgtatatataattttaatgtcaatgcatgtatttccaaaattctgtgagctttaataatagaaggaatatttgaatgaccatgagaaatgtccgtcgtttgtgtgtgtgccttttcattggtgacagagatgagtgtaaggagaagagcataatggatttctttcacatatgtaagcaaacaaatacactgaaaaatgctctgtgattctctcaaatggtatggtttcttttttattcctctagttttattgaattttaattgaccaatacaaattgcatatagtcaagatgtacaacatcatgacttaattcatatatacattgtgtagtgatttctacaatcaaattaatacaccgttcaccacacagttgccattttgtgtgtgtgtgcaagtgtgtgcgtgtgcacatgcgcacataaaaaggacacttaaaatctgcttcaaatggcatggtttcttattataagcaattaaatgtagacatttatttcaagtcatattatacaaatgtgtagtttatactcttcttagagtatattttaaattttttagtgtagagttatcttccatatattctgtatttatgactgcatactcatatctgtaaggagagtgtcatctttttattaacttattttataataaagtgaataaaacagctggcttaatcttaagaataagcaatccctgtcagatgattgactcttcatctgctctctgtatactggccctgtttcctttttttgcccaaaacatttacatatttcctgatttttagtttggatggaggtggggagatcaattttcttattgctattcatcttgacagtttgtgccactaaagtaagagatggagagaaattttctgaatgttcaagtccctatggagaccatagtgttgacccagtagagacagttgagaatacaaattgggagactgattttcttgccttctctactatttgtatatttgacagtataaggtgtttgagggcagtacatgtggaaatgttaaggagttaacattaatagtactgtggttaaacagatggcgtaattagcccgcaatggggaagaacaatgttttcgtgtttggataaaaagggcacactgtaggtggtagaataagaggttccaaatgacagtaccttatgaagatcaggcaagtgacaattttcatgatttaggcacatatctgtgcatatgtgcacctatatataatctctagacctatttttatctaagtaaacaaactcttgtcatttttaggaaaaaattatctgtatgtgaatgcataaatgactattaattcagcttagtctgggagatgtggctaagtattgtggaggatgcagaaaagaatttggtctttgtattcaagtagtcagttttctgggacaaattcataagcacaatggcaaatataggacctggcaaaaatttattgcaagtgattagctatatgattacttagccaagtccagtattcttcacaaggggaatatttttagtaagacagagaaagcagttgatggactaagtctgtctgtctcttcaacttactcaatattgttacctacttctctgtgtggaatgaggtttgcttttgtcaaatctgatttattctgaacttggttatagatgcagcacaaaaagtgatgcaacaagcaagaaaacataatcaagtgaataaaagaatatggtaaaccttcctgtttgtatactttgaaagtattttccatagtaaacttggaagttgaaattggttgtattctgtgctatttagatagatatgactcagatttttataataatgtaaattttgaatattacctcatattttggctaattattagagagatatttgcagattttcccccttgtcagcccatctgctcctatggtacagtcataatgcggaaacattgacatctcaattatttccatggcaacaaattgatgtcaggatcctacatttaacttcactgcaggaccaaataggatttggattacaggggtgggttgggagctgttattgaaacataagtctttaagaaagggaaatagaaacattttgggaaatgtatttttcaaatttagacttacctttaaagaggaaattataaaaccacacatgaagtgaataaatgaatgctcttctctctttctatctgtaaaaagccaatgaaggacattttctttctctgtgatggttgcaagtaaaactttgaatctcatctaatgtttgcttaaaaaccggaaagacccaggcagttgtccatagtccaagttcagaactatcatacttttagtttagtaatgtatataaataaagtatatggtacttcaaccttaaattatgtaatctctgtgtcttttgtttagaatatggtaattatagttatcttatcttccatacttgagggactgcataacttcagtgtgttttggtactttgccttcctttttttatgtcatttttgtgctgcattaaagagtatctagtattttattagatactcctgatatggttttactcattttttttactcagggtaaacaattacatttgattcctacttacaaattttgttgaatctacaaatatttctgatacttttttgttctgtaacccttggtttgtaacttgtcataaggctggcctcatattcaagtgcatttgggcttctgcctccctggctggaatgtgaaggcaggaattgtgtctttgttatactcatagtacctggcacatagtgggtaatttaagtctgtttgttgaaaaatcttgttatgatctcataacaagagtttgtcagggcagattttcagagtatcgatgatgtcaccccattccactgctggatcttgaattttgcagggttaacattttgatttatctgttttgaggagcccgattcatgataaaacaagctgaaaagagactgacttatcatgaataattggtgataattccctggttctgtctattaacttcttttgatgactgatttcacgctgggagatcacattgtagattatatggctcttagatgaaccagccctggattaggtgttcctaaattaggtgttcaaaagtattgtgtttgctgtataaattgtgtctggacattttttctatccaggtacctgatagccatctctaggaggaaagtattttctaactcttaactgtgctggacaaataccaccagaaattgtgttcttctctcctctaaaatgactgtatatcttcaccctcccattaaatattacataagacattagagtgtgaatattacaaatgtatgacctttggtatccctattaaaacaagagggaaggagaggtagagaaatgggcactaacttgcttcaaatcgcactctgaaataagtggaggagttgggatttgaatctgattctggagtcaggtcacttgcttctgagctcatatatagattgatagatcatttctgaagtaggatatgctgcttatgctttaattttaactgttttcagtattaaaaggggagcgtctttccaaatttgagcatatctcactgtagcccctaagtgggaatgatagttttctacctgcaatatacctgctttcaaggtcaggaaagcagagaattgacatgagactaagaagaaaatgagtgtatttaatgataagaatttataatgagatttcaaatcagcaaatatacccattttggatctatttatttattttttctgtgcaacttaatagcattgcagtaaaaacttgctaatttagatgacttgtgggcaacacctgtttgaattaactgaaagtctgaatcacataataattttgtatacaataagttttattatttttctgatacataattaacatcatttaggagctagaaaaactaagcttctgagttacttagaatagtttgttttatatgctattaattgccttttaaaatatttaatattttctacttagagattgactctttgcaaaaggcttttatatacagccctacatttaatccccagaggaatccttatttttcagattagtcaatttggagtaaaaggagagcattaaaaaaatttcttcaggaccagatgtctggttatataattctatatcaagttaatatagctttcaaaaagtaaagcaaaatagctgagtaaacttatcatgagcagacccacattacaagaaatattcaaggatttccttcagacagaaggtaaatgataccaggtggaagtatggatctacacaaaagaacagtgctgagatgcctatattagtaaatataacattttttattaggtatatctctttaaaggataattagtgactcctgacaggtatggggtttctttttggggtgatgaaaatgttttggagttagacaataatgatggttgtaaatccactaaaatccactgcgttgtacacttgaaaatgatgaattttatggcatgtaaatcatattgcaatacaaataaataacaaatatttttaaataaggtattgataaagcaaaaagatggctggttagcattagcctggcctaaagcctgtgtatttgagatgtttcattattacatcacaaatctttgctatttagataactctttttaaattatcatcaaagtttgcttagcagcatctgaactgtcttggtctgctcaggctgctataacagaataccagaggctgggtagctgatcaacaaaagaaatttatttctcacagttctggaggctgggagatccaaggtcaaggtgccagtagatttggtgtctggcgagggccctttttgtggttcatagaagctgtcttctggctatgtcctcacttggctgaaggggcaagggacggaggtctcttaaaactaaaggttttgcccttcgctgaagaccgttgctgttgctttattccattaagggctgcaaaatggggattttcttattatatatccatatgttattgtgtattgtgtcttattctttcttatccatagagtgtctggaattaacttctatagaagaactttgctttacctgccagggctatttggttacctggaaccacagtttttaatggcaaggtggaagaattttcttccttatgtatcagttttcagcatactaagttggtgccctgcatgcatcatagttttcagtttctccatgtgattcttacatgcagcttgggtagagtagcaccaatgtagagcttggatacatcccaaattccaaagttttattacttattataaaagcacatttacagggtggctattttgtttttgccacattatttatcctcttgccaaactttatcagagcatatggatttctttcgaagcatttctataggggagttttgggaggtgcttccttatatttgttcatcttacaaactaaggtaaatgaattgtagaagaaacactccaaaggcaaccaaaaaataatgttaacatttgttcaggatttattttgtgccaggctttgagcttggccctttacaatcgttagcttatttaccctcataacacctcatgaggtaggtaatctaattcctaatgcaacagaagctaaaatttatctacttgtctaaagttatgggtccagcaaagggttgggctggagctaaggggtgcagacgttgggagatccagagcctatgcagtgagtcccaattctctgctcttctcagagtgggatatttcacatgtctaatcccattccccctgtagatttgtctatttccattctgagacaaagaaatggaatgactgtttgtaatattcagattctgccatgggaaaatggaaatatatacagttgtctacagtagtggtattttgattagaccaatatagctagcattttcaaagtggttataaggtgatggtcacaatgttatttacataccttcatgatagcatttaatcgctaaatctgcaggtcagctgttattaactctgaggaaataggcttaaggaaatttagtactcaatgtgacacagtgaagttggaaccaaagttcctctgactatgtagatctttattcttaatcacattatgctgactgggcagaggaagagttaataggaattaagagaggttggagagtagccatctccggaagccaatttaaggttgttttccatccaaaacaggaaacctatatagcaataacaacacaagttttatagaatatggcccaattaattacctcaatatgaaaatatggtcatatctctatagtgtgcttgttttcatttttcagttcctccctggtgttggacagtgaaagaataaggtattgactaatcatgatcagttcagaattttgctgtgatttttcaataggtgtttctcattatttggaaatgagcactcagtaaaagaccttgctgtgtcttgcatggtttgcctcattatgcttgtgggatgtgaatttaagaaaagtaagcttggattattttccccagcgattgaagcttaggttgtataggtatataattttaccatatcaaaatatttgataattaaaaccttataaagagaatgtaatgcatccctaaaagcccatttggaagggaagacacagtcaacaaccagcaacttattaactggggaaaaagtaccaaatgcacttgtgtatattttaagtgaaaagaagagaggactcggatgaccatgcttagttaagggggagggtgaccttttatatgcaagttgggaaatacagagaaagtgaaaggggaccaaaatgaaaacacatgaaataagataagcagagatgaaaggtggcactagaactgtaagaagcatttgaacaggcagaacagtgctggagactttaggagagggctcaagctgccatgtggccggtcctcaaatagttctagaatgactagcatatctttttacaaaactataagcaacttgagggcaaaaataaagtatatttatcttgcatcctgaagaataaacatggtgcttggcatttggtaggttttctttatgtgtatatatgaaaagcatattttcattttattagaagattgtggtaaaaattctattgaaaaccatgctataatgtagatagctagacttagttcggtggtttccaaactttttggttcaagtacccatttatgctcctaaaattgttactgacagtctaaaataacttaggtttatgtggattatgtctatcaatatttaccatataagaaattaaaactgagagattagaaaaccaataattaaaaacccattacatgttagcataaaacgtatttttgcaggaaataaaacccctacatttccaaaataaacaacaaacaaaaaaaatttaccgaggctttttttttaacatattttgcaaatcttcagtttctagcttattagaagactaaatttttgtacctcttctgcattcaatctcatattttgttttgtttgaatgtattaaaaaaactcaccccacacaaatatgtggttggaaaaaggaggtgtgttttatagacttttcaaataattgtgtatatccttcttttatactatgccaaaagtctacagattataatttcttaagagtttgaatcagaatctaaaactttatcagtgagcaatttatactctgttttgttaaaatagattggtgttttttgtagtttgggtggatcttttacctatgcatgatttggaaacatcatgtattggtcaattggaaaatatcaagttgctaagttatttagatgttccccacgttggcatatttcattatgtatcaaacaatcagatttttaatatcaaagtattttaagagttggaaagctgtcaagctcaggatggtggattaaattttttagtataccgtttttggcttaagagctcaaattttgtcattggcaacagacattgtcacttatttttcttgaggtgacaggcttactccttttctcattttaaacgttggtcatgaccacttgggaagagtttgtcttcagtgaatcagtcaagtaaaaatggcgtttcatgaaaagagtggctagttcagctcatatctcagtctcataagtgctttccttgagataaacaacccatcttattttgatatgcaacagaaatgctttatgtatactttccttcatcatacagaatattaaaatgacataacgattgtgattttaacaattaattttacatgtttatcaaagatattgtcaagtgaaactgcgttctatttactatgattgcatgtcagtgaaaagtaaaatgactgccagtaaaatttgttgcccctgccttagttcttgctaaaggaatcaacagttttaccaaccaagagtttcattgcaccatcagtggaaaaggtaagtagtgccttaatatgacgtggaaatggttttgacctcaaagaccccaggagggccctgagaaacactcactttgagtatccgtggtttggggcaggggaggttatagtgtacgataaagcaattatacttatatgtgaaaattattttggtatatatttctaagagtagaatttcttccatgcattagaacaagtggttttgtttaattggttcattaacagcttggataaattaaattgctattacagagaagaagataatttgtttttaattttcaaataaattgagtacaataatgcttcacagtgaatttcttaatagtgatcttgctcattgtcataactgtgtgcacatccttagacacaaatatggtttaagcaggtggcatacttttctccactgtcaaagtattaatatcatttctctgcttatatggttctttttcttttcttttccttctttttttttttttgttgagatgcgtcttgctttgtcacccaggctggagtgaaatggcgtgatctcagcttgctgcaacctccgcccccgcccccaacctgggttcaagtgattctggtgtctcagcctccctaatagctgaaataacaggcgtgtgccattatgcctggcaattttttttttttttttttgcatttttagtaaagacggggcttcaccacgttggccaggctggtctcaaactcctggcctcaaataattcttctgcctcgccctcccaaagtgctggaattacaggcatgagccaccgcacccagccagcttatagagttctttgtctgatttttgtactactatagttttatctcacaaagtaagcatatgggcaaaaacagcgtaagtgtgaatgtgttagacttttcagttactgagttaacatagcacctaattcacatgcaaatattatatatttattcctacccttggttaatagtcaatttaaaaaattgcaccttgggaaaaaaaaatcattgtttttacctagagagcagagatgagattattttattagaatttcttctaggattttctactgttgtattttccccttcatttttttatccaggtttccgttttggagaaaaaagcaacattgaagaatgaggtagagccctggaaaaaagtgtccttctaggtgtgttaagaatggttatagagattgatatcagataccatgagtgagcaaaatagtaaattctcataaaataatacatgagtataggtattgagctcttttaaataatatcaagtgatatagatgaaggaagaaaatgttaaaagggttttaaataagtctctttttcaatggtgtaagtatgagatttgtgaagccctttccagatgcatgtgtgtttgcttatgtttaaaaaatcacttgagtgcaaacatttaaacacattttataaaactggcgggccaggcacggtggctcatgcctgtaatcccagcactttgggaggccgaggcgggtggatcacgaggtcaggagtttgagaccagcctgaccaacatggtgaaaccccgtctctactgggggaaaaaaaaaattagccaggcgtggtggtgggtgcctgtagtcccagctactcaggaggctgaggcaggagaatcacttgaacccaggaggcggaggttgcaatgagccgagatcatgccattgtgctccggcctgggtgacaaagcgagactctttctcaaaaaaacaaaaacaaaaacaaacagacaaacaaacaaaactggcatggcattggacagtgacacataagaagctgatgtcatctttgccacttagagaaggcaaaatatcttgttagataacccctcttaaatgctctgcttggctagtactttttgggcttggtcagtgattagagtttaagttgtaaatggtattcataatttcttgtctctgtctcatcccaaacagattagaaaatctttgatttttgttggtaaggagctagcatcttattaatacaaagccttgtgcataaattatttccagtaattatttagtgcctaatgtggcatgctttgtgctgagtgctgaggataaaagaggaataaggtaagatctttatagtttagcagaggaggatgtgagtgggcagaaaaatgttatgagttctataataggaatatgtataggggaacttggttacagctcagcttaattgagaaagggtgtgaaatgaaaagaccaaacattctttgcagaacagctaaacagttggaattatatactcagatgagttaatgattataaatagccatcatttattatctctccagaactccagaaccaaggttataaaaaatgaatagttctttatttagttcagaagcatttgtgaagtatctatagcatctgtaacatggcaggccctaaggacgctggcatgaatagtgggccgtcatctactgggagagtcagtatagcgtgtacgtgcgttagaggtgaaatgcataaaggggcatccaacatggctggtggctggccatgtgaacaagacatttgcatttgccacagcataaagaaggatatttctgagtcatggagtattttattatgtttatttggccccaatatttccaaataaaaagaggcctttgcttttgtgctacaggcgtttcttatctttaggaagaatgggccgggcgcggtggctcacacctgtaatcccagcactttgggaggtcaaggcaggcggatcacaaggtcaggagttcgagacaagcctgaccaatatggtgaaaccccatctctactaaaaatacaaaaattagctgggcttggtggcacacgcgtgtagtcccagctactcaggaggcgaggcaggagaattgcttgaacctggtaggtggaggttacagtgagccaagatcgtgccattgcactccagcctgggtgacagagtgagactccatctaaaaaaaaaaaaaaaggcacggttttgaatctgcacactcaaaaatggccacagctttcccgctactttaagcactcataatagattaagcatgggtcagatctcaccactcattagctattgggtctgaccactaattatttagtggatctctagatcagttatgtaacatctctaaatcttactttcttctactgtaaattagagataaaaaaagtagccaactcctagtggttttgtgagcatttaatgaaatgatctatgtaaagtgctcagcatggtgcctgacatatggtggagacttgttatatgttagctattattattttctcttaaagtactttaataaactgcatataatttaatcctcagaataactccaaaattaggatttctcttatttcacaggtcaggtagaaatcttggcattctggcagggcttttcactaccaaccaagataacagcttgcttattcaaaccaggagctgcttttagtgttggtaatgatttcatagagagtgatgctatctttttttcattaaagtgggatgataaacattttcgtaccccctcaccatgtgcaaagcactgtgctaagtattttagaaataggaaacttgaaactgggatcatccttgtccttaagaagcttacactttattatgataaataagataaaaatttaagtaactatgcagtagaatatactgtatagttttgaaaagaaaaagtattacttgactttgtcttatttaagctttagatattctgaggggtaaaaaacacaagattgcagttgttagaaaagctgttttgagcatttttcccctactgttttccttagttttatttgcaagctggagcaggtattaaagatgaagtgttctggtgggagcggtagcccagagtgcttgaagcattgctaatttcaaaccttataatttagttaaattgaaacataactgcatttagatgaatgggctgctagttttccttcccaaagcaaacatgccaacctctcattacttcttgtctgtgctacggcttctgtgctattcagatctgctcgtttacacataattgacatgtaacagtgtcacagactttttattttgcagaaagaatttttaaaaaattaggaatgctttccatagcatgccgtatcaattattctacattttgaagtgagaatgacagagtgatccagaaacttggtgtttctgtggaaagcggtttgtacagtacttggctcatgcttttacagacctgggagtaagtgacacagtaggtctgattacaaatacagtttatcttcatttggaatccatgacttctattaaatttaattacttcccccgtggcttctattaaatttaattaattccccctgcagctggcatggtagaggtgctgctgctaaatgaaggtgattgctaattgagggagttttctgaaagaggttttaccctttctcttgtttatctggaaatcgcttatccagccagacatctgagaacattagtgagaagtgcaggttgcaaagtcataggtgagttcatcaccgttacttagagaatggtagattttttttttttctttttctcttggatctgattctgcagttaacatgccttttggtgagaggccagtgtaggattctaattgaagaaaactggcccagtcttaacctatacaagatggaacatgttaggtctatatacttggaattttctagcaaccctgtcgaggttaattgttgctcagtttcaaaaacaaaagaaaacaggtgaaagaattcagcatcaggagcagtttgttacccatccaatagccattatttggtggactccaccaatgacagtaagcagtcttattgttaatatggtttacctggtcatacagctataatgataatgtaaatatcactatacattcctaaggcaaaacaagaaaactcaaaacatttaaaaaaatcaaatatataattgccattgctttgcttctaaaagttggtcaaatattaggaagaaaaatgtatactgtaattagaactacatgcatttaatgcatttttattctcatcctttcatgtatatatgtaagtatatatatatacatatactttatatgtaagcatatatatactttatataaattacccagtctcagggaagttctttagagcagtgtgaaaagggactaatacaatagatgatgcctaaagctgaaaagtcacgaagcagctatataagcatattatacaaatatactttatatgtaagtgtatttatactttcatatatataaaagaaaggatgagaataaatgctattttatagtatttatataatatactattatatatagtatttatactattatatataaattatatatagtatttatactattatatataaattatatatatatatatatataaataaaatagtagagttgggggtcttgctattttgctcagctggtctccaactcctgggctcaagctttcctcccaccaaagtgctgggattacaggcatgagctaccgcacctggcccttttattctataatagaaaggagctctcatttttttgagcatcagtgtgtgccagaaattatatatatactctacacacatactttatatgtaagtatatttatggtattgtatataaatgtggaatatatgtacattaattttcctagcagtccaatgaactattttatacatgaagtgttgagactcaaattcttatcttttctctcaataatttcacctgctcatataaatggtgtgtgaaaatcctggctttgaaggaagatctgttgttctttgaatggacaataaatactcttttggcaacaagctccttaggaagctacttcccttttcttcataatttcatttctgttttttcttctacttttctggacattctgcttggctcaacctcggaagtcattatttcttacttaccatctataaactcattcattactctaaatttgttactccagtcctgacctctctttgagcctgttaaagaaaaccagagctgcacagtagttaaagcgataaaaaacagattttattcaggaactattgcaatagagggaaagagggctcagcatataactgggcttacttctgaatacagcatggacaagtggggatttatagccacagaagcagggttgggagtcagtgaatggaaaattactaagaggaaatctcagaggaaaaaggggattctggttaaacagacctaacagaattcttgctaaaggcaagccagggtggtgagatacatcacctggggatgggaatcgggggaatgaggaatttgatcagatgtataataggttggagggttctcactaaactgataagcaggattttgctaacattgggctattcacgtctggcattcttggggcctagttgagaaatgggcttagaagagcctgaataaattctggtctaggaaggctgggagtgctggctcacacctgtaatcctagcactttgggaagccgaggcaggtggatcacaaggtcaggagttcaagaccagcctggccaacatggtgaaaccctgtctctacaaaaagtacaaaaattagccaggtgtggtggcacgtgcctgtagtcccagctactcgtgagtctgaggcaggagaattgcttgaacctgggaggtggaggttgcagtgagccaagagcgtgccagtgcactccagcttgggcaacagtgtgagactccatctcaaaaacaaaagaaaaaaaaatctggtctaggagagtgtctctgtcaagccccggaaactttcactctttccatatctctatttgcttatttcccaggcatagcaaactgaaatcattacattcctgtacaaatatgtattttcttcctccaaccttccctgctggctttgactcagttagtgattaatatcagaaacctgggagtcataattccttctctgtctctgcctcaccttcaagtattaagctgtatttagtttaataacagatctttctactttattgcatttcaccccaacctcaccgttttagtctctgccacttggatgactatacttgctccctaatctagtgttccctcaaatccaggctccagacaacttgtacctttggattataatatgataattttacttttcttttcccactttgttcctcctcctctttcccctttcctctcttctttcctcctctatttttctagtctccgcatcccttattccctcctacttttcttcttctcaattcacttcctcacccctcttccctcatctccttcttacgtctccctcctccaggtacctggcagatagaatcataaagacttgtgtgtttcagtaatctgtgatgtggtgcttattactgatttagactgagcatatttaaagacggtgtactgataaccatgtgaaattccaagaaaattctgtttttcagaatgacctcagtgttcctgtctgctaccattttaaataattaatcttattgtttttggttttttttttgtgaagtgtactatgttatcatgttattttaacttgatttgtcagctttattttaagatggtaaccaattactaaagttctgaactttacagttctgatgaaagtacacatatgtttgcgcttcaccaatgctatacaaattcaaattccttttacaataaatcttagtttttcttctcaattagtcattaagtttcctgattattctttaactgatactgtattaatgtactggctatgttaattagagccatgaagatgcaggggtccatcggtgaatgaattagactttttcccttaaccctttatatgcctctatcctcagttgttctgctcaggatatagtagaggctgcatagtacagattgtactaccatttttgcacaagtttagtttgaagatacttttcgttatgtatgaagatgcacttttattctttggaagctcaccactgtgtgggagaaatgagataggtgtttggtagagtacaagtatacagggccagaaataattaggtatattttatgggcactggtggccagtttcctatataggagggcttatgggtggccatatagttgtaggtgggagggccatggacttgttttgaagctgcatttgataacatgcaaatgtttacctatttgaaaaatagtttacttgaggtgggtatggggtctaggaggaggttagatgttggacttagatccctagtcaatgctgatcccaccaccattgaaggaaaagaaggtggacagagataaaatgatgaaagagggagctgcaaaaggaggtaggcaatgaattgaaaaatgaggtgactgtggccccaaggctagaagaatttaacctgacagcgtgcagggaattcagggaggaaagtctacctgctttactccattccagaactatcttttgcatatttaaactttaaacaaatgtacaactctattcagaattttgtaaagaacattatgaagtattttgaagacatgtctagcagtattcatctttacttgtcttttctgatatttattcaaatatggagttaacacttgagatctgacttttgatgactcctagatcggtctgagtttggaagtcagagatctctggagatttagttttgattgttatttacatgttgggcttatagctactgagtgttggtgtccactgtggtctcttctgaaccatttttctaggctttcttttctgatggcttctctttagaatgatagtacagaccatttgtgctttcataatcttttgttattactgcaatagtgaccaaaaccagctgtctagctctctttcatgtgtaaaccattctgtatatatcgtcttaaattactaatcttttggttgactcttagaagtgaatccatcttgtgaatccttgtttgcggactgtgttatacttttgttagtttcatggaagatagatctgactcccaagcttatgtgtattagcttttttctacactatctagaggagagactagctggtcaagaatgaaaggccttaatgtaaggcctaggggagaggggacttgagggtgggccctggtccttgacatgaaaaccaatgctgtttgccaattgttttaattttctaatctttgttttttttttgattaataaaagagcacttcaaagacctttagacaaggctaaactatctctttgttgcttacttttgcccagtagaatgttctccccacaactgcctaaagtttccatttcacttcatgttttttcaaatagcaccgtttacagactaatttgggtgactgagtctccttagaaaacatggaatgcttttcagaggtttaagtggctacccaaaattcatagtgttggtaagatatgaaccatttacagaaaaggaaatataaacctttaagcagatttttaaaatgaggcttaataatccttataacaaagaaatgcaaattaaaatcataagaattgtcatttttttcacctctaagattgtcaaatattcagaaatttgatgtggctctatattagcatagattttggaaacagcaattcttatatgctgttgtttggtgtgtaagttggaacacacagtgtagggggtaatttagcagcatccatcaaatacagatggctgtatctaacaacaccttccctgggaatttattcaaaatgtctacgtacaagatattcaccgtggtattttttttttaatagcaaaagttgaaaagccactaaacgtccatcagcatggaactacttaaatcaattgtagtccatttatacagttgaatactctccagctgttaaaaaaattaaaataatgaggcagttctttctttatatactgatatggaaaggtcaaggcattttattaaagataaaaaataaaggtgtctgacagcacatatagtgtactaccttctattaaggagagaaatgacatatatttcttcttgattgtatatatacacacacgcatacagatatacatagaaattaaggatggattcacaagatactaatggcagcagttacttgcagaatgggaaaatttcactatattgcatttagtatgttaaaacaagtttttgaaacatacaaatatattttaaaaattagatttaaaaatcatactttagcatgagttaattgcattgtttcctttctaacactcatctgaaatcgggggaaagagttttgattgagaaagaaagaggatctaagcaattgcatagcattgaatccttagctgaggcaagctctcatccataacctaccatgaagacagtttggaacccttgagagataagaaattaagtagcaggagctttgcaagaaaatggaggtgaaaggatgccaaaggctaatttataccacagttgtctctgggtaaatatggggatttgttccagaacccccttgcccataccaaaatccatgtatactcaagtcctacagttggccccatgaaatccacatgtatgaacagttggccctctggatatgcaggttttgagtctcacaaatactgtattttctctctggtttggttgaaaaacaaatctacatatttggacctgtgcagttccagctctgttgttcaaggctcagtggtactttgaatattttctacaggcagctaactcaaagaaaaggaaaagatagggtgggatattcttctttcttgtctactcttctgcttctagtatgagtcagaatgtaaatcacaatcagaatgtgaatgtaaagtagtagcttggaattagcacatggttgaggtccattacagaccaaatatatttaattatttactctgggaaccattcagatgtttagaagtctatctatttgcaactgcattttcactttcagcagatgaattctcaaacttttggaagactaattaggggcagcatataattatcctcagggtcacagattgtcattcattgtaatcggtaggctttactccttggtgtttggactgtttttgtgatactttctctttaccccaaagcataggtttttgaattattaaaccatagcagaaatcatgaataaagcattttgaaggagattctattatctgaaacctactgtaattttttcatgcttgaattagttctatgtactaaggattattgtttcaaattacattagtgggaatagttttccatttttcttaatgaattattttattaaaaaatatattggccagactctgttcttgactgggtactcaatggtgaatcaaagtttctgcactcattgtattatttgtagtctttttggatacaggtgttatctaccgtgctcattcatagccccccaccccaccacttcagtaatttcattgtaaaatatgtgaagcaggaaggggaaggggaaatgcataactgttcaatcaattttgctcctaaatgtttgattcccatctaataaagaacttatgaccatttagtggaatcctgatcttctaagaaatttttccgtttttttaaaaacaattctttgatcactccaaagtactttctaagcaaatctcagtgtttccctggtattattccactgtttaatggaaagaacgttaagtttggagttctaattggaatactgatccatcactgaataattatatggtcattttttttttctctaaacttctgtttcaatgggaaagcaaaacttcttcccagagttgatgcaactattggaagtattttttgtgtaccaggagtactaggagctctctgtaaatgctgcccattatttggtgattaattcagaagcagctgatcagtaagagcttaagtagtggtactgtattcatcagtgtgttcaggtttcagtcttgcagcctgaactcctttgtctttaggcttttctcagcctaacttggcacctggggcagccctagttcactgtttgtatctttttgtaagttgatactccattgcatctgaggtgcacaacagctctttgattcaatccccaaatcaaaagaggtaagatgaaggcagatgaagagagctagaagtagttagttggacagaagtagagagatgaatgctgactggctcttctccatttcctgcctgtggcaagcagccagctgtttccttaattcaaaattctgtgtgccctggcagtgatagagtagattcttcttacagaattccctgctggcgattgccatttcaaagaagaaacttacagtagaattattatggtttagagtgttactgtgtgtataagagtaggtagaatgaagagccaagggttggcatccattcaaaagtggcacgcagaattttcatttattcctttactccttagcagaggtagagatgtcagtggaggtcacctacaggcaagactctctttgagaaacgtctgtgatgttaggtggtttgactgagcgaatcagccccaatgtatgcacagccgacccttgaacaacacgggcttgaactgcgtggggccgtttatatacccggatattttttcatccaaatggtgattgaaattacagtatcccgggatgggaaacccgtatatggggagaagcaacttttcggatgttcaggttcttcagggctgactgtgggactttagtatgcacggatttgggtataagctgggatcttgaaactgatctctcccgcctatgcgagggatgactgtgtcctgttaaccctgcccttctgggaatcgcgacagcttctggccgaaggtgggagctgtttcaattccacatattcacactcctcatagcccatttgctatgctatacctcggtacaccccctcatcagccctgcctatactgctattttgggtctgccttcattatttctctgcctgctactcatttagttttgtctcattctattctttctagcaagaacatctttattctacactctcctcctgccttgggtcagcttaattaccgcctaaataatcgctaaggctttggagtcgacctgtttgtttaaaaatgtatttaattatgtaatttatttttatttattgtggtaatgtcaccggaaaagggttcttgtcccagaccccaagagtgggttcttggatctctcatggaaaggaattcagggcgagtggcagagtatagtatagtgaaggtaacatagtttattagatactacttagttgcagagtagggtgtcctcagaatgcaagaggaggcacaccgccatttcaaatacaatgcttgcttatataaataggttttgatgtactcttttatgatggtttgtgattagcttgtggcaggctattaatattgttactttcttatattacgcttatctttaaagcaaaacctattctcaaactaagaatggtttttgttcttaaagtactagggcatttccataagttctgggtcttatacagttagttaacactattaacttagtccctcaaccatgaatatcttgtgaccaagagtgctgaaccccagggaaagtaacccagcagatttgactttttcccaccttcattcaagatggagtgactctggttaggatgcctctgatggtaggaatacttaaccatcataaattaaaaacacaagatttccctcttaaacaatttctaagtgcacaatacagtatcgctaactataggtgtaacgttgtacagcagatctctgggccttattcatcctgcgtaactgaggctttatatccattgaacagcaattcttgtttccccttctcttcataccctggcagccaccattctattttctgttcctatgagtttgactaatttagataactcaaagcaaaatcttatcagtcacagaaggacaaatactgcctaggttttaatccctttcctatccggtgatcttggcaagttacctggtactctgtgcctttgtttcctataaaatgggaggctaaaataaaaaatgcatgtgaagttctcagcatatcattttataaaaaaaaaaatcactcaacagtgattgttagcacttattatttagcgccactgcacctttttatttaagtcccataaataatctcaattgatgaaattagtgtcagtatatactgaaagcatggaaaagaaaagtcgttttagagaaagcagctttacaccaatttctaaagtaagcgacaatgtcaaaaattgtctttagaaactatatgtgtctctgaatattcctcctccgcaaaactttcaaatctgattttctttaagctccattaggtgaaatatattgtaaaagtttccttcagttggattattttacttgttagtatagttttaattgctattatggttaatttattattttccaatcttaatacaaatatttaaaactgtaatttaaaatgaaatttaaactatctaccagtcttttggggactatcttgagattttaaaacagtgctttggaaaaatgttggtcgagacccaaagagcaacaaattatctttttggattgaaaaaagggattgatttttttcatatcttttgttgctttacctgggactctcacaaagtgttaagaggtaaaattgttgctatatatatatatatatattttttttttcctctttctcattttggccagttgactgaataatttggtcaattagttgacttatttaattaaactacatcctgttataatgccaaaatgtttatttctagtatggtttatttgagaactcattttttattagaacacttttgatgactagaaagcacacaacaacttactttcattgtaatttttgagttggggcttttctgaaattttttgtctagcttcacccagggccaagctgttacagtcatgccttgctctcctgccctttattcatcatctctttgtgattcgtcccttaagagaagtctctaacagttctttgggttagcatttctctttcaagtaacagataacgaactgctttaagaccatacaccagaaagatagaaaactatcatttccttctcctttcatcagctgacccacattgttctgtgcgactcttggtctttgcccagcctcttcctcggtgctgtagtaaattcaaatttaaaccactggctagttatgttgagatgaattccatatcaagaaaaaagttttttttttaaattaaaaaagtaattccacattatttatgtcatcctcaaaagaccaactagtttaggggaagctgtttaattacacattcatttgacttacaattttagaccctgtcaggatgtccattgcaaactaagattttgaaaattataaagtttgaaattgttttaaaaaattgtagaacctatttgggagcatatccaacatagcattttcttgatttttgttataaagagagcacactggggaggctcacatgtgaggaatatctaagccagcctgcctgcctgcctgcctgcctgcctgcctgcctgcctgccttcctgcctgccttcctgccttccttccttccttccttccttccttccttccttccttccttccttccttccttccttcctgccttcctgccttcctgtcttacttccttcttgccttcctttctatgcctgcctgcctgcctgcctgcctgcctgcctgcctgcaaccttgacctcctaggctcaagtgatcctcctacctcagcctcctgagtggtggggactacacgtgtgtaccaccatgctcaacttttttttttcttatttttttgtagagacagattcttgctattttgccaaggctggtgttgaactcctggcctcaagtgatcctcccaccttggcctttcaaagtgctggcataagccactgtacccagctaaattcctttcctgaagtgaaatagctctatttattcaagtttattctggaatggaccagcataaaaaagattccagtactttaattttgatgcttagttttttttaactaattatatttattgagttctttgagtgccggacacactccacatttgtgctctcatttaacacttcagcagtaatatatgaggtgaattctatgactgagtaagtaaactgaaatttcaggagggtaagcagtttgttccaagtcatatggctatttagtgttgggatctgctctgccattgttcacagctatattcaattgccccgggtgttgtgtatctttccaaaaacgttgaaagggaggttcagaagtattcagttatttgtattattagtcgttttgaaactgagtagaaagactcatttaggaaagttccatatgccttcttgtctgtctatggctggtttgctcaggagaaaagtccacaattatacaattgtactcagagatcatgttatttgtatatctacctgcctcatcggagaggttgtgaatcgtcccagagacaagataatctttttgtttgcattcacctgggctattttggaggctagtttgtcatcttcctgcaggagtaattttatccatgtagttcctagactgttgtctaaatggaatcaagatgggtttgtcagccaccgttgcctaatggtgattttaggataaattatcttatctcgtattagcctaagaaatctctgacttgggatttggggtgatttaatacaaaatcattcaaagatttctttctgtcttttctttatggcttttggactgtgtacttatgactttctctgctgtgctcaagtatcttcttagtatctgtaagtaaaagttacttataaatgtctgtaaaaaaaaaaaaaaaacagtgttagaggctgggcatggtagctcacccctgtaatcccagcaccttgggaggccgaggcaggaggattgtttgagctcagggattcaagaccagcctgggcaacatggcgaaaccctgtctctatcaaaaatacaaaaaattaacctggtgtgatggtgtgcacctgtgatcccagctacttgggtggctgaggtgggagtatcacttgagcctgggaggcagaggttgcaatgagctgaaatctgagattgagccactgcagtatagccttggagacagagcaaaaccctgcctcaaaaacaaacaaacaaacaaacaaaatacaaaaaaaaaactattagaaatgccctggaataaaaagaatgaaatccggtcatttgcaacagcagggatggacgtggagttcactatggtaagtgaaatatgccaggcacagaaagacaatatcacatgttctcattcacatgtgggagtttcaaaagttgatctcatggaagtagagagtagaatgataattaccagaggctgggaagggtgtgtgtgggttgcggggtggaaagcggggatgaagaggggttggttgatggatacaaacatacagttagatagaaggaatacgttctcgtgtttgatagcacagtagggtgactatagttaacaatatgttgtatatttcaaaataggtagaagaattgaaatcttcgtagcacaaataaatgataaatatttgagtaaatatcctaaatactttgatttgatcaatacatattgtatacatgaatctaaatatcacatgtaccacataactatgtacaaaccttatgtattgatacaaatagttaaagggaattgaataataaagaataaaggataaaatatttaaactaatattaaaatcagggtaaaataaactatagctgcaaaatcataagacagttaagtgaatatacctggattaaggaaataaaatttaaaataatgaaaataccgaataaaaattaataataaaaatgtaaaaataaaattgaataaactacattgagttagggtgtgtgtgtgtgtgtgtgtgtgtgtgtttgtgaacacaacatacctgtatggtaggggtaacattggtttagattcactttgtacttcatacctgtgttcaaaagactcagctgagccctttgtgaggatattttgactttgaaaatctggaattgatgactcacttaaaatagttttatcttgggactgaaacagggacataggcatatttttgtatgattcacatcagagctgataatcttaatggtttgtaaagggcctaaatgattctacagttttatataaagcatgttaaactatcaaggctcattattacataactataaatggacagagttttataataagaaaaatgtacatttgtttagccattgtctcctaggaacttctctctattattacactattgcatttgcaaaggcaccaaaggtgcagtttggtttatatactgcagtagtaattcctaaaagatttaattgtatcaggttttttaacttaaaaatggaatcctatttaaagtatatccaaatattcgtacaataagaagttatcacagtctacctattttgtaaatgaggtgcagtgtttagttttcattggggtttttgattttctgttttgagcatttaaaacaaaatcctttgaaaatagtagttggtgatcacaatggtttatgacaattttaacaaattgtattagaagactctaaggagctgtattttcaaccgtgctttttctcttccttccttcctttctcttccctcactttttttcttcctcttccttccttccttccttcctttttgcattggggtaagaacataaataatattacatctttccactatgtctaaaaaagttggaggtggagaacagtatattttccatgaaaatgtcagcctgccacatagctctgcttagtaggcaaaccgttattcatttggattctctcttggctttacatttggaaacagttttagtgttaggtacttatgattgaaaaggagatctcatgttgagcttttattgcgttggatgcgcttaaaggaggttttgtaaaagaccattgcttcattaagaaaggaagaaagaaaaacaaacaattacatccagggaaatgctaggatttttgatagtttaacatgaccatgtcttgagcattttcagttcataatgaggcttgccctaactaaaatggcatttcatttcggttgatgtactcttgacattattggtgacatctgctaaattctaaaccatatttttttttaaattgatttcattcctacatcatcagctatgaccaccagttgagctggagagattggaatctggtgttttatttattaaaaaagacattttcagactgcttagctcacaaagatattttgtattctttttcaaaatatattttatttatcatggatgcttgtgttttaaggctgcatatttatttaaaatttatgaagaaccctggaaaacattcccaacacaatacaaagtccacacatttgcacaataattaagaatatttggccgagcacgatggctcatgcttgtaattccagcactttaggaagccgaggtgggcggatcacttgaggtctggagttagagaccagactggccaacatggtgaaacccgtctctactaaaaatacaaaaattagccgggcatggtggtgggtgcctgtaatcccagctactcggaaggctgaggcaggacaactgcctgaacttgagaggtagaggttgcagtgagccgagatcacaccattgcactccagcctgggtgacgcagcaagactccatctcaaaaaaaaaaaaaaaagaaaaaaattaaaaatcacacgttgactaataaagatttctttaaatgtttgtgtgtgggatgtgcttgttctttttggaagacactaggtatgttcacgtctccaggtttctccccgggggtgtgtggtgccagttcagaatctagcacacagtagacttcctaatccaaattttcctgaattaatgtctaatttttcctaatgtggcttgttttttgctatgaccaattcctgcttatatttcaacgtcaaaccttaaagtcacccttttgtgacttttcttgtttattattttttaaagcagaattaaatttttgtatgtgtgttttatacactctcatgcaagtgcataagctgcttcactagttatcatgtcctctctgtcttttctgctattattaaaggtaggtaatatattttagtctcattgcatcattagtacttagtatactctctgatatagaatgaacacttgataaattcttgttcaatcaagtaaagtcaaagacttcaaaagatgacttgggaggacaactagcatatatcgattttgtaaaatatgttaatatcttcattagttactttagaattcaatgcccatataatcttttaaataatcttgggagaaaggagacattatttctatttacagtcgaggaaactacggagttaaaagtacagaattaaactttctccctatctgtctcctgtcaaagctgtattaagctgcttcctgagagtttgaatttccatggttttagagccgtttctttcttaactcattgctaagtgacttggtggagtacaattttcaagactaagtttcttcccttaaattcctcatattgtataaacatactcattcaatactcatccatcaaggtgattctattattcccacagggaaccttttcatcatcacaattccatgtaaaatctcttacaaactactgaaattttcattctgatcttttataaataaaatttcatacctaataagtgaattcaaaaatgataaaatgcctatagtttaaaattaactttatattgcattgatgattatacaaatatatctcattatggttgatgttctctgtctatttgatcttttttgtaagtctctcaaggtagaaattatctaattaataatgcacacctcactgaattgagtaagtttacattctgagtcactaaggcaaacttctagaagagcctctaggattttcttttttaaacagaaatgcccctttaaaacatttctctgctctcatgtcttgccactggaatgcaatggaatgcattgtaaaaagatatatattttatagattagatgttggtgaagtttttagttgtcagattttactttgctataactttggaattggaactattacctttgttttattgcagtctaattagtaggacgggatgaggaagtatgaatctttatttttatcaaaaagccaagaaggtttttgtattggccattagctcagttgcttggaataatgtattagtcacctggaggtcataggcttatcacctggtggatgatagctttagtcctttctggagcacatctttgacatagcccctgtcagctctgtcaccagggaggcagggcaaggctataatggtggaagtacacattaattatctactttgaaaaagcaacttgaagtttagacttcgtgaccatagaattctaagaatttcgagttggaaggtaccttacggtcatgtgttcctgtccctccttttaaggatgatgaaattgacacacacataagctaagtgacttcccctagtttactagtagcatcacttggatttaaggccttacattttcttaacaaatgtgcagatacttcttgatttatgaagggattacatcccgataaacctatcataaatgaaaaaatattctaagtagaaatacttttaatacacctaacctaatgaaaattacaacctagcttattccaccttaaatatgttcagaacatttacattagcctacagttgggcaaagtcatctgacacaaggcctatttataataaagtgttgaatatctcatgcaatgtattgaatactgtattgaaagtgaaaaacaggatggctgtatgggtactctaaggacagttaatactgaatgtatatgacctttgcaccattgttaagtagaaaaattgcaagtcaatccatcataggttggggaccccatcggtactttagtcaggataggtcattgaaattcattctgagtattcatttgtttgtaggttagttaacttgttgatgtaatttgtacttgctgttagtttgtctggaatgactatttaccacagatcttcacattgacatatttcttccagtcatcctagttcctcctcagggaggtatcccctctagcactctgtatgacgttcctagatctaactgccattgcttgtggaacgtagactccatgaacatctcgttgtctttactgatctcagtatgcttagaacagtgtctacatttaatatatatttactgaacagttgaaagaatagataacgataggctttagaccttagtagtctactaatgatgtgcatctttagattgctataattgctttctcctaagctggagtacgatgcttagcgatggaagtcctactataattctgagcagctaattcttcagttgaagaatggactcggtcttatcgctgagtgagtaactccattgaattcttaggaagcagatttgtcatttcacagtgtccacagattctcatatgatttctcatttcactgtacatggaaaggatgatgccaaactttttttttcttttttttcgagacggagtctctctctgtcaccaggctggagtgcagtggcgtgatctcggctcactgcaatctccgcctcccgggttcaagtgattcccctgcctcagcctcccaagtagctgggaccacaggcacccaccaccatgcccggctaattttttgtgttttttagtagagacgaggttttaccctgttggccaggatgctctcgatctcctgacctcatgatctgcccgcctcagcctcccatagtgctgggattgcaggcgtgagccaccgcacctggcccaaacattttgttttatattgtcttgctagctgatggtcgtggttgatcctggctgtgtggaggctatgtggagggagggcttcaggagaagggactacttctggtgtggcagtcatccaggaattgaagacgatatctagctttactttggggaatacagaagtaatagattcattaaatgtatttaatgaatggattaattgaatcataaaaaagtaaaaatcatgttcatatgttacattgtctttctccaggaggacatacttcatttgtctgggaaggagcacagacattattgctttctgatattgtggcatatcttctgattgtcagcaatggcacaaagaagtgtgcttattgatagggttgataggagtggctcttcagccatgaatgtaactgcacagtagttcctgtgtacctaaatagaaggcaggcaagggagtggtgtggcttagagtttgggctctggagtcagactgcctggattgaaatcttggaactgtcattactggctgtgtgaacttggctaaattacataacacctcttaaagtattcttatttgtggagtcaataatagtgctttctttaaagaattgtgagggttaagagagagaatgcacacaaagcacataagcactctctggcgcatagagtggcactgagtgttagctattactattattaatgaatcaatgctagctccacacctttaacatgtgcctgttcagtactaatggcacgttagaacacatgatggggaactacattaaaggaagatcataatctttaaacttattcatgtgttatgttttgaaaagagaacttatgcctcaccagttgcagtgttggctgtgtggaagattccattatcaaaagactgaaattgaggagtaccaggaaaagtcaaggccctgaaatcttaagtcttaccagtttatttaacaagtgttccttggtagtttttacttgcagtaggaacattatatatttaatttcaggcaaatcaagaaaaaaaactttgtaagtcgaccttatgtagagacaaatgtttttgtttcacttttcccgccaaaacatgggttatagaaaagccattttaattacaaatgacaagataagtgaccagatgttcagtaaaatgttagaactacaaagtttttctttgaaaatgttacatcttgttcctacatgattttaaagattttaaatatttcattcattgttttcaaagcaaagagcatttgaaggagcttggtctgtgaaggggtcctgagagagttagaagaagttataaggattaagctatatttgaatttttctgttgggtgctgagaagaatacaatgataaggtccagatgatgcttccaaagggattataaggattgaataaaatactgtaaaaatagctttcatagaaaagtagaaagtgttagataatgaaagaaaaatagaaacagtgttctctgggagatattacttgcagctagagacctcaaggggagctttaaaaatgaactgatatttgaactaggcctagaaaaaaagtgaagttgataaatactaatacgcattggaggcacataagggaaaggcatcctcaacaaagtgacttgaatgtgcaaggactagaaatcagaggaataattatgggaagaaatcagaagaataaatatgggaagcagaaagtcatagtttatttcaccaagaatactagtcccaagagataacatgcacacagaggtttctatggtgaaattagttttggaaacattgggtactatatctgcctcctggaaatttttcaaacattacatattaaagattctgagcagtcttgtagtaaaaaaagtatttaatgttatttatgctagtttatttaattatgaaaccctctttttaagcaaaatacatagaaatgctatgaaacaattttttgccgatgcttattgggaaatgtaagcctgtaaaagtagatggagtcaaggtggtagagtgcctgaacgtcagagtgaagagtcagtgggtggatccatggaagctttctcatgaaagcttcccagataagtggatgagccatgatctggagactgtatgtgagatgggatggatcagagacctggaggagatttgtagggatgcatccaatagtaagtcttttttagcagactaagcctgaggtaatgttggtctaacctgggatagttgtggtagttgtagaagaaaagttatgaaaggaaaggagtagatggaattggggactattattctaagtgaagtaactcaggaatggaaaacaaaacatcatatgttctgattcatatgtgggagctaagctattaggatgcaaaggcataagaatgatacattagcctttggggactcggggaaaagggtgaggggttgtgagggataaaagactacacattggggccaggcacaccggctcacccctgtaatcccagcactttgggaggctgaggcaggcggatcaccaggtcaggagatcgagaccatcctggctaacatggtgaaaccccaactctactaaaaatacaaataattagctgggcatggtgacacatgcctatagtcccagctactcaggaggcagagacaggagaatcacttgaacccgggaggcggaggttgcagtgagccgagatcacgccactgcactccagcctggtaacagagcgagactccgtctcaaaaaaaaaaaaaaaaagactacacattgggtacagtgtacactgcttaggtgatggctgcaccaaaatctcaaaaatcaccgctaaagaacttattcatgtaatcaaacaccacctattccccaaaaacctattgaaataaaaaaaaaagaaaaaaaggaaaggaaaggaatatagctggcagttctttgatgttagttgtatgtggctgatacatggtttttagattcttaaatgtatttttttcacattttaacatatctaaaatcaggaagattttagcattagtgacagcatccttcattcttaacggtgcatgaagtcagatttactgaaatactgttgttaaggatgtttttgaggtaaagcaatacagtagcctgagagtgacttggggcttagcagtttctaacagtaagctcttcccttttctggaagagaagtgacactagaagagtatcctccagcctttgggccgaaggagatgctgatttggatcagagaaaaagggtgaatgaacatcagagccagaattccctcatgacttctgctgttcttcataggctttttgacctgtcagtaaaggagaaggaatccttctgaacttccacatcgcacttatttacttactagtctgattttatacgactgagaatagtgtaatttcaagcaaaatcttacttccttgagagatgtgggcttcagccttcatcttccagatattaacttgaccagatgagcaagcctgaacttcctgtctcaaaatgacttttccgcagccactattctttctctgcactatatctttatctgtagctgtaaaaattaacctttaaaacttttatttatttattaatgttttaagagacagggtctcactctatcacccagtctggagcgtagtgttgtgattataactcactgcagccttgaactccagggctcaagtgatcctcccacctcagcctcccaagtaactgggactacaggcacctgccagcatgcctggctaattttttttttttttttttactttttgtagggactaggtgtctctctgtgctgaccaggctgatcttgactcctggcctcaagcaatcctcctgcctttgtctcccaaagtgctgggattacaggtgtaagccaccacacccagccataataaacctttttttgcaccacatattatttgctatagttctcttaagagtcaattaatccatgttattttttattttttatgtactgtattttatttatttcttttctgagacagactcttgctctgtcacccaggctggagtgcagtggcgtgatcttggctcactgcagcctctgcctcctatgttcaagtgattctcctgcctcagcctcccgtgtagctgggattacaggcatgtaccacccctcctggctaagtattgtatttttagtagagatggggtttcactatcttggtcaggttggtcttgaactcctgacctcatgatccacccgcctctgcctcccaaagtgtgggactacaggtgtgagccactgcacctggccaatctatgttacttttgaaaaaagttcaaataaattgaaataagtctttactattatacattatgttcttatggtctaaagaactcaagaaatagttttaaaatcgagaacacacaaacacactcacactcacacatagaacctaaaacaaaactccccaaaacaaatatagattcaacaaaatactataaaaagccataaagcatattcagtatataatttttaaattgttctgacatatatgttgtttgtatacccgcacaaatgttactgtcattaaactaatgatcctattttcttcttctcaaaaaaagtcctagaaatctgtttgtgatggcttgatgaagtttagtcactttataaaaggttaagcttttaaaaacttttccttttttatttttagattgctaatgtggctaggtcatgagaagactctgaaaatagttttccttcattgctaatcgcagctgttgcattactaaccaatggtcagatcctgcattaagaacaagagactaaaattacaaatagtttcttctttttaaatcagagatgctggacttcccaaatttttgtcaggcagatatattcatgtgattttaggtgcttagaaaaagtttattcatggaaagagtttataattgctagagatagctgaacctattttaagatgactgtatgcccattttgagtttgaaccacatagactagggaatgaagaggagtcattttgaaaattttagcgttagctcagtatgtaccagtaactgaccaggttattatattagacatttcaacctcttcttcttttttttaatatttctaaacatcagaaatgctcaggttttttttttttttttttttttttttttgcgtccgtgaaatgttaaaaactattttgagttctttgggaaaaaagtgttctcccatgctgtaacaaatggaaccaataatgtgaaccttttgattacaaacaaagatcagactatttggaagggaaaaaaagaatatattggaaagtacatgggaatctaatgaagtccaaagatgaagtgaataataaacaagaagccatggagagctcaggaatgcagtctgacctctggaacaactagaaatgtgacacagaccccaatgatatcttcatctcacttacctatttctctttgtgtgttggctttttttcttctttttctccatgcagtagtatgaccattgagtttcctagtgattcagctttcacagtagttatatttgttgggagaaggtgggggagagtgagtttttactaattaaagataatgaaatcaatttacatatacccatgcatgtgcacacatgcagaaactaaaatattaaattcattccggaaataacaacaaaaataacatgctaaaaatgtgtgcatgaggaaaaataatgcatcatgaaaaattaaacataacctttcaacaacacactttgaaaatgcacaacacaaaaatacagttgtaggcagagggatctccctgaagaaatacaaagcagctctgttggctcctggttgctggccaggcctcttaggtggatgagcctttgtatgttgtttagcaatgtgtgtttcttatttgaatgggcctagcctcatgaatcatgaattgttagttcataagagtaaggtgttcttataagccaaaccaaaacattaacgaaacccaaatgctttttacaccagaaggattttaagaacacaattttagcttcttttagattgattgcggagcttgaagaaatattatttcatgataattccatcatttataatcaactcctctctgctgtttgtatgctgatccttgtaattctgggtaaaagagaacagcagtacattttgggtatattgtgtaaggtgggaagtggagaggtgttctcttgtgtagttactgagtccttccttcctgaaatgaatcgtaattctggaaaagtgaatacttgtgaagagtcgtcttgaatgatttgtaaaaaatcctgttcttatattcaacgagtttcgaatctttgtcagaggagtattaccattagattgaaaaaaaggaaaataaataatacacacttttaaaaaaactccccattctcttattctcacttttaggaaaagagactgactaatatcttctgccacaaataccgatgttcttaaaaatatttatgggactgcttttggcaaccagccctattttgttttcatatccctttttgctcccatctttccaaactcataaactcccaaattatattttccagttttattccacaaggtaagatttattttcccctaaaactttattgctttataattttaagataaaatattctaatacatttctttaccagttgatgtactaaaaatacagtgaatttttacttgtttataaatgacattaggaaaaatatatctgtcagatttgatcaatgttgattttaaacaacaatatggaaaagaatgattgtgttttttataagcaactagaagctaatgtaggaaagatgatattgatatttaagacatgctggcaaacaataacatataaatatcaagtaggctattttacctgggcacagaaggtctcttccaaataccaaaattgaatttcgtcattttatccagagttgaaattgattatactgagaataaccacttaatttctatctttatctgccactgttttttggttcaaatctaagctacatgttacactgttctccagatacactgtgtggctttttgtctatactgtccccaccactagaatgtccttcttcagctttagtttacaaaatctttcgtgatttattcttaatgctgtcattttcgtaagttcttcctgactgtaaatggcaaatgtaaaattcctgctgctctctaaatgctcacatcactttgcttgtactttctgttgtattaataattaccaccagttgcttgggttgtcattatttgtttctatgcccgggcttctccagggagctctaagcattctgagggcaatggcaaagtctcattcatcaaagcatgttccatatacctaaagtaaggtctaggatttagtgggtagtaattaaacatttattgattaaaaaccaacagttgattcacagattaaagaaggaaaaatagatattttagttttctgcttacaagaatttcaggcaaaattgtgcaaataattcagtttaccgccttgtgtttattttattgattaatttccctatgcatagaaaaaaggatcattccaagaattttaacctcattgagacaatttatattttttctttcaatttgattcagttatttgggatgactatttttctcgacacactatcgacaaagacaatgttccattcctttttggggaagaacaggtagctacattttaagcaaagtgcaaggtaggctgaatacactcgaaaaaagtttggaaatgtagtgatataaactcacaatatagtagatcttatacacattcagtgttacgcatgattattcgtttgctaggtgctaattgggctttagtactagacagctattatgaaggatttcctacctaactaaaccaacaccatgatcttccccaagaagaaagagttgatcttgggaagtttggaagcacagcttttggatcctttgttaccttcctttttggagggaagactttagaggaacagatactcttctcgctattattgcttaacagtttttttgttgggaacataaagagcatatgatcctcttcaaccccagaatcggtcttgccctggctccacaacactggcaatgagaggttcccagaacagcaagattattggaaatttaagttttaaacaggttctcagattggtttcctattgaatttccattctctgtcttttctttttttctttttctttttttttttttgagacggagtctcgctctgtcgcccaggctggagtggtgcagtggcgcaatctctgctcactgcaagctccgcctcccgggttaacgccattctcctgcctcagcctcagctgggactacaggtgcccgccaccatgcccggctaatttttttttgtatttttagtagagacggggtttcaccgtgttagccaggacggtctcgatctcctgacgtcgtgatccgcccgccttggtgtcccaaagtgctgggattacaggcgtgagccaccgcgcccggccgcattctctgtcttttcactttctaatatttaaaagaggcagctcaaggccacacttacccccttttagtgtccattttaatctttccgtggtctgtagtgcacagatttagtagactccaatatttcaaataatggccccatgccccaagtgttttccttacagctctgtagacatcatgtggtaaaacaaaaacattaaaagcattcagaaaccaaacaaaacagaatagctttggtgttaccatttatacttcatttgaattactggatactagttctttgtagacatttggaggtttctccgtaaagtcctgataagaattttcagaaaaggaaggcatagctcttaggtgactgagtatattggggagtagtgtggattggtgacacaatagagtgctttacagagctagaggggatcattacagtgaagtatttctgagcaaggataggcatcaaaaatagggatggaaaaaaagaatgatatagacaagaaggtggttgagataatgtcagagacaccctaagcaacacttaaaatttggcagaggtgtgattttttcctcagtttcccccttgctgcttttagtagtgttctggtgctgaggaggaggctcaggatctggatacggtggacatatgcttatggtagatgctttaggacagtggttcacaacctttctggcaccaggaactggtttcatggaagacaatttttccccagatgagggtgagggattggggggctggtatggggaggacaccgttccacctcaggtcatcaggcattagttagattctcataaggagcttgcaacctagatccctcacatgtgcacttcataatagggttcacacttctatcagaatctaatgcctcagctgatctgacacacgaggcagagctcaggcagtatgctcattcagccagtgctcacctcctgctgtgcagccgggttcctaacaagccacagacatgtaccagtccatgacctgggggttagggacccctgctttaggacatgcagaacaagtttgtaatgaggactgcgacctctaggtcaagccacatttttcctaaaggtaacattttatttggagtatttggaattttgaggagtgcgagggtggggatggtttgaaggaactgtgattatgttaaaaattaacacctaatggattttagatggttagacctttgtaataaatggaattcataaagcctagcattggcaaaaatacatatcaattttttttgacgagatacagtgtctaatagaatgttagcgtccatctttgcatctaaaataatttaaaaacaaataaattcacttgcacctaggcatttttactttctctttcatctctctgtatatgggtgggaagtaatgtgatacattgcccagaatgtgaagagtgtgagaggaacacacacaaagtggttgccaagaatgtgtctgggaattagacacgaaaaggaccacgttcctttttcttctcataccacgtaagattccctgtggaattctgcttgttcctcagggaggaaaagcaaaccatgagttcctggcaatattattggctatgagaaagttaaggaagagatactgagtgacaaaaataccatgatgatcgaacaaattttcttgttattaagcaaatcaaaatggaaggcccacctttattggctaattattatatgttagtgaagtcagaatgatttataatagtgatagacccagaaagaacctttaatgatatgcaaacacattagttttcttgtattaaagtgatctgtacctgttgacattattaaatgactcccatgctttccattctaacatgattgcttttgaatttgcattattaaccattatagtttttctatgtacaaatggtgtataaacttctctttggaggtgctgatatttaatggcctattcttgggaaaggttgcagggagaatattatgatccatagggcaattttgaaattacaattagtactctgttgtcttcctaggcatgactttcatagtggcttatcttgtcctggtattttaacttcttggctctcttattcctcacacataccgtgtatctttaatacttgaccacttgttaaaactaatgagattgttttgaaaacgtaaatgttagctcaagaaaaaaaaggaattactttccaaggcacgtcagagtactatataaaaaaaggggaaaatacagactttagataaaatgtcctactttacagtatatatatatacacataaaattatatagataattatctgagataactataattatatagtgatattacctatataattataattttataattattatatctatataattttattatatataattattatatccataaaattatgtgtatagcacaacaccaacagtagatctggttttaaacctgagttagtttagctcttcaccgactcttacccagactattgctatcacatcttcaaattttgtttttgtctctgtggatggccttctgcaatctatcctgtatactattgttaatgtgttaaaacacagatctcactgatgtacctcattacaaggcaatacaggatactcagcatggaataaaagccagttgttattgagtgttgtttgcctctccagttcttttttttttttttttttaagatggagtctggctctttcacccaagctggactgcagtggcgtgatctcggctcactgcaagctctgactcccgggttcacgccattctcctgcctcagccctcccgagtagctgggactacaggcgccagccaccacacccggctaattttttttttttgtatttttagtagagactgggtttcaccgtgttagccaggatggtctcgatctcctgacctcgtgatccgcctgcctccgcctcccaaagtgctgggattacaggtgtgagccaccgtgcccggccacctctccagttcttatcttagtattccaccttcaacttgatcctgcccatcaacaaagttaatgctgcattaatcgttaatcatgctgcttttgtactttttttgtgtgtgtggtggtcgtcattcttgttgcaaaaattagttaatatgtcagatcttctgtgaagtcttttttgaccatccacccaagtataagtacttattaaccatgtatcctattgctgcctgtacacatggcatatatttctcatactgtaattatgtacttatatttctgtagtcctgtttaggacaggcacttttcatctctgtattccccagattgagtgtagtactgatacttcactacatgtttattgaattaaattctttactgttaactaggtttagtgagctctgatgtcacctacaaatatattatcagccccaaacatttaatctcaaccatcaaaaatttagcacaaccaccatttttatcgtatatataggaatggaatttttttttaaattttcagttattttgaatagtaatttatttaagccttcctatgtgtcatggaccctgctggtttcaaacagattactgtgattgagtgaataaacatcaagaatcttttatagagggatttaatattattgtaatcataacgctggttggattagggtttgtttatcatgccattatcttcaacaaggctcatctgctgcctcttggattcagatgctgctcagtggctccagcctgttctctctgaagagaggagaacttaacaaatggacattatcctcaagagtcatctctgccagagggctttgtggaagtgatttgtgagaataattttttttttttttttctcactgcatatctcaaatggcatgtttttcaccactgaaaataggaagacagttcttttgtgtttattaaaaataatagctaacttattcattaaaagaaaaagcattcttaattgtggcaatggttttgtggctttggacattaagaacaagttaaatttttatatgattcctcatccagatttttctcaagattaaaaactaagattcctagagaaaaacatttttttctttcaattttcacatagaattcttgccgttggagaattctgagatcgttgggaggaactttgtacagtgatctgtagacaatagctcttgactgtctgtgttttctgccaggttgtgtgtgattttgtaatacttccctagtctaggccgtatgcttctgaagagtccctgccatttcttcattccgcgatgtcattaagacccctgttgcttttatttgaaaagtatacaagctttggaatcggataacatgtttcagttcaccaattaatagctgtctgaccttggccaaatcaatgaactgttctttaaagcagttttctgaggtgtaaaatgagaactttttcattgaccttgtttgtaaatattaaatgaaattgaatgtttatagtaaataaaatgttaacattttatatcaagtgaaaaaatggaaattaatattcataaatattaaataatataaaacttaaacacttgtaaatattaagtgaaagtaccacctacagtctgaacacataatatgtgacttaataaaaccgtttaggttactttatgaagcaagcatttggtttcacatattctgtgtaccacacttagtaaagcttagcaatggcatcgttacattagatcaactggacagaacaataaaagaacaaatctcctccagaagataaggttttacaaataagtagtggcaaggcaatccaacttctcacctatttgattcattttttaaaaatttaggtgaatgatatacaatagctgctctctttaaatttttttcactctgaggttatttcagttgtgcatactaccaaaaaatatttaaaaaatcaaatcggctgacagaggcaacttgaataattaaacattgcagggtggtgtgcaacagggaaagaactgccgcactaggaagaaggggtcccgcgatggagacgctcatcatttactatgagtctgagaaactcagttaaccttagagaatctggggtgtgaaaggaggctatgatacctttcctacctggagatagggagctgattcaggtaaaatcttgacattccttcaggttctgaaactctaatactaggagttggagaaaatgtggactttttctgtgagtatctatttactattataagtatatttaggatgaataggattgtgccttagagtttggggagtatcacagggaatttgttgctctactcagtccttcttaagggctgaatgaatctacttttatttttctcccagttgtgacccatgagctatcagaatcccagtactatagtttctcttttcttttagtgatttattaactactgttagtctttttttaatagggttattaaggtcaattaaatagtaaggaaagagaaaacttaagtagacattggtttgagtaagaaaaaggcaacagaaataaaaccatgttttgaaaagttgggtcagtataggaaggtaatccttataaagtgatcattctaggtaggcatcacatttatacacccgtggacttcttactaaactgacctagattgtggtgacctgtgcttaaatgattcttaaagtcattctcaattccgatttccagtggttatgttacattcaatagggtgtagcctttggaaagatctaatttctcaaatgtgccgtgccattccatctgaatagtccagtgatttcaaagacaccacggaggaataccattgatatcacagaagtcctgtcctttcttaagatgaagagtatgaaaaatatccaagcagatgcagagaggccatctgtcttgagactctagaggacattcctatactgggtggagaattgtactaagtgggcttgggagtctttcgcaactcctcacatttgatttttttttttcattttaaataaatgatcatttagaataagtagagctctgcgttttccttgaaaagtaggatggaattcatgaaagggaccagcgaatgttctcttatgccctggtctgtgcagtactctatgcagacagacacttgacagatacccttgatatttcctttctcttcctttgtgggattgctttgaactctgtaggagacagtttagaatataattgccttgtcctgctttagggatatgtaggcgggcttaaatacagatattctcaaatagctggttctagtaaactaaatgcccttcctgaggaaatatatgggttgtagatgctgaaataaactaggttaaaaatatttattacacaaaagagatgctaactgaaagaggcacacatccttgttctcccaacagtttctcacttgtaaatggcatctctaaagggttgtccaaattcctagtgtgggcatgtagagtagacagctgagtcacagctgctgaaatgagaccatgcctccctcccgctcgtgaagggaagaaatagggagaaaggagtgcaagagaattagtgccaacagcttacttaaaattcactggcttgagaagtctatgagattcctgggccaaccggaagccattactctaccacgtggagtgtctgaagcatgaaatctgcctttccttagagaactcttatcattggccatagtttgtacaaaaatgtatcttctttctgcagagatctttcctgtattgcaggaatgctagtgttctctggcctatcatatgaggctgctggcctaccattctagtttgcattttcgacttggtgatacctggccagcatgttggctttctcctgaagtttgatgtttctcttccccttgcagtacatatttgaaaagaagtttggaactgccagctttgcttggatttgaactatggcttggtgccttactagcaatgagaccttgaacaaattactcaagctctctctaccttagtttcctcatcaataaaatgggaatgataataatgcccaactttttaggttgttgtggggattaaataaattgtttcatattaatgtaccccccaccaaggtgtggggattaaatgaattgttcagattgcttagaacattgcctggcttgtcgccactctgccatcaatggctgctgaatatcctgtattggaagtagcattgaagatgattggaaagagatattaatttaccagcaaattaacactccatctcatagaaagagcactaataaattaagatctgctccatatcaccattactaatattgttttagaattttttatggatttaaataattttacacacatacagaggaaaacaaacagtattatttagacattatgaatttatacttagaaggcccagtagcatcaattgtaaaattactagatttagatcattagcaaaatatttgagactgcaaattttcaaaaagaggtgacttttccaaatatcatcaataaattataagaaagtataatgtgggaaaggctagaaataaatataaaccaaaatattagcacttactacttctggtttttgggaatatatgtgatcttttaaataaatttaaaaagccctattgtttacgtagtatttactgtgtgctgtgaactgtgttaagtaatttttgtattttaaaaatagctattggctttacacttcatttgtgttctgaccaaatattttcattagtcccctttgagatccataaagcctttctgagttttgtgaatgtaatgcagctaaagattataattgtaaaactgcattccaaatggcacgtattgtaatttgctgctacttatatctgcttgaagctgtcaatatgtagagaatagatttgatcattgaactgaagtaaaactgctctcaatttaggagtgaaaaattttaaggccccacctactttctctctgggaaaagatgtttctgttttctgtgtgtgtttatattttctctatttaatgtagatagtaatgttgactagtttacatctgacttttcttccaggtaacattgagatttagaaaaagtacaatatggctggcaccctgagtttttggagagcttaactttgtgtccgaaatgcttaagaagaggagtgtgttcatttgctgtggttgtgattatgattataaacttaaggctggtaggccgggtgtggtggttcatgcctgtaatcccagtactttgagaggctgaggtgagtgaatcgcatgagctcagaagttcgagactagcctgggcagcatggcagcaccctgtctctacaaaaaaatacaaaaattagccaggcgtcgtggcatgcacctatagtcccaggtactcaggagtctgaggcaggaggatcacttgagctccagaggttgaggctgcagtgagccaagatcgtgccactgcacttcagtctgggcgacagaacaaagaccccatctcaaaaagaaaataaacaaacaaacgtaaggctggtaaggaagttttgccactgaaggcccagcctcagccaagttagtgattgggcaggaagtcagctctcaccctcacttaccctgcagttcccctcccctgtgacttctacaccagtattttatagtactataaagttttctttgactcacacagttctcacttcacccttggagatgcagttaatgccgttgagtcagattcagtagactttcactcattatgctgttagggtctttaaagaaatcacagatactccaatttaggactgcctgttgtggaggttaccacagcccgatgcaaggccacatgacaaatcattcatagtgatttttaatgttttggtagaaataatatttcttgaaaacatgactatgttattgccaatatctgcccagcaaaaagtagtttttgtctcttttacaatatgctcagaatatatgaaaaacaaatcttcatatgaaacatagtcaatcctttttatagattgttaaaggggactgagggtgaactgcagaatcctataaattggatgattctcgttttgtgggtatatttacttgttgagctgatcgcagcagggagagggtgcacatatttccttctagatacagcagtccttcactggttggaggttaaaagctgttgaaaaataacccgaatgcatttcatgaaagaatcttagacaaatacaattacttggaatatcagctaattgcttgctctataccatgattttcatgtcttacttcctccagcctgacttcctccatgtaccttcttggtctgagtaaaatctatggtaataaccaaatcgtagactaaaattaatcataatggtgagggctaaaaggaggggttaggaaaggacttgaccctggatggtattttcttatttttcttagtacatttaacatgtgtattagtccattttcacgctgctgataaagacatacctgaaactgggcaatttacaaaagaaagaggtttaatggacttacagttccacatggctggggaggcctcataatcatggcataaggcaaggaggagcaagtcacatcttatgtggaatggcagcgggcaaaaagagcttgtgcaggaaaacgcccccttttaataacaactacaacagcatgggaaaatcctgcctccatgattcaattacctcccatcggccccctcccacaacacctgggaattcaaaatgagatttggttggggacacagccaaaccatatcaacatgtaactttacaagttgattgtattgtagaccactaattgaaaatgctatttctaggaacagactttattttactaatgccaggctatgagtaaaaatgttgaattaaataatgttatgagtaatagtagctaggtagtcacagtcatagttcaagcatttcataatgaaaatatacatatttacatcttctggcaaagttataaacccatcccttccagataaagcagcatcagaaatacttatgatgtgtctacctctattatacctaatctattttgcattctgattttatcttcagaaaaggcctgcagttactgaaatgacaagtgaaaaggaggtaagttatgtaattagatgtcaggagaataataggaagttatagccatgttttagataagtttattgttggctgacttaaaatgctattggtgtaatcaatcttttcttggatagcttatcataaaatgttgcttcccataagtagtttccctgtgtttattttcttaatccactaaattgctagctgaaacagttcgtggctaggaagggacacttttatgtcacatatctcctatgacactgtcttctttccatttttgtaattgattcaacatctctttacctctgtaacatatttggatctttttattctgtcagcatttggccaaataattgctagatcctatgttgtttcttaaaatatgctttgtcttaatcaattgttgagtatttagattctccacatgaattgactatcatgatatcttactattattcattagtccaaagtttgagggtatatttgcaagccattttgctctcagtgcccttcaagtctgttctttcaattttttcctatagccattgggttcatctaaaaagacccatagacattttgcttttgcttctagcagtattggtagccttagcttgtatttgtaggactcaggactaaacatatgccaacaatttatgtagggtagaagtgaaaatgctggattatagggcaagtatattaacaactttggtaaatgaaaccaagttgccctcaaagtaccagttgtcctgttgttatctcctctatgatcaatactacatattgtcaatcctttgcttttttgcaaatgatatagacaaactcttcatttttgttgcaatttgcccttactcgaatagtgaagctgagagatttttcctgtttattggaacattaattaggggtagtttttgtttgtttgtttgtttgagagagtcttgctctgtcgctcaggctggagtgcaatggcacgatctcggctcactgtaacctccgcctcctgggttcaagctattctcctgcctcagcctcctgagtagctgggattacaggcgcccgccaccacgcccaactatttcttgtatttttagtagagatggggtttcaccatgttggccaggctggtctcgaactcctgacctcaggtgatccgtctgccttggcctctcaaagtgctgggattacaggcgtgagccactgtgcccagccaggatagttttatttttaataattacttgccaggatgtccgtgtcagaaacacattgtaataatttattttatctatttttagtgacttgaatatttcaaaatataaggtatggcttgagatgagaagtgagtcatgaaagctataatactacagagaagataccagacttcaaatgctatcttcatactgctagtgctttaatctattatgcaaatcatatttgccagctttcttcccccatacttgaaatttaaaaacttcttggtttttatattttattctgaagaactgtgttcacctttttaataaaccttacaatttgatagattaaaacttggtcattatgttttagagcaagggctggagggaaaattgaaagaatgttgaataaatgagttttataatactttagtgaatcattttttctttcttcttcttcttcttcttcttttttttttttttttttttttgatagggtcttgctctgtccatcaggctggagtacagttgcacaatagctcactgcagtctcaaattcctgggctcaagatatcttcccgcctcagcctcccaagtagctgggactacaggtgtatgccactcctcctggctaatttttagaaatttttgtagacatggggatctcgctttgttgcccaggctggtcttgaactcttaggctcaagaaatctaacccctctgtcttcccaaagtgctgggattactggtatgagccactgtgccaggccccaatcatctaactctgatgagatcagaatatttcaagtttggagatcttctcatatgtactgttcttaggaaccacgaacttctgatatactagagtttgaagcaaaagaaggttcacttcttatctccattaaattattgcctgtgggttggacaagcttgatctagatgttttcctaactaaaatactaactaatgatgacttaaatgtacacagcacttagcttctaatatcataggatattgtggagaaattttcaaattaattgacacacgtttctaagtagtagttggaagcagaaattggagggagtccaaatagtttctttgttggtatagaaatgaacacacacacacaaacctgaatcttggtgagatccaatgtaaaatttcattcactattcccccctttaacactgtctttgttaggttagaatggccattgacttacatgtcacttaaatgtctgtgcaaagcagtgctttttgctgcttgggaaatctttatgtggtgattccactaaatggtaaccatatgcactcaactgagggaggaaatttgaggagaaagttactgtgattcaggtttcagcattgatttggttagaagttgacacctttaaagattatcttaaaagtttcactaaaacttcccttaaaacccagagtgctgtctttatgagaaagggagcaaaggtccccgacatccagggttctgatgtcagtcaacattaacaaaatgatttgcttgtgtttgtgtgagtggcttgtttgctctggaccagacagaaggctaaactgtcattaaattatgcttagaatgagaagaactggttaatgtatccaatagcaatagttaatatactggttgtaatgaggatgatatccaattatctattctaaccaaagaaaatgacagaaaaaaaccatcattctttagtcttaagaattgtgttttaagaagtttgaaaaacccaaacattggcccatatgccttctatgttaacctagtctagaaacattttgatatgcaagggggttaatattaatgaaaaatataggaagataaagttttatatatataattattattattatttttgagatggggtctcactctgccacccaggctggagtgcagtggtatgatcatggcttactgcagccttgacctcccaggctcaagtaatcagcctctcgggtagctgagactatagtcacgttccaccatgcttggctaatttttttttatttattttttgtagaggtgggttctccctatgttgcccagggtagtctccaactctgggctcaagtgatcctccttaaaaaagtgttctttttttttgttttttgatttcaagatgcattttaattatttacataaattaattggttatctattttcttgaagtgtatttcaaagtcctacaaaacttaattgttgacctccttaaaatgtagttgagtatacttaaatttcctttgccaatctgaagtaaaactttaaattcaaaccctcaaagcaggtctttgcccttcctctaggaggttgggtcacggaattctgttttacgtcccttcataaaaaaaaagaaaaatgatctctctcccatcatgcttgagctaagtcaggagcaactgctgaaataagccagtgtgtgtctcatatgggtgaagtggagcccaccagtaatcagtaatctctccaggagaaacaaaacaaaacaaaacaaagatatgtttaaatgtgagcttgggtggtttccagttttaccaaaatgtaaatatggcttcagttgagaattttatttttcagtacatttactctctgttgctttgttcgatgaatttctctagattgtgtatctaacactaagtgaaaaagaccttttactggaatagttaaaagtataaaaaataggaaaagaaacttgggtaaatatactcactaatgatctttgggaaaacacctggtttattatcctacagtttgtgcaagggctactgcaaaaatagtccgaacaaaattgcttttaatgttttcaaagatagaaaattcactggtttatacatgctttagggggaggtgaggtgaaaagggaaggttgccaagcaagagtgatagtatagtgttaatgatcatataaattttcagccttaagtcaccctatttaaataaaattatttgtagaaattttagttaattagctaggcttttatagctttttctattaaagaccctttcctgtcagtgatatcagggatgcctgagagacgttgatatattatatggttcaaagtttaccacatgtctattctcataggatgcagcatcatcatgctaccaaatggatggaatggggaataccttctcttgaggttgtgcccattggaggcagctgtactggataattctgaaaatggctaatcctgcctcacttttaggagacacttaatgtagtgtttaagagtaaagaacccatagtgcctaggttcagcccctggctctggtactttcttgctctgtgactcttggcaagtttcattttttcttctttggggtacttttcactaacatgttccttttacattttcaaaacctcttttcatctgtgaaatcatttctatgggtatttggcatgtaattaattacccattagctccaataatgaggttggatgaagtcacatacttattggcagagctgcccaggtctcagaggcttatttttgaattccaacttgtacctgagagctaaaaattaggtaagatttggattgatcacacttcgggatcccctgctacaatggatatgcggttacctgtatttaaaacaaagaactgatgacctttttccttttaatagctgattccttgatttacctaactattcttcattttatttcatttatggaaagagcactgaactagtgaagcatagtaggagataacttgcacgcatgtatgcatgtatatgctagggcatgaggtatttcccactgtggtcttacaagcttgaagcatttggacggaaggcccttgaaagtgtctctagttctcaccttttctagtctcactttattactcatactgcttgccagccaaacaactgatttggtttcagatgtagcactatcattctccatttctggttcagttgcttggctgtggctcaccgctactcctcttaatatgtgagaaagaaaatatggaggtgatgcagaagttaaaggttcttggttgtaagcttttaaccagactatgttctgcctatggtttaagatcagagtgatctaaaccaagggctggtgaactttgggccaaattcagactgtggcctgttttgtgaatagaattttattcaagtacagccatagctatgcccatttgttaggtattctttgtggcttcttgatactatgacaagagttttgtagttatgacaaaaatggcatggcccacaaaactggaaacatttactaacttgctttttgtacatgaagtttgctgactcctacgctaaaggaaggtatttcctgactgtttgaaagtatatatgatgagtgttcaggtaaaactggttttggcaatatggtaatattgccttcatataaactatttttagtctttctgtgtatattagatggaaaccatatttctctttttgttaagggcttagctgttaaatatgtgcatctgtatagcatatagagaataaactgggaagaataaaacatgaaaaaataaggatgcttttttaaccaaaaaaaaaactgtgttgggtgttaggagcttgacatgcattatgactaatcctaacaccactgtgctataactgttattattttgatcgtactggggaggaaattgaagctaaaagaggtaaaatatgaaagctatttatgtatttagccattactccaggctgtgtctagatatattgtctctcttctattacctgcgtggatgatgtatggcccatacttaaaattcttaagccttattcatagatgtataagggattttaatgttgtttctctgtaaagatgaagggggtggaactgaacttgttattccattctggataattcagtcttattgaagattgtttatttagttggagtggagcatctgcttcgaataatatacagtttgaatagaagtcttactagctaaataatcttggattatatgaacatgtattcttggctagagatggaactcaagggatgaacaattagataagtaacaattgtgtttgaagtgagttcttctgtcatcattaagagttatttctacctatcaataaataatgggtttggatttcctgaaatgtgtctctagttgtttttccttaatgaaggagttagacctaaataatattttcacaccctaattaactacaagcagggcaaaggatactttcaggatctcaagtgattattatttaaagaactcctattcataaattttctgttttcttctagtagatcctctttggtaatgaaccagagcaatatattatgaccagtgactcataaatatgcccttaaaaccatttgttacttgtatctacttggaatttttcctattttaatttcagtacttaaattggaaaacaaaagtgttgcttatcattagagcaggtataaagtacctaaatatttatcacggtatgccagtttttattttgtaccttcagtattcccagaagtgtagcgttaaaaggaaaaaaaatgattcgcatatcccagtatatttcagaggaaataggaactttatttaaaagcattaatttctggctgggcgcagtggctcacgcctgtaatcccagcacactgggaggccaagacgggtggatcacgaggtcaagagattgagaccatcctggccccacatggtgaaaccccgtctctactaaaaatacaaaaattagatgggcatggtggcacgagtcccagctactcaggggaggctgaggcaggaggatcgcttaaacctggaaggcagaggttgctgtgagccgagatcgcgccactgcactctagcctgggcgacagagtgagactccatctctaaacaaaaacaaaaacaaaaacaaacaaacaaaaccattaatttctatacttctgtaaggtgtttttctgggaataaactgtattactcagattatcaatagaactgcatttaagatatttagtaattttcattctttttacaatttttgtgaaatatattggcttttttgtaatgaattttgtagatcatatcaacaaatttatatcatggtttctgattagcatagatagatgacaaagttagcttaactcagtattgcatgtgtcctaatgtgacatgtattaatctttctctgtgtcctgaatggaagaaagatcattccaagttgataatcacttacatgagcaaagttatgtatcacagcttaattcacaattggagaaggttaatttgtccatttttgaggatcatcaagcagctttactaaggatattgtattttccaacttattttgtcttggactttctttttacttgaaaaaactatatatattccaaaaatttaagaaaatgcttcatatcttcagctaaataaagcttgttctttacaaacagtaaagaaccatgaaagataattctatttgtttcttgctactgtactcagtcagaaaattaagaatctagaggtgccatggaggggagagtgtggaagatcttaggacaataatcttttaaaagaatgtccttcatggctctccagtgatctacgacttttcatttttcttcagttcaactttgtttaaattaacgtgaccccaggttttattgaaaagtttgacttcagaaaggacttaaatttagtattcattttttcctgattctacagaaaatgtctctggttccgtgttctctcatagagcttttaccctctgtttaaataagcactcaagaatctaaatgctagatgtttaggcaatatagttttggggtcaggggtacttacttttctttcctttttatgtttaatctttttggtgtctaatactacttagtaccacatttttcaccgagcagtttcggagtaaaaagatattctggcaagttcatatcagcttgatttttattttcagatgaacaggttgccaaccccttaagtggcttgctatcatagaaacagaccatttcggtgatagatctgtcccttagttgattgattggcgtagaggaattagcagtctgtgaaatgctcttcagaagtaattttcctccaaaggtcaaggaactgtggtcaccatttctctggcatgatttgcagctactcattgtagccttattaccagtagcaaatgaaacagctgaaatggaatgtttccttgctcatttttctttccctctgcctaactaaatttcttgaacaccagtttggtattacctctttctgttctgccatctgccatccagctcagtgaaactttaaattcataaggtatgttttaatttatgaattaggagcttgctatgacatttctctttttaaatagatttatgtaatactatacataaagatgtcttgaactcaagaacatgtattgaggaccacgtatgatagaggacttggtgtttaggcctttctagtgagtcctaaatggtcaataggaactgtatatgatggaattagttcaggatatattatgcgctctctgttacaaggttgaaacaaattattttcctctgtttccctctattcctcttttaactcaacatgggttattaccatttttttaatgtggcttgaattgcctcatactcttggataaaatcttttaaagattttaatacagctgtagaacaaactctaaactcctttttctgacatctaaaacttttcgtatttactttcatttcttcctagtttcctatgtattctggatgctcattatacagagttatttgaaatttcacaacatatgatgttcctttagagttatatgcctttgatcttgcttttcctctagttttattcccatttccattctggctttgctctgtttggtatatccttcctcatattcactatgagtaactcattgaaaccttccctaaccaaccctggtgtgagtagccaattctttaatgttctgtggaattttcatcatattattatcccgcataacacattgtatttattttaatatatatgtctcccatagtttgtctcatttatcagtccagttatttttgcatttcctatcatctactccagtatactgtatttgcccttaaccttgaaatacaaaattctttacaaaaaaatttgtaaaagttttattagtatgctatattttatgcctcttggattagaccttgttgtaaattagaaattaaaaattatttaaaaagctttcttattactcaagtcaagtagaccagtaatgattttcaagactcctttgacaaatttcagatagggaagggatgtgcaacaaatagcaagcattgacccacttattttgtacagctactcctagttgttattgctaatcagaatcctgtagtctaaaattaacagtggctatgaaggagagcaattaaggccatttgtctttcaaatgagtcaatgtgggtcccactggtagtttaaatttatatacagagggcactcacactattataaagggtaatgggggccctgaaggcctgtgttacaaagcagtaaattattttagagtttgatagcaaattatattttgagaaaaactttcctcttgctatgtgaagatacatttcctagcaacctattttcattggttaattttaaattaaaaagtacatcttttttaatgagagcatttataaaaggtctattttaagcatatttaaaagacaatattaaggttttgagttctcgagtttggttgttttataggattgctgtagtcataagagtgattcaagaatacactcaacatattctccttttggaaaagatttcagagcttgtagtgccaccatgacatctctgatgtctcctgctttgcctgtgacactgacccctccctgtcattggtgagcagtgtaactttcacttatactcagattgccaaacttttgatgaggaaagtaaattccttttttttacagagaagaatttacagcactggagtttactactccttagtctgttgcttggtcagagaattcactgagtttctgcacagagatccctatggaaactgaacaaatacactatttgaaaggagacaggttattggtttttctcattaaacccactgctggattttcgttagttctaatgcattttctttcaagatgagacatataggccagttcttattttcatgatttgaataaactaaatatgttgagtcgtgtgtgcctgtacacatcgcctaagaagcaaaaataatccttctacttttgcaatacaattacccctgaaaattacgccagaaaaaccatgactgatgcaaatggggaatgctacccccgtttaaaaagaccaagttattaaataaagtgggaacggtgaaagtgattataggctaatctgattggttttatgcttgagtcacccccaaccttttaaatcataattgtgtatgaaagtaatctaaataaagcatgaaagatatcacagacctcaaacactttagaccctaaaaagctttatgtttcattggctattatgagatttcaaagagttcttttaaagcaaagatgttagtaaaacttaaattatttcaccttcttgaacttgcattgtagaggaagacaactttcactcttattcttcctctacttctcaccactaaagttactaaaaacgatttagactccaggtggtttgtgaggcaggagaatagggtccggaggcagggaacctaaggctgattcacctgacgtcctagaactaaatagaaaggaaaaccccaactttccaggccttagtaacagaaggaccacagcgtactccctttgcaaacttccttgttttctgagtggtgatggaaaattgaaagtacctctgattggttgcagaaagtactgtaaaatgttgattgcgggccaccacttcatttacatgaggtgaacaccaagtggccaatcggaaacctctagggaggtatttggacctgagaagattccgtactgttcccttgagctgctgctcgcgcactcccacagtgtggagtgtactttcattttcagtaaatctctgctttcgttacttcattctttcctcgctttggtgtggattttgtccaattctttgttcaagacgccaagaacctggacaacttgcagtcaagatcctctaccactaacactttgtatatttcaagaaagcctgacttatgcatgtatctattatttttaataattcaaaatctgtgcctcagtcttccttctgggtctcaaatgggcttctttttcaaacagaaagtactgatagacatttatttttctgtgaaaatttaaagagaatagtgataaacaggagtaccatttattattaagattgtgagtaacattatatatatcaatataacatttccttctccagaactttcgttatgtttggaaaatctgtttagaatgtaacagtagtcttcttttctcctaggtggctgtacttttgatgatggtccaggggcctgtgattaccaccaggatctgtatgatgactttgaatgggtgcatgttagtgctcaagagcctcattatctaccacccgagatgccccaaggtgagagtcactctgtttagtcagtgttgggggaatagttttgcagtatctatgattttcttatttaaagtgtaacaacaataatttaatggttataataagctaaattattgtgctactggatcacttctaagagccttattctttgcctttcccttaataactttctgtaattctgtattccttgttgtctttgaaaaaaaaaagataagtattagtgtttttttctatttaataaaaacccaagtgacaaaccaaaaatcaaaaaataaaagaaaaaacagaataaacaaaaaaaaatcctttccaaaaaattctcaaatgtgggatcagctcttttcgtagttattcaattaaattgtatatgttggatccaatcagactgaagggaaagaattttattacattgtaaggagagaggttgtgtctttctcccagtggtcatgagcatgccagtgactctgaggggaggcagtgtggagacaaaagtatcaaatggagatcttttatgtgggaattatagagaaatagggccagatctgttcttttgttgttgttgttgttttttgatatggagtctcactctgtcacccaggctggaatgcagtggcctgatctctgctcactgcgatctctgcctcccaggttcaagtgattcccctgccttagcctcctgagtagctgggactacaggcgtgcactgccacgcccagctaatttttgtatttttagtggaggcggggtttcactgtgttggtcaggctggtctcgaactcctgacctcgtgatccgcccgcctcggcctcccaaactgctgggattacaagcgtgagccaccgcgcccagcatcttttcgttttttaccttactttgttatatcctttgattttgggttttgggagataatataatttataattgtttaaaacagtgtgcattatgtttcatcttaggaaaaacacattaacataggatgtcaatatttacataccatttcatacaatattggactaatagttgtgctttcaattctgcatattaatctggagcaaattccaagttctgtgcgtatatgcttagcaataacattaaattgtgacattaaaatgtaaacaggaatttaaaaatacaacatgaaagagaacaaactcttttccttccaatatttagaaagaaacaaaaatagtacataattatatattatatatagttatgtatatataatatattatcattatgctattataatatataatataattaatgtgctgattgcttagtactaataatttaggtttcaaagtatatttagtatttttattatgattaaaaatggtttagaattaatttttctacaaaaagagtaagtccttcttgagtgtgaattttagatatgacaattttagacatagccattagaaatgaaaatgttaattctgcttattgaagagagaaaattctatcagcagcatccctgaacttgctgatcaatgtgatttaaaaaaaaaagtgaaaacatcaacaataaacaatttatcacaagcacacaaagtaaataaaacctaaaagttacatttctaaatgtaatttttagtttgtaaatgaatatggtaaatatttccttgaaaaattttgtgttggttcccccgtgatgtgtacttttataatagaatgaattaaatttgctttttactctgaattgtcactctccgtgattgagtaggaaatggttatttttgaggctgaactgagccataatttcctttgcagagggaaaactggaactgtgtggttgacactctttgtttcttatatttgacccctactttgtcagcagactcatttaattttgtgcgtagatttgtattttttctttcaaaggtatgtaaccttattttcctggtgcattttaattaaactactgtaatttttcacctgaattttctctgtggtatatttagactaaacttttcatataaaattaaaggatgtgggtgggctgggatgcacacattttgaatgtttatcatcatagaataataagaaagatgttgatttatggaaatgttaccattgctaattaccattgatggtgggtaatgaatagttgaagaattactgctcagatgaccttgttggctcacctttgatgaacagcttaatcggtggttacagtacaggatgatatgcacagaaaatgaaagcatttgaaattcagccatatcttccaattaataggacattaagtaattaatcatgcagaggagggaaaaaggtcacggccactttgccgaatgaaacagtgtttagtcttcagagaggtgagagaaagcactcatgtatgttattcttttagtcatctctttttataatagatactatttttttcattttccttctgatattcctttaaagtgctgactgaatattccttgctcataaattggtgtaaaggagacatttagatttttcatgctaaaatgttatgatctttttattgtcacataaattagcaagcatgcttattttctttatgtactttaaaaacacaaacaaaaacaaaacaaacaaaaaaccccaaatgtttgggaactctataaaagctggctctccaaacctaacttgttattgaactgtgtgatacttggtgctattaactggcttctgtttattaactttttggactgaaagccaagagtgagagaaaaaaggatgaataaatagattagaatgaaagaagactgaagatagatagtagagaataataaaaaaaattgtttctattcatgaggagatacagtaccatcaatcattgcttaaaatgttctgtagcagttcctacttactacttactacacagttccacatactagtttggtcagattacaatgatgatgactgaaaggtctgccaaatagaataaaaaatagcatgcagaagaatgagtacttcataagacagttctagtgtccccaaatcatatgaaattatgaacacctacttaactcagtcatcaaagaaatgcatatttaaaacacagtgagaaactactgtacaatcagtggaaaaatgaaaattttaattccaagtgttggtaagaatgtagaataagtaaaaccctctaatactactgttggagcataaatctgtacaaccttgtgaccagcaaatccattcttgggtataagcccagcaggactgagtatgcatgttcaccaaaagacatgtgcaagaatgttgatagcatcagcattcataatagttccaagctaaaaacaacccaaatgtctgtcagcagtgcaatgtataaataaatggtggcatattcataaagtgaaatattgtactgcaaataaatgaaagaaccattgctttatacaataacatgaatgaatttcgcaaacacaatcttaagggagagaaaccagatgcaagagagtatgtattatatacatttatataaattatgtaagtttcagaaacaggcaaaactaatcaatgatattagaaatcagcatattatttacttgaaggagggtttgggtaatgatggttagtgcttgtcaggtggcatgaaggagtcttccagatgctggtgatgatattctatttcttaatctggatggcgttttacagtttgaggtgtgctgaaatctgtaaaaagtcattgagctgtgtgcaatgatgagttgtgtacttttctttatgtatctgatatgtcaatgtaaattgaaaaaaataaaaaccaatgcacacaaggctgggaaactaaaataataaataaaatgtcatggattagaacaaaagatataaaatagatatcctcaaatgggtccaaacttctagttttcttaccatactggattctctcctccctactaaataaatactgtgttcgctgatatctttgtgtgggccttgtattgttcttttccctctgctgaaatatttctttgtctgcttatccattcgttaatctcttacccatttttactgtgtcttctcacgttctacctgctttgagaagattttcctgactggcttgaaactctgtttcttctatcctcatatcagaagatgcggcccactgtactatgtactacttaaattgtagctatttttatagtatatttcttatatgtccttctgtccattagactataaggtccttatgaacagccgggcgtggtggctcacgcctgtaatcccagcactttggaagaccgaggcgggcggatcacgaggttaggagttcgagaccagcctgagcaacatggtgaaaccccgtctctactaaaaatagaaaaattagtcaggcatggtggcagctgcctgtaatcccagctactcaggaggctgaggaaggagaattgcttgaactgggaggcggaggttgcagtgagccgagatcaggccactgcactgcagcctgggtaacagagtgagactctgtcttaaaaaaaaaaaaaaaaaaaagtccttatgaacatagaccatatttttttgtgttttatttctcaaaaaaaattatttttcttagacaaaaatgtcaacttctgtaatgtaagttttaaaatatttttgtcaagaattaaacaagatgtttttcctcttgttagaaaattaattgaattcaaaaataccccatttaccaaacattatattgagttgagatttttatgtaattagacccttacataattattaagatttgaccttagtctttataaatattacctatctatattggatacacttaaatgttgttaattctatcaaaaaagtgttctcttttcatatttctttctctctttttgtttttgacttttgcttgtcaaattccgatcttctgtccctcaaaagtctattgtatatatattttcagaacccatagagaataagagctgttgcatagaactagaaatcattctttgatctcaaagacatgtgtgttcttgacattgtttgtcaatttttttatgcttatgacctcatgaaataaatttatttgaccattttactatatgttctctcctagatctgagagtagggattgtgactgacatctcaatacatttatctttgactgtaattataactgctttttatttttaacaggtttttgcaaaatagctaattgaattttagtttagagtctctagagaacttatttgatagtatttaaaattatgactgaattgtatcccaccttcagtctagtgttttcactgataataatgaaaataactgtacagagttctttatttaaaatgcacacactgtatatatagtaaaaaatgaaagccctttgttgttaaattactctgaagattgaagtaaggaaccactcctcctcccttataaaacttagtgaggtctgattcagtagtttaaggccatatgtctctaagtgtttttctgaggagccaccttgatggagccaggtggtatacagaaaggggtaggggtgagaatgtaggggattataaaacagataattccaggaccatttttcaattatttatttggagagatttggtgtgtttttttattcagtggggagcatgcatgggtcacatgattttgtacctggctttcttctgatactgtgatgaagtgaaaattaaataagacatgggtgtccataatttgatgcatacaataaaagttataggtaacatgatttcagctaagtttcctaagtaatgatatgagtctcttagttttataagagaagatttagtaataatttatttaatttagtaataatttattaaaataatattatatatgccatggaacacattttaatacatctgagaaaaaatttcaaggaagttatgttgacttaggctttctttctctctgggaacagtgatcagttactaaaagtagtggatcactttgactaatattttcatccccctattatagatgattaataaaaaagcatagttttttacaaagccataactgtcaaaaatctcacacagctgaattaacagaattatttgacagtgtatcttccagagacaaaacatggcagagattggtagaataaagttctgtgcatgtagtattggcaatgaatattagcttgcaatattatcgctagttttgtattacgagattgagaaaatcaggccaaaatgttggtttactttctttttgtcatctacttagcattgtctgttaacacaaccaaagagagtgtgtgtgaacatgtgcagttgtcctaaggggaactgagagatttggtggtaatggggagaggaagggcttaacatgaggccattaacgtagatgggaaaacctcaaaaagtactggatataggtgttagattctaaggagcgtgaaaacttcagatgtttaaagctggaaggttatgcgtcattcaatgattttcagatttttttttaagtaatagaattcttttttaaaaaaataatattttctatcactttaatatttaaaatcaatgacaaggaatgaatggtcctggaacttatctgttttataatcccctacattctcaccatctacccctttctctataccaccctggctccatcaagatggcttctctgaaaaacacgtagagacatatggctccaaagggtagtttgaaaacaatgatgttgcagactcaagcacttttagaaaagcatctctgagatgaaagtacttactactattagctaccacttactggtcacttactgagttttactataccagggacatgacatgtatcttctaatcttcacaagagccttataaaattggtgatatttcggagataagtggagtgaatatcttaacagcatatctaccagagacaaaacatggcagagagtgatagaataattgtcacccagggacagaattggaacttaaatctgtctgtctaatataaaagttactcttgttccagtaccaccgtgcttcatcactgcagttgagttgacaaatttccttgacttgggcatgggcatttatttaaatccactatataatgagctatataatttatttgatttaatccagaatgatcttctactacttcatttaaaatacttctttccacaatttgaaagctttaaatgactgtttcttaccctttgtgggaaatggaatctgagactcactgttgtttggaattgctgccaagcttcaggattttctctatgatattctcatcccttggggagacgctttgcccttcctttgatttatgtgtatgttatttttagttatttgataaacacttgctgcgtgtctgtttaagcaaacctttagaaacacatatgttatctgctgtctcattagagcatgtatggtaaaagaaaaaatcatggacgaaaggaatcagactaaagtctagggtttgaaaataattttaagtctttgtttgcagtgaggtattttaggatgagaattatgggcttatttcaatgtgctcttccaaaccatgttatcatctgtctattgatgcttttgccctctgcacagagaagatagtttgccacatttgagttgcttattaaaaacagtgggagttggaagcagtgcaaggtgagagagtgaaaggctgtaatggactacttgaagggtaagccacttaatgaaggctggtttttaatgtaaggactgttaccctcgcagacataaatgcaacatgaaaaatgtctaaattacagtggacagaaatggcatgctgagactggaattttttcctgatatttcaggtacataatgcatctaagttagatatgtcctaatatatttcaggggaaaagaatagcctagtattaaaaaaaaggaaataaaaatgaatataggtgtcagtgctagagaacttccaacctcctagatgaattaagataggaacacacagcaatttcaaagactatatagtcacctttaacatataccttaaaatcaatacatagtccaaagactcaaaatttcttttccctggtaggagtgtgaccgaaaatacagttatgaccttatacttctcctctccaaaaataaacttgactcaagataggtaggtactatctcagtttaaaagcttattatctttcaaacacaagaagaatgccagggaaatacatacacacacacacacacacacaacaaaaaaaacaaaaaaaaacaaaaaaaaaccgagcaaacaagaaaaggtaggtaactaggaattattaaaaatatatatgatattaattatctcttataattaatgtgaaaaatatggagttatgattatatattagattatcattacatataaaagatgctttaaaatcttggaagaatgttagttttccaacctagtttctgccaagagtggtatgttgtaaagacctctactccctcaccaaagaggaaattattggctgagatgtatttttcaatgaaaagtgaacattttctaaatttagagcatatgacaacttagaaatgctcacagcatcatgaagtctccacctagccatgctgattaaaaagacgctggcttgctttttctaggtttatgagaataaaattaaataggacagttttacaaacttcatcaagctggttatgtatttctgtatgttcctcccacctcagttatttaagagttggagattaaataggaaagtagggtggcaattttgactattcaaaagttatgttttgagtgtgtaatttttatccatgttaggtcagacttactggatacttaaaaaataattctctgactccttctgtctgatcccaagcatttaaaatatgtcatttcacttaattctcccaaaatgcctttggaatatgtatttacatcattctgtaggtgaaggaactgaagtcaggtgaacctaagtaaattatcaaaggttttatgtcttgggaaaggcaaggctaggaatccaggtatatagagatataggataaggatttaacctttgaactttataaaacaagtatatgtagagatctttctttagagactgcagcaaaaagcttcagggctgacttggaggtgtggcagaagttgtatctcttatgccttttccagtgcaagtaatgggaagcacaactacaaatgtgtttaaaccataaggaaggctactttcgcataacaaaaggtccagagttggctcattcagtggctcagtgatttcatcaataattcagattttttcttatgtctttgcctctccattcagtaggtcatctttttacctcaggctatctctctttaaaggtctaaaatctatggctattccaggtacaaaattcagacacaacagtatcctgaagaaaaagaggttcttagttgtctcctccttatgtcttataagtatcaataaataaacacaaaaaactttcctgggatactctttgatatagatatgttagcatagatctgtaagtagagtttcaaagctgtgggatttagaagaatgcacaaataaagcatttattaaaacagcattgtattctctaatgcaagcttgtctaacctgtgggccacatgctgcccaggatagctttgcatatggcccaacacaaatttgtaaactttcttcaaagattatgagattttttgcttttttttttttgtaagctcatcagctgtcgttagtgttagtgtattcttcttcttccagggtggcccaggcaagccaaaagattggatgcccctgctctaatgcgttattcagcctagcatcaggtttcccttaatttcatgcatttactgcatatgttacatatgcagtatcttcctacccctagtaagcttaccttatctttctaacctgccattgttactcactagaatttttcattgtctcttgttttccttatgatttttatgatgtggaataaataagggaacatactttatttaaaaaaacctccaaaacgaagaaagagtcaagtgttatacactgtgtatgtgagtgtatgctaaagatagattaatttattattaggggaaccagcaggatagtaagactggttcaaaagattataggaataagggaaacatttataatcagtgaaagaaagaatggtggaataagattcctaaattttatactaaatgtccaataagacaatcaaagtgaaaccatgaggctatctttactaacagacaaatcattttcctctgtactagacaaaatttgtttgcattatcataatatgagtatcatttgtgttgctataaatgttctacaagttaagtcttttctcacagagttgtaaaatatcttaatcagtggtaattagtgactcagatgaagcgacatacttttaaataattagcgaatcctttggtgaaggatatacagtcattcttgtgctgggtcccaagttttgaacattttttcttaaaacttcccccttaggatcgtaaatattatccaaggatgattcttgtttaaaacaacaaaaaagtggtatccttttgtttttgtctgatttatttatttatttatttagacagagtctcgctgtgtcacccaggctggagtgcagtggtgcgatctcggctcactgcaaccttcgcctcctgggttcaaccgattctcctgcctcagccacctgagtagctgggattacaggcatgcaccaccatgcccagctaatttttgtatttttagtagagatggagtttcaccatgttggccaggctggtctcaaactcctgatcttatgtgatctgcctgccttggcctcccaaagtgctgggattacaggcatgagccactgcacccagcccgtttcctttagataggtgcagcaagaagtgtttattgacatgagccttgtagtaggagtgaaatatccagtgtcacgcaatattaaacaattagtaagagtggaaaattaacatctatttgaagatttcattagaaatctagaattgtgttttcagtagcctttattacttcagagtattttaaaaaacaaaacttggtttcttcttcttttcagaagcttaggaaccaactcaaaataaccatctccattaggagtatttcacttgaagttcttataaatgtgggtgaattccttcctcttttatgtcacccaaatgagctgagcttccttgcttgccagggattaactatttcctctcaggccgggaccctataaactcagactaggtaacagaccctgttactgggagggctctataggtatcgattgtttccacatatgaaatacacagcctttgtctctttggtgagcttatcatatgtgttttagtaaaaaagttcttcttaatcaaacaatttgtacacttgatttgtcaaactatattctggttaaagaaaaggccgattcttagttatttatccagttatctgccattgaaagtaaagaaaagtagaaaaaaaatctattactgaatatcttagatgtcagaagcacatatcaattaaagaacctttattaagtcaaggattaaaattaaatcaagataaataaaaagctttattattatatataccaatcaaaaaaacagaacattaaaagtatactgaaaatctcccaaacaaataatgccaaattgattcactgcatgagttcctttaagttatatttaactaattatttatctcttgaatttggggattatagtttatttcatgaagtcatcaatcctagaaactctggcttagtaacctggtatagtctggctgatgtctaggtgatatcagctctgaagcttgtacccttgaggctggtccttgaagacataacagttagatgtacctgatctttgactttctattgaggccagtatttgaagacttaatctgtggagcctatagttaatagcagagccttcaggcaagcatgggaggaatgcagaaaccacctgctgaatgactgaatgcttgtgattaatttattatagtaatcaaccgtatcacactagaaaagagaaaaattctccatcagggtataagacttactatttaataagtatttgttaacagctcctctgaaagtaagaatatatggacatgactgtattaacagcttgccatgttcttcccataaattgaattattttggacacattttatattacctgaaaaaaattaatgcacagaaagttgaactaatctgatttgaagctctttttcatgcaagccttataatggtgttgagctaattaaaaaatatggaacataccaaacaaatttaattatttttattgttcctaatcttacaaggcaaggaagtgaatccctgcggttgtccaaagacctataggaaatcacaaaggcagattagaagaaaagacctcttgaaatttttattttttctgaatttgttgttttatcatgcaaggaagaatcagaagtgttatcacaggagattggtcacttgattaagacaggtgcctaaaaataaggaataataccagtattttaaaattattaatattaatatttataatattaattatattaatatagtaattttgatatttaaaaataaaatagaaggtaacacaatgataaggaaactcagctcttccaagaaataaagttgtatttgtttttaatcatcaaaaccataataaaataaacttaatatgtataatactatcctggagagatacccaatcattcctcagattaaacagaaattaggaataatttttgtaacctctttttaagaggagactgaaaatactaagatcaatttgttattttaacagagataaaacctaattccagtctggcattaatataatatttgacagcaaaagctttaaaaaaaaaataaaaattttttctggtcaccaaataatttatttcacgattgccttgtattcaatgtatttctttaaattcattatgttctgcacacattccatttgtagttactctaaacttttcaaaatatctgtactattctgatgttttactaactgttgtatttgaatgtaactcacaacaaactctttccactggtggttttatttacatcaagcttgtccaacccatggcccaccagccacatgtggcctaggatagctttgaatgtggcctaacaccagtatggcctagggaagccaaaagattggacacccctgatttacatattatattgagtttttgagtcataagtaaaaatactttctcaggaaaaaaaaaatagaaatattgtccaaaaatctttgtattgcgagatatctctattaagttatatgttgagaaatatctccattaaatttggtttttaaaccaagaaaagttttctattgataaaaatatggacaaggccaacattttgtggactatcgtgcgtgtggaacatatctatgagaagtcccccttcaaccagttgtcaaagtgagtcttgaatgagaaggaatatttattaggaagggaaaagttaatttgaaattgtatttttgatgtaattgttggtaatgagcaagcctaaaaggataggaatttatttcctaaagtagcagctaaagtaacaaaaaaattatccttctctgaaaagtttaagaaataaattcaataatagctgtataaagcatttgggtatttaatttttctcatgtttctagtatattgctttactttatatgggactaagaaataatttaacttaatgttttatagaaaataaaaatgtgtttaaactgtcaaaatattttttctgaatgtaatctactaatgattttgacttattacttttgtggctataatgatagttaaaacaatgttaaagatatgctattgttcataaaaccacactgttcttgacaatagaattaagaaattgatacttaagaataaggtgaaacaataccaccgttcagtgttgtgcagtttagcactgtgtttggcacatagacctatgataaataactgttttatgaatagctcaaaagcttaaaaatagaaacatgattttctcaactttcttctggaacacataagtatgttggaactcaaattatttttgaatgaatacataaatggaatgataaatttacacaaaggaaaaaggggaatattttagaaaatgatttgaatttaactgttgttaatgcactatactattgcaaaatggccttttgaagctttttaacgtagatgaatgaataggatggatctggtcaagaggattgtctgagtgggtttaattccagccccgtataacactataataatattctactgatggtgtttatgtttttttttctgcatgttacatgaaatctttggaagtttagatctttgccccagtattggaagattatatttttcatgttacgtcttatagttaaactttgctattaaggatgctattgtgacaagaacatgttgctttatgtaataagcactgatttcgattttttaaactggattattcaggtattttcattgccactggaaccaagaaacagactcttcttagcttagcagtggtgactatttcttctgttctctttgactcaaaattgaagtcaatgaagaaaagccagtgggaagagctgattgttgccatatgtcacattccttatgataaagtctaagtttctccctagtaataaaatttatataagccctttaaaaaataggatgacatttatgttagtttcttattttcgcaggctgagcagttcttttactgaaccagtagcagtggtacaaaagttgttttgaaatttcaaatgctctacatctatgtttaggaagtggacacctataggtcccaagaaatcattagagtggaagaaataaagagaaatggatggtcaataaaaacaatttataatttttggctgggtgtggtggctaacacctgtaattccagcactttgggaggctgaggctggaggatcacttgaggctaggagttcgagaccagcctggccaacatagtaaaaccccgtctctactaaaaatacaaacaaaaccaaaaacaacaaacaaacaaacaaaaaattagccaggcatggtggtgcgtgcctgtaatcccagctacttgggaggctgaggcaggagtatctcttgaacccgggaggcagagattgcagttagccgagatcacaccactgcactccagcctgggtgacagagtgagactctattaaaaaaaaaaaaaaaaagaattttcatataggttttctttatgctgcttttaaatatttattgtccatttttaaatggacacatgattacatatagttgaaaagatagtattctataatagaagtcatagttctttgtgctcaattttcctagtatttttacacacagaatctccaaactcagcatatcatataaaccattttggtactagcaccattataatactttcaacattattgaaattgatttttttcctttttttttttttttttttttgagatagggtattgctctgttgcccaggcttgagtgcagtgtcacagtcatggcagtcctcccacctcagccttcctagcaagtgggactacaggtgtgtgccaccacacctggctaattcttgtatttttttgtagagatggggttttgccatgttgcccaagctggtctcaaactcctgggctcaagtgatccacctcagccttccaaagttctgggattacaggcatgagccaccatgcctggcctgaaattaatttctgttaaatctgaaagagactctatagattatctctagtctaaacttccgttttacaaataaagaatagtgtagaaataggcaaactgacacaggaacctgagtaacctgaatttaaatctaggttttattgcttgagatttggtcatgacatacaacctttcttagcttccattttcccatcagtaaattaggaataataacatttctctctctctctgtaaatgttgttgtaccagtgaaatgaaatacagagtgcagtatctggtagtatctgggatgtagctgatggtgaatgaataatatttgcctccttccctctggcccaaggtgacacggccggttagtaatctcattaatctataagaaattggtttgaatttctttcacttactttttttttaaaagcaaggaataaattgcactttctcatcacaatatttcagtagctcattaggaattattttatatccaattctgaaaatcacctttgttatataattgctcactgagtacagttgctttgcactctgacgcataatgatatctagaaatgatttttataacaaagatagaataatgaggtatggaaatagtttgggaaaaggtttattatttctcaagtcttaagactgtttttatgtagttattccatgtgggttattgaattgctttgtggtcattctaattaaaaaattttctaatgaaatacacccttttactttgaattttacttaatgttgacagcagctgcagtctataatgtcataaggccaaggaagaagttatgcaacaacatttaaagctgagacactggaaaaattgttaaaagtatctcacactgcaaaaacacaagcaagcaccagcaaatatctagatttgaaaaaaaatgggtttaaaactgtctgatagagtttattgtcatatatttaaaaatctggatattctgttgcacaaacagattttggttttatggcttacagtagaacttgtaagatacttacttggattctacatatttgagtaattttttaacctgttttcagatgtttgggctgtgcccagattgttagctacgaattcttgttctaaaatgagaaatctgataggttggctgtcttacctgtgccttggttacgtctgttgaagaatgagagaaggataaattctctctgctctttgtaggtcccttttacatactatgataattaatgtattttcagttactttgtatgtcaaatgcagattcctttaaacctgcagctccatggatgtgtttacggggtttataaaccctttaaaagtgtaatattgcatacacacacacacacacacacacgtgtgtgtgtgtgtatgtctgtgtgtaggaaggtgtgtgattttccaagaatgtattagacacagaatatcagaataatcacgcagaatagtagcagaattctatagagtacaacattgaacaggtctctaaggcacagcccttggggaaggttgcgtttataaggggaaacaaaactcccactttgctcatctccaagtctggtatcttgtgctgatgcaatcaaagttgatacttttttctacagagtctcctttgcacccttttaattttattttcatcctttcaaggagagttagctatatccagaatttaaaggatgtaaaattctttattctcaaagaattattgtgtgaatttttttctctcctgaggctaatatctgtaggttttttctgttattgatgaacacatcttttttatgtcccttttgctatactattgagatgaaagcccgtttgctagggtttacatccaggctgagcagggtttggaaaatccccttcatcctttttcttccatatacttaacctattgtccatgggaatgcttagataaattactttgagcattgtgtttttcatttcttgcaacttaatgttgattattacaattaaagacataagtaaaaacaaaccaacaagcacacaaatattattaaacaacaaaatattagatagcaaatattatgaaataacaaaataaacagacagtttgccatccattcctaaagtgaatgccctggaaggtcaaggctttttccctctgtctagccaactagtgttagaaaggaacatgtgacttaccaaatgtttcataagagtctgagaatatctacagctgtaaaggatttgctgtttttggaaatataaaaaattgttccttttcttcaataccttatgaagtaaaagaaagcaactgaggcatttctgccaaagaacttcttatcttggaagactgaggctctggactctagcacttacaccacatgacatggacagattgtcctctctttcttaaaggtaaaatcaagactttcctatttgtccttcttttcccagaaagtagttgtaagaaccaaaataatacatgattgtgaacatactttgaaaacagttgaagtatgtttttataatctcacgaagtaacaagtgtattgtgttggtaatgtaaatggattgatacttggatctttaattattccatgtcattttactagtcaatatctcaaagaatgagactcaatcacatggttcatggcagtgcatcatatagcatttattcgattcatggtattttatcccatgactctaggtagtaatggcagagtacagagatagagagagtagaaaggaagaaccagtaaactggagtatgttcaaataaagtagctgaacttggagtcaccagtttccaaaaagaacagggagtagaacatttagtcagaaactagacagactagtagaaagatatcaggaagatgaggcaagtggcaaataatcaggtactatattatattctttctttcttaatagtgccttgaatagtactttactgtgatagacattcaataattaaaatagcttcttaaagtttaatctctaaggtcattttaacaatagcaagtaactcattactttcctctgttattttcaatcttacttgaactttgcatagggtaagaattatattggagtggagataaaactagaagatatttatgcataggtgaaaacagcatttataagaagaaaatagatgaaagcaggaagtgacaaaattctgctctgtaaaatttctccaaaagtgagatacgtatatattttcagttatatggcatatttcacatagtattctttggacttctttgaacgattatgcatatacattagcagtaattattttagaatctaatttttatagtcagattcctgaaaggtatttttctcaagacttttctttatttgtattttcagtggaaatttttttcatgcttattttcttattttaacatttgtacatgtatatgaatgaaacaaaaatggttagaaaacatggaaattatacataagtctcataaccaagagaaaatcaccatcaatcttttgatgtcattttttgttacctctaagtctatgtttgtgtgcattgttgtttgtatgtacatctctgtgtgtgtctgtgtatatttacttatgaaatcatgaccagatagcatgtacattttttgttttgctttcaaaattaatgctgcatcaaacatccgaaaattctgttatttataattgttatctttgggaagattggttcaataggaactactcagttttgtccagaagcaaggcctaacttatgttttacttaattatatttgttttctagttcataaatgtaataatttcttaattacatatagagatgaaagtaacttatggtttatatttattgaaatataactttcaccttaatatttgtggttaaattcaatctatttttgtgaagatttgtgaaacacagtctaaaaagcaaaccatgatcacagattacttctgaaatataattcttgactatattggagttaagcagagcaaagaaacatgtgctctttttcaacagtaagaaagaaagaattctaatgtgtttaaaattcagcctaatttatatgcttgtaacagtttggaagttgattaaagtctgtagagtaagtgaaaattacatgtagttctcattttagttgaccttccatgttaattaggacattttttttttccatttattttgtagttaagaacattttctttatctagtaaactttgattctgggttttttttcttttttttttgttggttgcttcttgctttaatgaagttgatcactttcatatcccttttaacttttctcaagatgctgaatatgattttgaaatacaaatcaaagtactatgatgaagaaaatttaggcagttccagttgtctattacttacaagtcagtcatatattcatttaacaaatatatatttaatggtacatgatatggtttggctctgtgtccccaccaaaatctcatcttgtagctcccataattttcatgtgttgtgggaggggcctggtgggagatgactgaatcaagggagtaggtctttcccatgctattctcgtgttagtgaatgggtcttacgagatctgatggttttaaaaaagagagagtttccctgcataagttctctttgcctgctgccatccatgtaagatgtgatttgctcctccttgccttccaccatgattgtgaggcctccccagctacatggaactgtaagtccattaaaccctttttcctgcataaattacccaacgtcaggtacgttacatctttatcagcagtgtgaaaatggactaatacagtaaattggtaccaggagtgaggtgctgtgaaaagatacccaaaaatatggaaatgatttggaactgggtaacaggcagaggttagaacagtttagagggatcagaagaagacaggaaaatatgggaaagtgtggaactccctagagacctgttgacttgggctttgacatttggctttgaccaaaatgctgataatgatatcgacaatgaaatccagactgaagtggtctcagatggagatgaggaacttgttgggaaccggagcaaaggtgactcttgttacgtattagcaaaagattggtggcattatgcccctgccctagagatttgtggaagtttgaacttgagagaggtgatttaggttatctggtgaaagaaatttctgagcagcaaagcattcaagagtgacttgggtgctgttaaaggtgttcagttttaaaagggaaacatagcataaaagtctggaaaatttgcagcctgacaatgtgatagaaaagaaaatctcattttctgagtagaaattcaagcctgctgcagaaatttgcataagtaatgaggagccgaatgttaatcaccaagacaatggggaaaatgtctcaggatatgttagatgtcttcacaacagcccctcccatcacaggctcagagggctaggagaaaaagatggttttgtgagtcggacccaaggcttccctgctctgtgcagcctagggacctggtaccctgtgtttcagtcatgccagccatggctgaaaggtagctctggctgttgccttacagggtggaaaccccaaaccttggcatcttccacatggtgttgagcctgcaggtacatgaaagtcaagagttaaagtttgggaacctccagttagatttcagaggctgtatggaaatgcctggatatccaggaagaagtttgctgaaggggtggggccctcatggagaacttctgctagggaagtgtggaagggaaatgtggggttgatgcccccacaatgagtaccttactggggcaccacctagtggagcagtgagaagagggccactgtccttcagacaccagaatagtagatccactgacagcttgcattgtgtgcctggaaaagccacagacactcaatgccaacccatgaaagcagacaggagaggggctatagcatgtaaagccacagaggtggaactgcccaagaccatgggaacccatctcttgcatcaacatgaactggatgtgagacatggattcaaaggagctcattttggaatttaagatttgactgccctgctggattttggactttcatgggtcctgtagtccctttgttttggccaatttctcctatttggaagggctgtatttacccaatgcctgtactcccattgtatctggaaagtaactaacttgcttttgattttacaggctcacagatggaaggaactttccttgtctcagatgagactttggactgtggacttttgagttaatgctgaaatgagctgagactttgggggactatttgggaagcatggttggcttggaatatgaagttatgagatttcggaggggccggggatggaatgttatgatctggctgtgtccccaccaaaatctcatcttgtagctcccataattcccatgtgttgtgggagggacccagtgggagatgattgaatcatagggcaggtctttcccatgctattctcgtgataatgaatgggtctcatgagatctgatgtttttttttttaaaaaggttgtttccctgcacaagctctctttgcctgctgccatccatgtaagacataacttgctcctccttgccttctgccattattatgaggcctccctagccacgtggaactgtatgtccattgaaccccttttcctgcataatttacccagcctcaggtatgtctttatcagcagcatgaaaacaaacttatacagtttgtgtgccaggtattcttccaggcacttgggctaaatccgtgaacaaaatagacaaaattctttgccccagagaagcttataccttgatggggaaaaggataataataataataataataataataataataataataataataatgcagtgtttctaagtaccatggagaaaattaaagacctaaaagatgtggaggagtatccatgcagttatctaggggaaaagcattccaggcatagggatcagcaagtggaaagtccttgaactaggagcatgcctggcatttgaggaagaataagatgaccaatttggtttaaagaaaagagtggaaggcattgttataggagataaagtcagagtagtaataggggactgattgtatatggctattatcagtacttcacaaagttctaaatggagtgacatgattttatcttgacagggtcatactgagtgcgggatgtggagagtagacattgggatgggacaagggtggaatcagggaaactagctattaggcagttgtgataatccaagtcagagaagattataacttggggccaggatataatcagagatggttattaaatattagggtaaattgaatttgctgacggattggatttctggtgtgagagaaagataggagtcatggatgagtgaatattgttttagcctgagcactgggaaggacacaatagtcatgagctgagatggggatgaatgtgagaggggcagatgtttgggaagaatgggagttaggttttagagatgttaagtttgaaatacttaatcgatatgcatgtctgattatcaggggagaggactatgctggggatacacactttggagtctttattgtatagatggtctttgaaaccatgagactggatgaaatcacaatggtataggtacgaatagagagcagaagagttgcaaggaccgacacatgcattactccagtgtttagagttcaaagatttagagaaatgtacaaaggaaactaagcagtagtggactgtgccatcagaggaatatgcactatattgagaaatatatcaataaattctgagaatgattcaggtgaacttagggtagaatgattaaacgtctgtttacctttctgtctttatccatgaaagaaggaaaataaataacaaacaaggtgtgagattaatattaaaatgtgtactggaaaggtactggaaaatcagaggatgggggctacatctgtatttctgaagcctttttaccctttcttgttttatgtagtaagaaatggaatacaattaattgtaacataagataaaatataatcaaatattaatagaaacaattttgttgctcaagagaatgataactactgctagtactgagactaaagggtattcatgggcaggcaaagatttgtgtcataaacagaaatttggagtgatcactaccacaatggtgaatgaaagatggagaagcctgcattctagaccactgtgcataggtgcatattgatcgcatagttacctttagcactttgtaatgttatctgttagtattagcataatgaaaaatcagaatactaggcctagaagaaaagataatttcaagcaacatcgaggcaatgttgtaagacagttatgaaacactggttctcgaagctggctgcattttagaaaaaccagacattctttataaaggattaatgccacacccccagaaacttctgtatatttggtttgagttaggactagtatttaaagtcccataggtgattttaatatacaactaatgataaacatcaatgtaatggaagccaaggcattgtgtgtgaggatgtgcgtgttttgtgtctaccatttgtagcactttgtgttgcaataggttatcctgattttgtttgtagattattgcatatgcatctgtgcctaattgatatctgtgtgctgcacatcaaaatgtgaactaacgcagctttgcaaagagtcaagtccaaggactaagccttgcaactttatttaaatagtatatagaaaaattctaaaaagaatatgtgaccactaggaataattctaattggttggttagcagttttagcacaatgtctttgataggcccttacatttgccacatagactttgtgcttttactgggaaatgctaactaaaaaaatacattggaatgtttccagtcctaggtcaccatttttttttttttttaaaattacctccctcattagttcccagcattacagtgtatggtacattcacatatacacacacatactcatgtatatcagagtactcagttctgttcatttcctcattccatttttcttttcaaaatttggcaggctatagtgaaaaaactcaggacactgacttaccagaaatgtgtttgtgatgtgctgaaaagttagacacttttctgagagccaggtaggggtcttctccatgtactatggagtagccatttataccagtcattcatgcctgtcagagtatcatgtgtgggcacttaaaatacaacataatgaaaatcaactctccttattatcattatctgtcctcagtaacctaaaatcaagtattaataggaaagaccaactacaggtatagaccttatttacccttaggtttctggcctgcttttcaactctttggaaattctctttgaggattaaatgaacaatgtatacaatgtgcctaatgtacctctgtcactttatctttggttttcctgatacattgaatgttggaataaactgaatcctgatttttgacttgattcttttgttcctgagtgttcttgtggtgaacatgattttaattaccacacccaaagcgttaaaaaaatcatttcctttctacagattctccctgaattctactttttcacttctaatttatttttatcaccatttcctggtattcttttgccatgcttttgaagtccattcctttgttatgctataggcaactgctagcagacctatttctgaaaaactctatttgacaatttaaaataaaagtcttatagtcagaacttggaaacagaacgagaagttggggctagagctaggggaatcactaagttgatgtgagagaaaaagcagtaactggaaaggaccaaaataatggacacatataggtcaactaggcaaatgtcatttcatgcagttgtgtgcctcggaggtcctaatctctaaccagtttttcttgtactaaaatgccattgaatttatagcttaagcagagtaattaaaaagctgagaaattggtgatgaagaatgaaatctggaatggcttctctctctctctctttttttttttttttgagacaaggtcttactctgtcaccagggctggggtgcagtggcacgatctcggatcactgcagcctcgacctcccaggtttaagcaatcttcctgcctccccttcccccagtagctggaactacaggtgtgcatcatggtgcctggctgcatttggccttgctttcttgagattattgcatttatttgtttttcagaaaagataaagatggtgattggttgggtgagttagtagttagggttctttcagtatcttagagttgactccacaaccacagttggaaggaaggaggctctttaaccaaagtatgaactactgttgaaatatgctgatgaagtgtgagaatgacagcagcagattgtaatggattttgaagtgttccaggttttaatagtaactaatagtagaactatagttcaaatctgtaatgacaacattgaaactgtagtcaaaatactaaatctagattgcattaaacctttttatgagaatacgtaaaattatcatatgctaacaagctatcaatctgagttagaaatgcttggcaataaaagtgttgtttcatttgattgatattgaagtagccgtttgttttatactaacttcacattatggtacagatagagtccaaactgatgaaacagatgtaactaataaaatgaatcgacagtataataattgtaaagggaaataatcgaagacaaagaaagtgttttttgagtttttttgctgattgggtggtgagagtggaagagcgtgggaaagcgtggtataattcatagacaaatcctagtatttctctgtattcagtttcatttcactgagttgtctgattgtaattgagttgttcatattgttctcttgaaatgttttgaggcaaatgaaatcttctaagaattcaagtatagtgaaacaatagccacaagacatggtaaacttattgctgatgttaacaaaggacaaaaagggaaaacatgatttgtatttagtagtgttggtgctattgcttggaaccaaatatttaaaattatttgcaaggcaaatagatttgactttaatgatgaattttggtaataaatcatgaagggaatcttttaatctttgaagtaataagctaagcgtgcttttttgtgagatgaattgactttaaaaatagtaataacaaaagtctaaaacatatttacaaatgatgatttttgataggacttttatataaaaatttgaactatcatgtgataatcctgaatttaaaacctaacagttttactggtagaaattttttatgagaaaagtaatgctcatttaagtagattttaaagtaaaaaaagctaagatgatatgatgaattatcttgatgttaaaaaggcactgcttcatgaataatattactatgaaaaaatatttgagaccctaaaggcctataaaggagaaatattttatttaggaaatgaaaaaatgtatatcaggggcaatagcttaggggaccctgagttctattccctattttactgtttattctgtagctgtgagcaactaatttaaccttccaaaatcttttcctcatttgagtaaggaatgactaatactttccagctacatcaataacagggatgccctggtggatgatgatgtttgtaatttagtacattaagctctgtgggtggaaggcaagtactacaatatgcacaagctattatcgtcgaaccactttttgttttaatacttattttaaaaatatttattttgattctgttatgtgcaagggaacaaatgatatgtcctttctgtaaactctaagcctctgaaatgcagctttcatttcttgctcattattgtatcctgtccattcaagctttgcttttaatcttctacatggtaaaaaattaacaaatgtttatttagaccataaatattttgaatggtttcaagttttgaatggtttcaaagtttgaatgtttttttttctcttacaagactgtctgctttagaagaaaggaacttctgtttgctactatcctcttacctcccatcattggaacaaagtgctcagttctggaatagatttcctcactagcatagctataaaatattcttcagaaacatggcatccacgtctttgtggcatatgccataagagcatttactaaaatatgagagaaaggttaaaaattaaatgaatttctaaagctttttaaaaaattgctaaactttcataatctattcagcttctcaatacatgtgagtttggaagacagtaatttctataaatttattaacatttaacctactaaatataattctttgaacatggaatacagctaaatttctttaaatattcttttgtatgtcaagaatttaagaataaagaatagtcagttttcacatgcagtattttgtttaccaggtagaagcctaacttaaactcctatttatcagaccaggatctgatatattttgaatgtcttataaaatatctatattgttcttgtaaaatgtctatctatattgttcttatatctgaggttttacctggggttccctgcctttaaacgttatttacatatggaatattttcatttttctcttcaaagttaaactgtactttggaaaagagctcactctctataatcattactgcacttctcaaaactgccaccttttcttcaggaatatagaagtgggaaatgattctgtaaaatttcaaggaaagagtggtgggacagtaatggggaaataacctctttcccttggtaaaatgtgtaatatatcttttaaaggcaggaaacttgacttgtgaagtgatggtagaatttaaactgcatgcaaagccaaggctctttaaaagaacgtgaattaagtcaactatgtagtttagctcttgggtgatttttttgttgttattgctgtgtgtgtgtttttttttttgtttgtttgttttttgttttgttttgtttttttaaatagagtgaagagttttattcttctatagcctctgaataatggaaagacttcctggtgcctgaattttaaagaccattattgtagtctataattgtattgtactttggaactagagagtactgtagaaacctagtccaaatgccttactttacagacatggaaacttagttgcagagaagtagcagtacttgcttggtgaagagcacgtagctacttggagttaaggtgacaattgtcatggctcacccctcactctaggttttgtggtcctaaagagttaaaggaaaataatttctgactcagatactcctcattccagttagtagcaatcttgagttagtagcatttattttgtgttaaaaataaattggaagtgagttgacaggaatgataaagtttcattgggggaaaattaggattattcaaaggaagctccaactagtcagaggaagcaaccagtaaaagcaggatcttggtcattggcctcgtcacagatttgtctgcactttgacgttttttttttttcttttttaacagaacagtttattgttaatacatctctccttttattggaattcctcttacatgaatggattttgttttgtttgtttaaatagagtaagtgttgatcatggctctatccctttcttttcatcttagttcctccttcagtttatattctctgctctctgtcaccctaaatttattcattaaatttagtctctgctttctgttgtccctgtgtgtgagcctttgcttttcatgtctatatttcagtgaaattgggacctgttaattttctgacacctgtagatttaaatccagtgacttacaaaacaaactcagcaattttggaatgagaggacatctgtgcattttgcattattttttattgtgaacatgggaaggttatgtatgcacattagagagtcaaatttcaaaaattaagtactggatttgcttcatttaattgctttataaaattgaactaacattgtaaatcattaaagtgagaatattttttcccgaaggctctctcaaactctcaagtaggacattactttgtaatttttatagtagttaatggtttccatttcagtattgctattatgtgctaagaaacctgtgtttgatgtagggacctagtattaatgaggcccaagttagtggtttgatttatatatgaaataatttagaaggagaaatgctctctatcaccatacttaatattatcttttattgtagtattggccttgtgccaacacttgattcggagattagtcaaaggtcagaggtgatcatacttgacggtttagattcttttggaagctaagaaagcaaactgtgccaggcccgccctgagaccacttaaatttaagtgagggccagggtattggtgtttttaaaagtgctgcaagttatgtcaggttggataatattggatacattaggttaagtcactgaatttgtcgatagttggctttgagccttctactactttgggcccaagtgggtattctaatggctggttttacatactccttggattctagaatcctgtgatattggaaatctctctttaagtaaatgctgacaaactggttagaattaaatggggagggtttgggatggagtcctggataattcagcgtcgccaattgtcagtgttggaaaaccagcatgcagaatatagtagaactgcatttaaattaaccatacatcaacagatatttattaagggcctaccatataccaggcatggggttagaaaagtcaacagagtagtagattattcttcgcttatggagtttacatccttaaagaaggtggcacatagagaccaaggtactataatatagtaggtccaacccagctagcttccctgcagtgctggggctgctgagcatcaaacgagaagtttgcttggtgttgggagcctgtttctatgaagatatctatcttctaacgctggagtcatcctctgaatccaaagaagctaatactgtgagaggtaggagggaagtaacatgatgaagggaatagcagatctgtgtttgcaatctgacttgcatgctcattaagtctaaaagcaggcaaactgtcaccatgattttaattcactctcttttatgtttcatgaacccacacagttggttttatatatgttcaatgcacacttgacatgcctccacatcctcattgtgtgttattaatactgtaaatatgtaaggcattgttgtcacagtctctgggatcatagacttgattgatttctcaactctgtatcccgaggtggataagttaccttaaacttaagagtttatttactcagccataaaaatggatactgtgatatccactttgtagtagtcttttgcatgtctgagatgtgtaacccctttagtccagtacttggtacaaatagatgcttagtaaatggagatgtttttgttagtataagaagagccacaatttttatttaatacttaaaattgagaaatagggaaattattaaaactttaacatacaacaacagaagagatgtgaaacatatttatgtacattctttcatttagagtttaaaggttttaattacatctgttgtattagttgaaactttcttgaataactacagtgtttttccgtaagtgatccaagttttctattttgctcttttccaaaagtatcatctaacacctgcattttagtacctaaggagctagttagagtggcatagtactcccaaaagtgtctaaggctcgcttcatttttgtgcttaccttgagcttctttgtgtgaccctttactgacaagttttcctaatggtaagggctagttcatcaggaatattctatggaaaggcttatctgtcttctactaaaatagttcattccctgtgactgatctgaacttagaggaaatctggctcagttgtcacctaatgtttgcagaaagattcagagattaataaaacatgagtctgtgttgcttgagactgtgtcacaagtattagatccatagcacttctgggagcatttaataagaatagtcaagaataccttagcatttggatatcaaacctgattaggttttaaaccagtcttatcaggttttccttgttactgatttaacttaaacattgcataagatcattggcttggaagccattcaactctccagccaggagaggtacctgttctctgtgttctaaaagtacaaagacaaggctgatattgataacaaattacgtaacaaactcataaatacagctcaaaatgctatcattagctgaagctatgcacaccatggctggtgggcatttacgattgaggaacttatagcatgttagtatgaatggtcacttgactagaaaaagtaataccacctccacttcatatcaattataaaagacttcagaaggcattttataatctaagtttttattctctggaagtatttttattttaccacttcatttcttttcagttaaatattacctcagcctttctttctcttatctctattcaaatgatatcaaatctcaaatgacatttcaggcacttaaactttaaactcagaaatgacttttaaactgaccaaatgactttgattgtttgtgtctataaagatatgcataagattgctaggaaaattgaatatacagacagtacccctaacaaaagcctgaatttggcctatgatgtttacaagtttacaagtgtttattcacatctactttgtgttgtatattgtgctagattctgtaggacactacagacttccaagaaatcagaagaggttgaatcacagtgctcattagacattctttgccattttcaaaatatatctattcagatatatgcagatacagtctacgttacaaacctattcttaaatttaccatgaataatacagaaacatagcttatcaaactcataccataactgggaaaagatgaagtcatcgactctattacagcactgtttatagcagcactgtttaataagctcagatttagatagacaagatgacaggaaaaggaaagttttaaaaacttggttcacaatattaaagacttcatgggcgtttgggttaccctaataggaaaaccagtgtgcaggagaaaggttgtgactattcattactatatttttcttaaaaatgtacaagtttaggctgtgtttatatatgtgaaatcataggtgagattaataattatccatatactttaaaatacccaataattgctgcttaggaggaggttatttatttatttatctgtctgtttaatttgtttggaagatgtcaatcatcattactgttaatgaagcttacttaacaatgccttattaaggcctctgctttcctttgtaaatgttaccaaaagcttagcaagacttgggagatattcatgacaataaactgaaatgtttgcattcaggtttcaaatcaattatatgtttctaagtatgtttttatatgtaaaaagtattcagtaaatgtaatgcaaacttctgtaactaactggcaagtttaggtagggataatatgtcccccataatacgacaagataaaaaaaattgtttgaatgccgtttgcttttaagaaatatattaagatttgaaacttaaagttgagaatgtataagaaaaattatgccttgaagaaactcatcatgactcagaatcacaattttgttagaattttgttatatatcacagggataaaaaaaagttttcatgttgggtaattttataaaaattgaatgataaaatttgagtatggtctattttttttgataaatggctatgtaatatagagttttaataataacacccaaaagttcaggttcaggttttggctctgctaattactaactcttatagttttggttctctcatctataaaaaaatgagacagttaaatatctattccttctacttttgaagtgtagcatcgactgatatggtaactaactaactgtgaatgtacgtatagaaatgccatttggaagggcgtcttctgtcaaaagcaacaagtaaaaagagagtgctataaatctaaagtctgggcctggaagtaaagacagaaaattctccaaatagatttacaaaggaagaccttcctttttgatgggtttaaaaaactatttgagttgttttgagaatatttttacttagctatgatttggttagtcattaggggtaaacctagtagatagaaatgagtgttcagcaaactgattcccagatgaaagagaaatgatgtttatgtctgtttccagtgagactgcagtttatgagccaagacatgggggtgtgaaggaggtttccagacatgcaataggaatggaggcaggtactgttttatcaagtagtttagaacagaccattgatatgaccaactctttgattttgaaaggtattcaagtcaacttagattgtattgtagttcctaattagccatggcattcagggacaatggcaatttatttattatttatgttatgtgcatagcaagtcattggggggatttgtactgtgtagtcacccacaaactcatgctgactgaggctctacattttgtggttgcaccatttgggacacagaactttatcttagtggcaagaaaagacagtgactggagaaccttcatgggtgttccgaagccttatttaggaagtaacacatgtcacagctcattagtcacaagtgacattataccatctaactgcaagcaggatgagaaatgtgggcagcagacaagtgcttgatgtgcatcttcatgtgtaacacaaaataaatgttgcagaagagggtttcctacctcattctaccattttaagtttatagagttaaggtaattaaagcaaatatgacttacattactgaattcccagtgattctttttcttcctaccgtggcttctctgttttggcagaacttcagttcatgaggacctatttcataatagtcaaaaatacatcaaattctaatttatactgtgtcattggcacatagacatctctcttttggggaaagtatttgtaccgggctttctttgttgagaaaatttacacatatttatatttatattctgtaattttttctctttggaattttgttattaaaggtgatctatgcctccattcaccaatgctattttattttatatgagcccttttcaaattttaatctaacaattaaatttcatttcagcaaactggaaattcaggggtccccatctgtctttttaaaggtgaaaactaggatttcttttgtgcttgagcaaaaagctggacagccaataattctcttatttgttggtgaatgaggaatcaaaggttacatttataaatcactttaagagcataatttagatccttgttttgaaatcctctatagaatagtatatatgtaaaatgatcttattatgtctgtgtgcccatcataggtttaaagacaagttgagtacacaaattgatgtaatttggatatatatccctgccaaacctcatgttgaattgcaatccccagtcttggtgatgggggccaggtgggaggtgattgttcatggagacagatctctcatgaagggtttaatacaattcccttggtgctgtcctcacaattgtaagagagtttaaaaatatgtagcactttcctccttcctcccttgctcccactttcaccgtgtaaaatgcccgcttcccctttattttctgccatgagtaaaagctctctgaggcctcaccagaagcccagcagacatgctcagcaccatgcttccggtaatgcttgcagaactgtgaaccagttaaaccccttttctttaaaaattacccagattcaggtatttctttatagtaattgcaagaatggcctaacatataaagtgtccccttttgtgctctaagatacgaaagataaatttatattagtgcaaatctggtttgtatcatactctgttaacttgttgaggtagtatatgattgggtgagaataagctggaaactatggaatgtgctatttgcacaacatttgattgacaaaaatgcctttatttagatgaactaaagaactttttattatttaaatgtagtcatttgccacataatgatgttttggtcaatgatagactgcgtatatacaatctgataagattatactactatatttttatagtaccttttctatttttagatatatttagatataaaaataccattgtgatgcagctgcctacagtattcagtacagcaccatgctgtacaggtttatattgtaggagcaatagactatatcatatgtaatagactatatctattgtataggtttgtgtgagtaacactcaatgatgcttatgtaattaacaccctatgatgtttgcacaactacagtgacattcttagaagctatcctcatcattaggcaactcatgacatatatgcatttatttgtattaactgaaatttatacattttataatttaaaggatcatccagtgtgctcgcatagaatcacacctgtgctatgaaaaattataaacaaaataacaaaaagtaactgaatactgtttgttttttaaatatagaaagggaagtttagttacactgaagaaaacaggtaactattcatgggcacaaactgaaaatgaggggaacagattctctcataggtgaatatttttctttcctgagatagtagttttatatgtatggttttgcccagggactacccaagtatagagtttgtaaattgaatggttgcagtaatttctggaatccctataaactatgctaaatatgaaacattctaaatggttggaaagctagtccttataaatttagatactcaatacttagacatatttatttcaagtagttaattattcttaatttgctctgaattcttaagtgtaagaaagctataatgggacagagggagacctatatcccattttcagtatttcaaaaaattcagtatttctgaattatgacacaggttatttcatgttactcaggagctctgttgggtagtatttacataagtaaaactaaaaggaattttaatgctagcggtgcaatgttgaaaacaaactaaggctagttttggttgtatagggtgtagaataacattgccaccctacactttttagtttcctagctattaatttcaccaatgtttatttaaaagcatataaaagtttaattgatgctcatatcaacatgaagggagtcacacattaggtcctggattatgaacattttgcagaattagtctaggaattctgctatggaaagtagaagacatagaagaatgggtttggaggtgaattactggcttcatattcaccatacttattaggttaatactctttatatgtttctcaaatgctaattagtgatttaccttgacgttatataatagcagctgtcatcacatctcaatgttttgtgactactttttggctctagttgatgaaatttcaaagagatggagttgagtaggaaaagtgttggaaatctgtgccccttactggcccatgattttaagaacattagtgtctcatctgaaatacagagattaaatgaggattaagtgaaatgataatgtgtcaaggttttagtactctggcctgttacttgtttttctcacttaaagcgaccaggtcccgggaaataggaggagttaaaatttcttaaactttgataaatttttgttagaatgttgtgattttatgaaatgatctcttaagcgctgtcattctcagaagatcatgggttgtcttaaagtgcttttttctgttataaaatcttggtaaaattcaactctgagcaacaacaaatacaaaattgcctataaagataactagtttttattttgaaatagatatttattgatgaagaagaccttctaacttgtaccactcaagaagcagtgaattgaactaatacagtggaaaatgcttgtgaaaaagaccagcattcctttgactctagactaaaggataatgccacctgagcaagctactgaattattgccatgcactctatggctaattcttcacttattaattgagatagtaggcaaacgctctttcacagatgtgttatggattattttttattttattttattttattattttttttttatttttgagaccgagtttcgctcttgttgcccaagctggagtgcagtggcgtgatctcagctcactgcaacctctgcctcctaggttcaagcgattcttctgtctcagcctcccaagtagctgggattacaggcgcttgccaccacacctggctactttttgtatttttagtagaggtggggtttcatcatataggttaggctggccccgggctcctgacctcaggtgatccacccgcctcagcctcccaaagtgctgggattacaggcgtgagccactgcgtctgtccctggacctttttattgaactacaaaaacaaacagataactttcatttttggattactattaaatgttgtcaaactttattctttagggaaaatggaagtataccactatacagagaataactttgttatactcaaagatagaaaatactgccttggctagatgtggtggctcacgcctgtaatcccagatggggtttttccatgttggccaggcttgtcttgaactcctgacctcaggtgatccacccacctcggcatcccaaagtgctgggattacaggcgtgagccaccgtacctggtggaaattatcctttataacagtcaaccactgggttgtatggttgccctccagtgagatcctatgctacatttgagtgccagtatcctggaggagtctgtatcttagtgaaagcaagggcaattagggtattgtctacagtatgcatcctatttaactggctgtcatgatagaaaccgggagcaataagtatcacataagtaaaagctgttatctccatgtatatcattctccccacttttctccttctgccttcaaatctgagcagtctattataattttaggagctgctcttcctaactgaaatatattgctgctttccagctgctgcctgcagatacttaaaaattgaagcaagcctttcatttcatattatctttctaccaatccatgtgctgaggtaatgcactggatatttttgtcattcagccgagcaagggttctatttgcatgatttatcaagttaattatttgctttgaaacagcagacttagaaagacatctcacttctaggtattctgctactgaagatggcactgcattattgagttattgtactgtactgtccagtgaaaatttctggtagacaaaacctcccagtatttggaaaatacccagagctctgctcaagattcttcttttcacgtttttcttcttattgtaccatgtctgaaactttgggatgcatgacctcatctattaaaatttccctgtggttggagcagtgttttcattcagctgcacactgttgggttactctgaatatgtagcaggtattgaactcttcaactgccacaaaccccatgacccatggtgaactgaaagcaagggtctgtatgtagaagggagtgcaggagcactgccacccctcaccaccgatggtgtctgaatgggattgtagagtctggcctgaatatgccctctccttcagggccaaggaccattatagtaaattgtggttattataagtcaaatggaattgggtctctggtttatcataattgttttgaatttcatttggctgttctgaccactctaacttatgaaggaggtagccaattttgatgtattttagtattaaagttataaaactatattgaatttaactttgggataagctcacagatctgaagtaaaattgtcattcatacggcttcactgagtgggcctatcctgggtagatgctaatgtttttcatggaaatttgctgtgtgagtagagatggcaaaacgggtgactgaatgatgtaatgtctgtataacatcactaccacttactgttaaaatacagcagcacattatctatttacaaaggttgcactgatgaaagtaatggttacagttaatttggacagagattttataaataaatagttacaatatcagcataatcagcaataaggtaattgtaaggtgccaggaatggaaacactgtagctttcatatttctatcattttgaaaaacaaagacagttgctcttgactatgaatatttataattatttgggtggtgttgatgtcttctggctacaaagagccaactagtctataaatataaatagactgaggctgggaacagcgtgtacagtgacagtgtccagaaatgctgaatccttaagacttacagtggagctagatgtctgggatctggggtccccacctagacctgaaatgtaggtctcctccccatatctctctcctgctcctgcctttcttgccctctcagggaagtgactatttcctacatgatgttatacaactggtaaaaggcagttggtaatcagaggtctgtgatctctgtctttgtttctttcctgtgcttaatattgtgatatcatataaaactattaaaatctgaactctgatccatagctgattaaacagttactgagatatacctaccgagtgagctgacttgaaaccttgatttaatataagcataatagtagctaaatttcattgtttcattaggtaattgaaaatacaggcaaaagaaaatgtgaaggagaaaaattttatctgtttcttggttcaggaaggatggatccctgtgctctgtctcatcttaatggacttccagcctccatcctcattcttaaattgtgtctagaaattctcttttctacctctcttaggcttccccagtattcaaaccccagctccaccatggagttctgcctttgtgtaaagttttggaatttatatttcttctgctacttctctgaaacagcattgatacaattgtagaactagagaagctatatgctatgttagaaaaagcacaggactaaaattggacgcaggggtatggcttacaatttcaactctgatcctggttgtctgagtgacatagaatgaataaaatagttccagacccctattgttcatactaatttggaaagtgatctgaagtagaaatgtaaatttatgcatcatcagaatgaattgatggtgaagccatggggtgtgaaaaattatccatgaaacattgcaatttatgatatgagaaagaaaagaaacctaaatgaaagccattacttgaaggatggacagagaaagagacattaataagaaaattgaagagggtcatcagagaagtagcaggaaaaagaacaatagttgtttcgtgaagggcatgggggagggtttcaagaaggcagaagaattgccaatagttctcattgctttggaaagatacagtaggatgagaaatgaaaaatgcctaatagattcattaattaagggctcattagtgactggctaaactagtttcagctgtcagaagggtcaagaataaagttgcaatgaagtgagctcgccatgcaaatgaggaagtccgttgattataccttcaataagctcgattaaagaaaggagaaagagtagatctggacttgaattgttgttgttgctgttgttgttaaaatggaggagattctatgcaggggccagattagtcaagggggtagactaaagaaacaggagaagaggggtttaattgatgtttgatgtggggagagggactggaagaagataaaaggaaatgagaccttgcaaatagagagaagggttagccttaaacaggacaagtaacacctgggacctaggcatttctctatttgactaagttaaatatattgtgtatagactgattttccatttacttacttttcccaaagctatttgccttttaattgtctcactgatttttaacaatttcagaaaaggatgggttgaaaatgactaaaggaaaactgcactcagcagcattcttaaattgtgaaattctagtagaaaatatgtttatgtgtagaaaaattgggaactttggtaaagaatttctttttgtttatttttatttttatttactttttttattgtactttaagttttagggtacatgtgcacaacgtgcaggtttgttacatatgtatacatgtgccatgttggtgtgctgcacccattaactcgtcatttaacattaggtatatctcctaaagctatccctccgccgtcctcccaccccacaacaggccccggtgtgtgtaaagaatatttttttaaaaatttacttgaatcttcttcttcgttccccagtttttagaatttttacaatgtctatgatacatgcacctatacccacatgcatgtgtgtgtatattattaatattcggtaaagagaggctattttacacacaataggccctctacaaatatgtattgaatgtgtgttaaaggcacaaaaaatatttttttctctggataaggaaggtaagggaaattaaaagactgacttaatgtcaaatcttaagtatttttattctactattttaaatttcaaataatttagatagcatggatagaaatttattttttggtaatttgataaaatggtttgctaggcagctttaccctttattctcacttttggacgttgcataattactgaactcagttgttctgcatgtaagtgtaagaaaactttcatcttcacatcagaatatttggattgtaaacaacatttaaagaatgtttaggtgttgtaaaacaatgaagtcaatatactcttaagaattttagagttagctgttaccataagggaaaccagcttttttgtttctgtgaatataattgtaactctccagtaaagtgttaacattcattaaaacttttactagttgagttctggtttctgtaaaatatttgttgatgaaataatttcctttaagaacatgctataatttgcatgtaattacttcagcctgaccttgaacagataagggctgaccattggaggctgaaagcatgtgtgattaaaagttagtctagatgaaagtggcctaggcttgaatgtgagcttcatcatgtattagctgtgtaatcttaagcaagttagtttaaattcctacgcttcatagtccatgtaaaacaggaataatactagtgccctcatactgtcataagaattggatgagttaatacttataaaatgcttagcacattgccttactctttctaatcatgttaaccattcttattgccagttatatagatgcttatgtggtaaaaaagacatgaataaaaatacaacaaatttagaatgtgtgagatatatcgtaacattaaacatgtaaaggaggctgggcgtggtggctcacgcctgtaatcccagcactttgggaggccgaggcgggcagatcatgaggtcaggagattgagaccatcctggctaacacggtgaaaccccgtctctactaaaaatacaagaaattagccgggcggtggtggatgcctgtagtcccagctacttaggaggctgaggcaggagaatggtgtgaacccaggaggcagagcttgcagtgagccgagatggtgccactacactccagcctgggcgacagagtgagactcagtctcaaaaaaaaaaaaaaaaaaaaaaaacataaacaaaaaaccaaaatacatgtaaaggattaaatgctagaggcttatcccaacttagtaaggaatatgataattttctgagacataaaatatatgctagcttccttacggtatatttaaccaagaaaacaagggtagcattattcaaactactcttaatttttaaattcaacttttatttctgagataattataaattcacatgcagttataagaaagaatacagggagtttttgtgtccctttatccattttccctcaaatgtattattttacattttgcattaactgtagtacattatcacaacttggaaaccgatattgatagaacctgatcttattcagaatttaccagttttatacgcagtcatatgtgtatgtgtgttatttccagttttatcatgtgtagagtcatagtaactaccacgataatcaagatatataacagaattttttttgtcacctgaaggatcccttgggctaccttttcgtagacacagccccctccccttgttccttcagaaccactcatcattactcctctgtaacgtcacaatttaagatttttgtataaatggaatatgtgtgtatatgtatgtatgtatgtatatggtatgtatgtactatgtaccttttgggttcagttttttcaatctagatattcccttaggatccatgcaagttgtgcatattaatagttcctttattctgctgaatagtattccactgtatgccattatttatttaactgttttctcattgagggacatttttgtttttttctttttggctattacaaataaagctatgaacactcatctaaatgtttttgtgtgaacataaatttttatttctttgcaataaatgcacaagagtacaattgctatctagcatggtaaatacatgtttagtttcataaaatactgtcaagctgtttttcatagtggctgtaccattttacattcccatcagcaatgtatgagtaatccatcttcaccagcatttgatgctagcactgtgttttattttagctgttccaatagttgtttagtgatctcattgaaattttagtttgcgtttctctaatggctgataatatcaaatatgttttcatgtgcttgctaaacaactgtgaaatgtctttaatgaattgtctgcatttgctaaataaatagttttttttaagtgctgagtgttcttttattgatggttttcaagatttttaatgttctgtatttagtatggtaaataactgtgagtttgactacctcatttctgtatacatttgtaaaaaatgacagtttttttagtgttttgacaaaaattttcaaaggacattgaacaaactattttattacttattacaaagatttatttgcacagtttcaactagcatatcattttcatattcctacactactgagcaaagtgaagactatttgcagtcattataagatgttatatgtgctttgttaggggatactgctgtggaaactcatagcctttgagaatttgatgtctcagttgggatctgtctatgaataagagttctccaggcagagacagaggggagagtggtcctccatgcagagggaactccacatgcaaagacctggaggaatgagagtacgtggcactttagaggaaataaaaaaagttcagtatggctgcagcatagaccaagaagggcagtagataagctttgaagataggaggggcaggtcataaagacataatctatgttaaatactttatctttatactagggccaaggaagaggcaatcaaatctggactgtacagtgatctgcaactagaggtagttgcagaatgaaaaataaattataggatagtgcaactaaagcacttaatattgtatagtagtgttttacatttaaagttgttttagtgtttatgtttgttttagggtttctgtgatttttactaatggaatatttcttttttttttttttttttgagatgaagtctcgctctgtcacccaggctggagggcagtggtgcgatctctgctcactgcaatcttcacctcctgggttcaagcaattctcctgccccagcctccttagtagctgggattacaggtgtgcgccaccatgcccggctaatttttgtatttttggtagagacaggtttcaccatgttggccaggctggtctcgaactcctgacctcgtgatccacctgccttagcctcccaaagtgctgggattacagaattgagccaccacgccaggcctactaatggaatatttcaaatgattatatactaatcagaaggcccaatagaaaaatgtaaaactgactgaagttgagctacattgaagaaaattgagatggatgatctggaccccagaaatctgattccctctttcaacatccaaccagaccttgaccccatctctctaagcccctactacagtgttcctggcaggctggagtggactgcaaggagaccctttgtcattttgactatgatatttagcttttatttgtttcatgtaagtttcattgcacgatttcatttttgaaaagattctccatgaacaaaatgtttgaaagtttttgcccttagggttttgggagttcagactggtaaattctaattttaagaaggggaattttaaactctggggtacattttaaggaagaactaggtgagaaaatgagctaccaggaacattcatttaatcaatttacttgtgaaaattacatgagaaactgatgatctgtattttatgatattttttctttatttttgaggctgaagttctttaacaaacttttcagttatctatcaaatgttccttcagatatttaaggaattatagtgatgattttctctctctcctttttgtctgaacatgtcctgtttaaattcgcgttcattttctaccacatagtacacactaacctctctgcctctataaaataagaatactgttgatgtggatttacagatgtctttttcccgtgtttatatcaccaccgcttattttggcacagtaatgccaccttttatttacttaaagtgctaagattaggtttaaaaatctcatttatcaggcccttgctcttcaaagagtagaagatggtagaagttataactccaagactgaatgagtcatgtttcatctgtagactcagggctgtctcttttagattcctggctaatttcaggctttgcctcacttttatgattcatcagcacctagcgaagtatcagacatacttgtttgtagaggtgcttagaaattgaagaagagttgaagtaaacttgtcactctttttttttgcttagcttcttttaggttagagggctaagagtatgacattaaactggagataaaagactcaatttagtggctctaaaggagttaatatggtttgcacattgaaagctctactagctaacaggtaatataagcttgcttggtgataacttttcattttaagagtaaatattaaattgtgttcaaatcccacatattttggcctcatggacgtataggcccagtgtttgcattactttaagttattctagagtaactagaaataccaattgttacgttgaatttttctttaaaaacattggcttaaatatttacaaagcactgtgcatgtcaaacaaaacatttctggagacagattgcacctttcatccatctgtttggaagccttgatctagcatactcattactggattctatcagtggtcgttggattgatgaatacctttctgtgcactgcctctaccttctgttttcttttcctttttcctttaagggcatttgatgctgttgataagtctcctgttcttgaattttaacaaaattaccttcctctacttctacttttgcactccaacatatataatacctgctgattgcttcttacaaaacactgaaggctttaaaattaagaacacttttatatctgaccctgattgctacctttaatactttctaccttgctgtgagctagcccatgggtgccctgtaaaaatctagtgtctttgatcctccaactcctttttctggcctgttatttctggctcccatcctgctatttggagtttttatttctccccttctgccatccccatcaagtgaatgcatgtatcagtccatagacatggacttagtacatagttttcttagtacatgattgcctctcagtgctgctccacattctaaaactagtgggtggattgcccatatgtgctattcttcccgggacagtaatggttcatacctgtagcctgggaatatttattaatagtgccctgtttctctgtgcaaaactctgtgttttgctttggaggaagacttatgtggtcacctgacccataagtctcctataatcattaaagagtttccacagttggcaaccttgcccaaatcccaatgcttaaatagattttaaatgcttaaaatttccttattacccaagtaaaacagaacaaatagactataacgcctataccctttcaacagcacttcttttcatcaaaatttttcatgtattttacaaataaagcctatgacacaatgatttttttattcttttttttttgaacggtgtgaatatgtttctgtctttctctcccttataacagaatcagcttctgaggatatgctggcttgttttttaactaaggtggtaaaacagcagcagctctttacctaaaatattgcagtgggcacctctcacctcacatttcatttgttcaattatttatatttggtacaataaaagagaagataaggcagagatcatgaaagcattaaactacaatgaatttctgtattttcctgttgatataatctctcattcatctgcaattgtacattcaattataaaccactatccagggagatttagttcttgaaaaaaatctactagggaatatttatgggcaaatatatttcagtgttttatttcctgcttacacttgattaaatgaatatgcagaagaggtgtgaggaatggtaacactccatgattttaggtttgctatagtttattttccattgctctaggttgacagtgaagtgttgttcatgtttctggacatcagatttgagttctttaggtttctcttgggaattttgtcttatgccttattcatacttcttttcatgattttaccttcatttctttcttttctggtaattgccttcttatgtggaataagggagggcaagtatagtatggaaatctctgtttgcaaaagcccttagcaattactaacattcttagataggtggatttttattcgctttcttatttaataaggacacagtcatttctatgctgtggtgcctacatatttttattcatcagtagccaaattagtgattatttttcttatcagtgttcaacaggaagtttgatttactccacctccaatttagaagttaaacaaattgttatagagctttcaggttttcatacatatcttattaaagaaatagctaaaaatacttaataagtaactgaaaagtaattctcttcaattcgaccattatattggattatatttccagtaaaacttctcaaagaatggaaatagggaaaaataaaaatcgatcatacatttgttaacaaactaaaatatttcagtttacaaaaggaaacggattgtcattcttacagaaaattttgtaaacttatggctttaatattcaccatgaataaaatacaataaacatagtttttaagtacaaatatattttaaagatttggggaagggtttttgttatgttaatataatgaaaagaaattattttaatatatctaacaaccattttatttgcaagtgaaagacacttttttattggactagagatggtggatactgagttcaaaacttcatctagtagtctccatctggatttgactaaaatagcttctttttggcagaattttacattttgggtctttgcttaatcagatttgtttcttaatattgcgttctttcatatactgaattgattaattggaaaatttatttgtgttttatataaataagtatgtacttggaaataatgtagcctcatttcatgtttctgtaataataatgctataatgactcttgaatatttttattctccacagctttttataaaagtatatgtgttgtgtcaaagctacaatagatgatctgtacttgaaagccatatcttaactttttttgtcatatccttggggtaactgacatagtctaattcccataggtattgtatttctgataaagcaagatttcaagaacttagaataaactttatgaacaaaaataaaatcgacgtattaatgttgctattttatggaatattatgatggttgcacttttaaattttaattacaacgtagagatcggagtgttataaataaataaaatgtgggaaatttttagatttcttaaaaagtttatttcctgataatgtaacttagtagctcagtttgtagtgggttggatattaatgtatttctctcttttaaaaccatgttttacacgaggaaaaacagtaagtgagcttaaaaaagatctgacagatgagattgctttaccgtgtatttatctactgtccccttcccctcatacacatactcacatggggacttttacagtttaaatgaaaaccataaaggtccctggtataggtttgactttcctgcttcttaaaaacatataaacaaacaaatgaaaaaaaatcaacatatcacattgacccttcttcacggtaaattcatctccagtttctgcaagtttagaggaccctaaggtcctgcaattaatttagtcagttctttcagttgcctgaattagcaggatttttgtgatgccgtatgataagagagaaggtataaatagtcctatgataatatcattctcacggtcataaagggatagaagttccctgagtcagcatgtttacaaggcccctcttctcacttgtcttccccttgttccctctgatcccatcaagcttgctggtgaatcacacagatttcttttgcagtcagagatcaaggttaaaatagaaatttgtattattgtttccagtgagataacattatattattcatttattaggagctttatttactggtgcaggatctcaatccaaagcattttatatactatatgaaatagaatggttttccttttcttttgctgtcaatacaatgcagattccatgtctctcagtaaacaggcaaatcttagtgtttttagcattttaatcagttaaagtattgtcacttaagatcagacttttgttgcatgtaaattaatgttttcattcctttcctatttttatagggatagcaagcatgagattgtcatttgttgtagacttcctatgtgtcaagccttatgtttagtgctttgctgatgttttccaatatattcctcacggtaatcctatgaggcaggctgtattatctctgtttgacagatgaaggggctttcttccagaaaggggaaacaatttgttcaagagtgcacatttgacaaggaaggttccagtaattaaactggtttggtcttactccatttgtattgaagggaacatttacaggctgtataaatgttttatctttctttaagatctgtctgtttactgagagaaatagaattttcactggattaatttgttaggcaactaaaaaataaagcaattctatttcatgtaatatataaaatattttagattgggactttatatcagactattagtaaagttttatcatactatagaaaattggctatatattatactatagaaaaattttatcataccatagaaaacttcaacttttaaaaatgacaggattacttaagatcacacaaaaaagactgcttctctattttcatctttatctgtttccttctttaaatttaccttctttgaatattaatattttttctacatgtcacttaaattctatgattttcagatttttaatctataaaatatatggcacaatcaaatgatctcccaggtccctaaaaatcatagaattctatgagattgtggccactcagagcatggcagggaagacatcagtaatataatatccttgtatccttcttttctttcctgcttctgattgttattcattggaaattttttcagaaagcaactctataccaaggtgaaaggagtttctttcttgcaagataaataagacatttacagcctgaaatatataccttttacaatataacttaaaaaatggatacaagaggtattaagaaaaaacacctaccactttcctttgtagttaacgaagattgagtgcttctattttgaggattagacatatttaattttaatggaaataaggcttatacatttagattcattatctcacagcctttggtataacaggtaaggtttcattaaacaccttaatgggaaaccagatgtatcagtgagaagggatacaaatgcatgtagtatatattctccttgtatggtgattagcacatatattatctctccagcctgagttatgtactgaagaggaattctggactgcattggaggagaaataaattgaaaaacattcttgcttctcctgaagctaagcttcgcatcataacctaattatttgtttctcagatgttgggcttttctcaaatgtcagtgattcaattagccgatacttattgatccctgaccccgtctttagtacaatgctagatgctgtggtttgaagtagtacagggtattgccatcagcaagatgacttgtcttcttgaggagatcgtgaacatactcagaataattaaacagatgacaggatgagagcagctactgtttatttgatacttacattatgccactctcagagattttgtttaatatatgtagtgggaacaaaagtgcatctttttgcctgtatctaaatgtgtaattctctttggtgtcaaaccaaaaaaaagatatatattccatattaaaaagtgcttaaaatagcattcactgaagactccctcagatgtatgtgtatgaatacatgtatctatgaatttatgtttgaatgtatgtatgatatataagtggaaaaacttgcttagaaagaactctctctgacttcttaaagtcctacatcacatagtagttactctgatttttgtgcatctccaccaaaaaaaaaaaaaaaaaatcacctggcttatactgagacctactttccccccccattctcctacattcaggataattttcttctgttccccaggtaactttttaccctttatcatataatcaaattgttttctctagattaattaaaaaatttcccaccattttttcttctgtctacagaggtaccaacaaaagctgagcagtgcagacaaaagtcctctttagaagtgaggggtgggccaggcacagtggctcatgcctgtagtctcagcactttgggaggctgaggcaggcagatgactttagcctaggagttccaaaccagcctgggcaaatgacaaaaccccatcttttccaaaaatacaaaaaaatttgtcagtttgatggtgtgtgcctatagtcccagctacttgggagactgagttgggaggatcacctgaacctgggaggtcagggctgcagtgagccatgatcgccatgatctgccaggacaacagagggagacctttaaaaaaaaaatcacgaggagtgattggagggggtggataaaagactgaataatcatagtctaattttgttgaatcaggctgcatacagcctgattgtacgttatagggtatcatcttatgttttacattattttgataaacacagatctccaattgttagcgaattcagcataagaatcctgatgtaacttgagttgacctttaaaagatgagtgtgatttcatttactaaatggtgatgggagggtttctgagagtgggagcagtattaagtggatggtgagaggatggcataagaaacatattcaccttggtgctgttgatcaggatatagtcatttacccatttagaatagagaatccatgtgaggaagtttagcttcgttttgggtgagaagaccaaggcagtattgctgagatactagaagccaaagcacgttctatcaaatgcttggaacacttgatagaataaacatgttctatgtatggccccaacattcctataaggcagatagtattatctctcttttacaaataaagagcccaagtctataaagagggaagtgttacgaaaatcacttaacttataagttctgatgccaggatttgaaccaaggttgatctgaccccagagttcactctcttagctataggcttagaaaaacatacaaaattgcagatgtttcttagcttaagatctgtcgtgtttatttcagctggacttgggagatataaggactttggctttgtatattttgtcaagcagctaaaaatgcaaacaactctgtttcacgtaatttatgaaatgtttttggataaagcatttaacagctgactttctatttaaattcctcatttgaatggagtttgttaatagaactttaactgtgctatagagttaacctttaagaattttttttatttaaatgcattcatattctagttctttattttattttttgtctttaaatgctagaaagccttgtgatactcttattaatgatgaaaatattgattcttttttcttttctttttttttttttttgagatggagtttcactcttgttgcccaggctggagtgcaatggtgcgatcttggctcactgcaacctccgccttccaggttcaagcgattctcctgcctcagcctccagagtagctgggattataggcacccactgccacgcccagctaatttttgtatttttagtagaaacagggtctcaccatgttggccaggctggtctcgaactcctgacctcaggtgatccacctgcctcagcctcccaaagtgctgggacaggcgtgagccactgcgcccggctgattcttttttattttcatatagacatatatatatcatctgtcttactgcgttacgatatccagaacaacattaaataaaaagatagtagacatcttttgtacattcttgattctaaaagaaatgtttgtgaattttcaccactgaaagtgttgactaatacagtttttggtagctgtactttttcacaataagaaagatttaattcaggcagtctctacccaccccacccaaaaaagtttcttctttgaaaattttctgtaataaacctgttctttaattttttaattgtttttttttagaaatgaggccttgctatgttgcccaggctggattcaaactcctgggctcaagtgatcctcctacctcaggctcttaagtagctgagactacaggtgtgtgctactatgcatggcttaaatctgttctttagaaaaaaaaatttgtagatatttcttttgaatttataatactttttcccttggctctaccattttaattttgttcacaatttagattttattttgttttaaaactgagaatcaatttacaatacacttctatataatttatgaaaatgtattagagatccagcacactgctattcagggtggtgatgggacagaggtataactacataatgagcctttttttttttgtcataactgtgtttagtttaaatacttcaatactgagataaataaccagtacctggctttaatcctccttggatctggcttagtaggcaattacaattgaccatctccattcataattttttgtagaattggcttttggggctttggtgaggtagagtaggcacttatagaaaccttggtctttgtaacaagtagaagctgccttcatgttactaattattatttaatttctataacttaaaaatttttttgtgtgtgtgctgaaacctaggatctattttctcttctcttctcttctctttttttgtttgagatggagtctcactctgtcacccaggcttgagtgcagtggtgagatctcggctcactgcaacctccgcctcccgggctcagacgattcttctgccccagcctcctgagtagctgggattaccagcatgtgccaccacacccagctaatttttgtatttttagtaaaaacggggtttcatcatgttgtccaggctggtctcgaactcctgacctcaggtgatccgccagccttggcctcctaaagtgctgggattacaggcgtgagccactgcgactggccgtatataccttcttatgccttccattgttatgtaaataatttgaagttacttatcactaagataattggccacatagcaaagagaaataaggaaaaatgactcttgagctgtaggaatgcaaatataatttaaaaatcaagtccatgacaaataaacctgtattctccaggcagtaaggcctacgttgctgttctagttgaaacttaaatgagatactaagctttctggtaatcaacttgaaaaggaatcatacaattagttatttaattttcactttacttttttaatggcaggaaagcctttcctagcatcaagttctaaacctgcaggcaaagacaaaggcatagaaaataaagtgatggttctttacatgtttcaagggggtaaatatcttgaagcatctttttgaaaaaatgtttttcttcagaaaaattaaaattatggattttctttcacaaaaattaatttaggcctgtgtacacataattttattccaatgtaccttttggacttagtcttttcttaatctacagttattggtattgtgtgtgacaaattctgtttgagtctgagtttattactaagtgagtgaaggaaatgcttttcaaactacaatgtgaatgcagaattatctgagttacatgaggctttttgaaaaaattacatatttttaactttctgagtctaaaattaatatacatatacttaagataattatttattaatcattgagaaataattcagaggcattatttgcatttgtgtttatgttacatctgctaagtgaaagggtgaactgtatcacattttagagtacatatagaaaaaaaatcaaatgtggcaaataacacataccataagcatgcaaaatttataataagctgtgagatactagctgacatcatattgatgtttttaaagcacagatattgtgcagttcctgattttgtacatattaacttggaaaagtttactaacaataaatatagtaaaacagagaactgtttttattaaagcagatttaaacttttcctgttattttggaatgtactattaaatctattagtctatcaaaagcgtggatcagtggctaaaagttaatattaaagaaaaataacaaaaattatgatgacattaactcaaatgatgtttcattatgatcaaaaccaaaagaatcaaacctaaaagtgaaatgtaaaatataaaacaaagaagtacctatttgccactcttaaatctatttgcatttttggttccacaaagcatcattttatattaaataacaaaggatgttaatttaaactgtattgattttatacatgtgttgtatgagtaaacttatggtatgttaatactcagatatttatctgtgcagagttcaacttaacactgaggtctgtgagaaagttttctttttcaaagcttgggattttactcatgtttgagaaacattgaattaggagtttacccttaaactctaaactctttcatgcccatagtgaattaacagagcatgctttcttgtacatttagaggttgttaaagcttacccagttgctgggtctgctagaatggggggattccataaggaaatcagtttactgagactggtgtctgaaagaaatgttcatcaacagagaaagtcttgaagccctgtctggttgccatgtttatgctgtgggccatatggttatattctgagagtttgaaccagtgaactcttagctatttttaaaaatttgatagagatccaagaaatggtttacacttagacaaagtgacttattttaggaggctgttttagccactggagaactccaatgcttcttgaagttctcaataaatctttttagtttgtctaagaatcagatccttagatttctgcgtcttctttttgcttagctccttaacagcttgaccctctttcaccaccactctcttttactggttttattttggatgggggtggggtgatggtagcaattctgacctttggattttagtccaaatattgattctgggcaactagaacagtggccaaaactacctctcttactcaccctaagaaacttggttgtgggactacagctacctataaaagaagaatcagatgtcctgtggtattattgatgtcccttgtgggaccttttctaagtctaaataagtccttagggtcaagctgtttctggaagcctggcagaaagtttatctgcagcaatttgtcaccatgagcttacttgttagactctcatttatttacttatgttcattttcttaggtacagaaggatatttttttttctgtgttccaggaagcaatttttgccaaagctaccgtggggaggaaaattatgattgtgtttcaatcacaattagttgcaattttgcctctccagatacatatgtgtgttgtagcagcttgtcagttttttcttaccccaaacacattgtcttttgaattgaatgctgatcaggataaatatataacacactcaaaggggaattttggtcttatatttgggaaaaatacattagtagatggctactcagattcaagatgtgtttagtgagggtcaagaggtgaatatgcttcagatacctgaattagttacatgggcttgttagtgcaagattaaatggctttaatttaactgccgatagagtctgttgtgggttcctggaagtcacccaaattgttaatcactattgaaataacatattggtaaaaaataagaaaatttattaattttaaaagttagctgtgtaagttagaagcttagaatgaattttatttcccttgtcctctgtagtattttactgaaaaaaggtttgtaatcagattgctacattccatgctccataataaaatacagagcagcattattttgataaagtaaattgactcttatattttatttataaaatatttaagatttttttgaaaacttttcaaaagcaaaaaacataatagcattatgggatttatatgtgtaaatgcatatgtagatgatttacaaatatgtttgtagcatctttgctgggatgtctcaacaaaattaatgcctccccttctttagatagtatttgtttttgtttacggcagtttttcctatatttggtgaatctcttgccttatgagtttttatagccccagaaagaagtaaaacactcaccttttcagccatccttaactaggacatcaacaggtgaccaaatcacaattcagaatacctataagaacattgattaggaagctattgagtaagaggaggcagcataaagatttccttctgcagaggggaagcatagacttccaggggcagcaaagcacaggacctagcctgagtgttgggagaatgttgtctgcacccagcagtaggtctccactggtggatatacttgagttattatttgggcttcctaatgttctttaatacttttttctggttgtttttgctgaaagtgatacagtggattctgctgtttacattgaagaacttgaactcatctttttcccagccttgatcttcatccagtgtaccatggctcagggaatggcactgctatatatttgggtgtagtaacaagaaatatagttgtatattctggatacctgtctcttgtatatgttatgcatcaccaattttgctgtttttacctcctatataggtcttgattggctgcttcacatcacctccatcatctattactataattaaaaacatttttcctctattgactgccacagctactatcttcctggtctcccatacctattttgcttaccaccctatcactcatatgttttatacattgtggccagagttatttgccagaatgaaaatctgacttatgatagcaaccttcatctcattcagcttaaatcttttctgtgtttaactataacatttaagataaagacaaaactgtttatctttgcctgcaagtcctgcttggtctgtttacttctttgatctccattgtcatcttccccattttctcctctgcagccaaactttcagtctcttttattcattgtacttggccctcttctaggtcctttgcacaagtggtttattttgcctgaaatgatcttcctaataactctctttcattcttcaggtcacagctcagacatcactttttcagagactttctcaccttcctgatgaggtcatatctccccattacatgatttcatagccagactgtcttgtgtagaggtcatcacagtttcatttggcacacattttgttgttgctttgattactcgtgtgatgctgcatccatgcagaagaagccccatgaaggaaaagtactgaaatggtatctgttagagtatttcagattcatcctcatgggttttcaatgcaattttaacaatatttacatcacatgatccttttgctgataaacttcttgttcactttgataggtggcataatataggagctaagggagataagtttattgttaggttcaaactgagatctgagcaggttacttaacccttctccacttcacgttttcctgtacaatatttagcactttacatattcagtaactttctcactggaggattgggtaaattaaatatttttactgtcttaagctattcttttaattatttatatgccagtaagtcaccatcaacacttccactgatggagtatcagctttctgtagatcactacacagaaaggcctaatgagaggtaatagcccttaagaagtttactgctgagcttggaaaattctacacattctaacaaatacaaagtgggcaatgtaaatttgtttattaactaaaaagttgtataatcagacataagagcttatgaagaaggtaggaataaaggttcttaggggagaaaagagaatacaagctttgcaagaagaaggggcacaccaggcaaaaatgcttattttattattattatgaaccatgaactgttaatgagctatgaattcatgctggtggttcatggcaagttagcatggcaaggtttttatggaccaagtttgcgaggatttttgagcaccagatggaatgtatgattcttacttgtgcttgagcatgcagttaattgcttcaaccaatagaattgtgttgttactggtgaatgtgtgtcaccatcactgaagcaatcactactagttcatggtgtttgcagagtttaatccctgcttgtaggatcattgtaaaggaaaagaagtttttgtttatttgtttgtttagttacagaaacagttcttagggagatacttgatggtattttagttagaagaagaaaatgtttgagatatattcttgcttatggttattctcaagggagagaaatttgatcctgtctgtatgcttgagttgcatccatttagcttatgaatgttaatgaaagcctgaaagtatatcacaatagtagattgaacgatgtgacagtgaaatttttgaaactattaagtttcttcttccctcctgtaagagaaaaattacctcccattttcccagcgccttggggtaggggaaggacatctgtgcttgattgttggtctgagatctaactgttacttcttttggctgaagttattttttattttagtttctacagtacaccccagagggaagctttaaaaaattagtgtgggaactaaaactctacaatttctcaatgtttgtgtttacccattgagccttaagttagcatttatgaaaacattaaagtacaattctcagttgctctcagggcaaaaaaacaaacaaaaaaaaacaaaaaaaaaaacacactgttggaatggaggtcacttgcgtcatgcagcttttctggttatgtttaaaaggaatgttttgttgaaggaatatctttgggtgattgtatttgttaagacaaagttgaattaattgtatgctacaatcagagaagtatttgcttgctcttcctttcctcaccattggtcaatgtggcatttcataattgaccagatgtgttttggctattttttaaattttgtttttcaaaataactgcattgctagcactgaaagtagaatagcctatcccagagacctgggatatgatttaatattatactttgctcaattattggagaccactaattccattaaagctgccttaagttaatgtagactgaggggattttacaagggtttcaggttttttttttctttaagtatatattttataccaaaaccttgagctatagttgacgatcttgtgaccaaaagcaacagtctcaaaatttgaggagatggcaccattcgcttttacttttttatatcctaggatctcagtttcttttattatatttgtatggtttatgaagctactggtgagatgaaaaataaaataaccctattttctctaccaccctgttttcctctcttttctttcatcttctcagaacttaacattttaaagtgtaagcacttatttcatccctttttccttctactacttgagctcttttcttcattttgctatgcccagtctctcattttttttttttttttttgttatcattcccttttgcttttattttccttttcttgtcttagaacctctaaggcagaactgtttcaaacaagcagaccgatttttggcttaggtgatagtactttgtaaataaaaaaatgaaaagatgttttcctttgacagttcccacttccgtaatccttgcaacaatccactcaaacagtgcttttattatatctaagacatttatctgttccaggcctcagattttcatcagtaagatggtagagaggagacatagtggaaagtgacagaacgtggctgttaatttaggcctctgacttcagagcctgaattcttaaccatttcttttgtttgtttgttttttgtttttgagacagtgtctcactctgtcgcccaggctgaagtgcagtggcatggctttggctcagtgcaaacttcgcctcctgggttcaaacgattctccagcctcagcctcccgagtagctgggattacaggtgcccgccaccacgcctggctaatttttgtatttttagtagagacagggtttcaccatgttggccaggctggtcttgaactcctgacctcgtgaacagtcctcctcagcccccaaagtccggggattacaggcgtgagccaccgcgcttggccttaaccatttcataaacaggaatatgcttttatttgggtgatgggggagattatatttttccttccttttgaatatttcatgaagtgtcttttattgtattaagaacttcagtggacttaaagtttaataaaggaagaaacttctttggtggccaattgaactgcccctgtgacctgatgatccttgttcctgagaactgagttgaaaaactttgttcaatctgaattcttctctaattgatcattacttgccatttacttattcaggagagcagtgaccattgttacagttataaaattgaatagttataattgttattagttttgagtcacagtaaggtctagttgttcttcatgtacttcttgtactaaaagtactttagttcttctaggttatgttgtctgaaaagtgggaactttcagaataatagactagttgagttggaaggaaacttacatcattcagtacagctacaggcataccttgttttattgtgctttgcctcattgtactttgcagatattgtatgttttacaaattgaacattttggaaattctcacagtatttcattttgtgtaacaaaatgtaacattttggtaattctcacaatatttcatacttgattattgttaattatatctgttatggtgatctgtgatcagtgatctttgatgttactgttgtaattttttcatgcaccacgaacagctcccgtataagatggtgagcttaactgataaatgttgtatgtattctgactgttccacctactggctgttcccgtctttcttcctctcctcagccctccctgttctctgagacacaacaatattgaaattaagccaattagtaaccctacggtggccctttaattatcaacttaaaggaataactgcaggtctctcactttaaatcaaaagctaaaaatgattaagcttagtgaggaaggcatatcaaagctgagataggccaatagctgggcctcttgttcctgttagccaagtttcgaatgcaaaggaaaagttcttgaaggaaattggaagtgctactccagtgaacacccagatgataagaaagtgaaacagccttattgctgacagggagaaagttttagtagtctggataggagattaaaccagccacagcattcccttaagccaaagcctaatccagagcaaggccctcaacattgaggcaagaccctctactagcaaaaagataatgacttgctgaaggctcagatgattgttagcattttttttagcaataaactattctaaaattaaggtatatattttatatatcttatataccttttttttagacatgatgctattgcacacttaatggactacagtattgtataaacataactttaatatgcagtgggaaacaaaaaataaaaatttggtaccttcagaaataatgtgactaccgagtagaatgttttgactttgagaatattcatttacatagaaatcatagatgtgttgtgcactcattctctttagaccttcagttctggtctttaatgtttaacagtgttgaagtatatccagacaacaggtgggaattgttagcatgatttttagtcttcaggcagtttccagggaatacaggccacactaccttctcttacctttaattgttcatttcaatcttggatcttttggaaaggtgagtgatgattacaaaattggccacaggacaaagcctttattgccttttgggtcatgttactgattattttctcttaagttgcttttctttttagcagctacttctcaaaacttttcactactatgtaacataaaagctgtgcaggttggatagctgtaggagagtgccatgatttcagaaattggaaaaatcttaaaacaagagttcttaaacttagatcaatgagtcctttgaaattgttggtgaagtaagtgtgtgtgtttcttggagtgggcgttgaggcaacaatactttaaatttacttcagatttcaaagaaagagtgagagagggagggttatagaggaataggaaggataagactgagaaagaggcctgactcactttgggatgaaagggataggtagagttgtgaagggaagggttaagaaaggttatgaaggttaagtgccattaagttggaagtttttaagtgtaccaccctttaacattgtcatctcatttttaaacttcgaaagtattctcttcatacattttctagttttattttctttactgtttggtggaagaaggaatgagtacgtctaaaggaacaagtattgaagacccatctattcctctcgtcagtgtgccttcgcacatcatggaggtagtctcatttagtcctcacaccggacctcagtggggtgggcacttcaagatgaggaaacaagacagagaggggttaaattatttgcccaggataaacaagtaaatagatgtgtaggaagtagggaaaattggagtcctggaaggtactggaaaggaaatcaaaacctattataaaattagccacttttaaataggaaacagatggcactaatccttttaactatttatgacataggtttcctatgtcataaagatgaaactggaaattttgttcgtcaaagtaatggccaagtacttgttttttgtctccttaagatgtagtaggggaaggggattaaactataaaacaatgcttggccaggtttctaaatcttaatgtgtagtgtagcgggtaaattccatgaggacacccacttcctaagaaggagaaatttgctactttctactgaaactttcattttagtttttttgtgttgcctgaaggtttttagaagctattatcttaaatccatacatttttctattttcaaatgtaaactggctacctagaacaaatacaaagcacttcctcagagatcaagagaaattttgtcattcggactgtgaaggaaacaggtttatatttttacaaggcaatgggagggacatgtcacggatactaaagttgttggaagtagactcctgcaaagatgcaaattcagttaatttgaagtttgggggacaagtttactttttctaactttttctgacattttgtaatatttgcctcatactgtcttagaaacaaactgtatgatgtaggggatagacctcattagaagagaagcatccatcttaagaagtaatagaatgtaaaagctcgaagaattaaaactagactgtacaaaaagtgatggcactgatgtccgtctaaccaaattaatggagtattttagggttattctcaagattgaaaattttgcttattatcatttcaaattttactctttttttttctctttgactatctttgaaaaaaaaacaatacttaaaaaaatatttttgcttaccttcagtggagcttgccaagtttacaggttacacagtccctctgttaggggctggcgaggccaaagaggtttctaatcttaaaaagcttgcactagggttttggggatgcacagacagatatggtatattttgtacataaaagagcattatgtaagtgctatgggaatgcagggcaggaaacacaaatagatagttgtccgacttttttataaaacatccaacttcaaactgaatactccagaccttgttctagatttttggatgaacaacatacatgaaatcccaacttttcatggagtttttcaattaagtaaacaaataaattcagtaagtggaaagtgctataaaggaaataataaaaagtgatatgttagaaagaaccctggaaggaactactttaacagacctaggaatgctgcaccaatagatgaatgatgaaaatcagccagctgaggacagagcatttcaaacagaggaaggtccagtgcatggagactgagacaagcataaacttaggtgtttttttgttttgttttgttttgtttttgtttttgtttttgtttttgtttttgtttttcagaaaaaaagcccattgtatctgaaacatcttgtgtaagggaagagaggtgtaagaaataatgttggagaggaaggcaggcaccagatcatgttgaagctgaggggtggggctaaagagtttggattttattctcaatgcaatgtatgagaaagatttaaaaaaattaacctggctatgtatcagaaacgattgtagggctgctagtgtggaaatcataaaacttgctaggattccattctatttgtcctcctgagaggtaataggagtttggtaaaactagtggatatgaagagacgtgaatggattgaggagagagcttgaaaatagaaacaatgagaattgctagttaattaaaagaggaaagtgaaggaaggggaaaaatcaaactgattcctagtttgatcattgagtccttagttttaataattggttatatttgttgccacttaatcagatgaaaaaaatagtggtaggagaagaggcttgaaaaaaggaaatgaaaagatgaacgatatgaaaaggagggtaatggcattgccttcagcacaaaggtaatagcaacagaagtacttagagagattaattttataacaaagaaaaaaaatatccccgatgggctgagacccaaatcatgatttcacttgtcactcttctttctacttagagatcctgattattgcttcttaagctgtctgggcatgaagcaatattattgtatagtgtctttagtttttttacaccaacagtttctggcatgttctttgttactactgggaaaatctcactcaatgccaagagctagctgttttgcacagtgcgttggtgctttggtagctattcaagatggtctccagaacacataaaaatacttttcttatgaggatagaatattacttagtcctctgtactcctccgctcatacataacaatctgattctctgatgttgagagactagagtggaagaaagccctttgtgacggtcaattttgtgtgtcaattagactcagcgatagggtgcccgaatattaggttaaacattatttctagggatgtgtgtgtgtgtgtatgtttctggatgtgattaacatttgaaatggtacactgagtaaagcagatagccctcccactgtgggtgggcctcatccaatcgcttgaagtactgagatgaataaggagtaagaaatccctctgtgtctgactgtttacaagctgggacatcagtctcctgcctttggacttggactcagattggaacttacaccaatggctctcctggttattggactcagacttggacttgaactggaatttataccattgactgtcctgtttctcaggcctttgggctcggattggaattataccatcagctctcctgtcctgagtctggacttctcagcttccacaatcatatgagtctattccttgtaatattgtgtgtgtgtgtgtgtgtgtgtgtgtgtttatctatatattccttttctctggagaatcctgactaatatatccttcgtactagggtagaaaatttcaacttttttcatcttcattcttcagacatccaacactctggtgaaggattttgttttctaactgattttatagagtacatctttataccctgcagagactgaatgagtgaagtagactcaacataaataaaagcactaatagtgttctcattagagcagagcgataaaaagatttatgtatattaaaatatagggttctctacatgtgatccaaagatctctgtagaccctcatactctttcaggtgatccatgaggtcaaaattgcttatcaataacattgaaatatagttttccttttttctctttcattttctgatgaatgaatagaagaatttcccagaggttacataatgtatgatactacaacagattgaaagatgaagtaaaaatgagaatctaattgccttctattgagacagatactaaagagatttgtaaaaagtaaaacaatgcttattacttcttactatcttttttgtttattttgggaaatggttatttttcatgaaaatatagtaaattatgagatcattgctaatcttaaattattatttttgagatttttccattttaaattctaatatggtcaatattgatataactcagaaacaaaagctgcttgatatccttagtatcacaagtataaaggggtcctgagactaaaacatttgagaacctttgttctaatataaggtttcttatatataccagcgtgactctgacaaatacattaaatatgtacttccaaacattatactcgttcattaaatccttatgtttggaagcagcataaactagtttcatttgtttttctttttgttgttgttttgacattttctggtaatttatctcacatatagttagaactagtgctgcctcaattgttcatgttattaactagtgtctttgtctcctcattcaattggtaatctaactaatcaagtaacaagtgtttattagacttctactgtatgcaaagcccttgttagatagggtgccagttatcaatttattgccccggagcttaaaatttgtccttcattacctgccctgtcatagtagcacttgaccctttaagcggttctgctttacagctggcacagtgttaagctttgtcagtagagggcactggagagacacttaagaaagaaggatcatctattcttggttgaattgtgatcctaagtttgtttttagttggtggtactgcacagtggacggagctgtgtgcatgtagcagacatagtccctcagtgagcttgtagcaacaaacctggcctggtgactgccttgctgtggcacacacataccccaggcctcatgccactctgctgcagggagaatgtgtcctgtttccctagcttccctagagcaggattggctctggcctgagtgacccagcagactttatcttcccgtgagctgcaactgcaccttctttaaggaaatctgattctcagcaacctcccctgtctatattggtttctttcttgggtactttgattgttctttaaggttttcttcacagcgttaaagtttctatcttcttataggtagtaattctttatattacattttcactgttaaatttactgtgtggcttctctcttctgattggactctgaataattcaggtgctttctaagagaacaaaattacccttctgaggttgacaagagatatcccagtaaatcatttaaaattggcacaaaagcaatgtataattgggggccagaatcagacatttagaaactgtgagacagtttgaggacagaaaactggcatgatgtgtggagaaaataatgaggggtctgtcagactggagaaggtggtttgtgaagagaagtgggaggtaaaatgaccagttactttgggataagatcatggaaagttgtgaatactaggcaaagaaattgaaattttgcttttagtttatagggcacattcaacagattttaaataagaactgacaatacaaatattatgttagtgtactaaagtataccaacacatacatatataaaggagttttagaagaaagtatggaaatctatttatcatgaattattttctttgctattgatccaatttcccatgtaaataccttattcatagaagtgtaacttaaagataaaaaataattaatgtataaaatccatagggcattacatattcatctatatactagattatgttattttccttgcccattctttttagtaaaaactgtcatttgttttaagtcttctctgcctttctcttttttaatgaattggaataagaagtactcaatttttgtattgtgttttttgaaatatttagttatttataggatcctatttgtatcctataaatacaaatagaatttatttttaaaagatttaaaaaacacgcttgtgtttatttactatttatcattattcatttgattttcctcttgtaagatagtattcatgtagtctctgttttaataaaaatgtgcaaatctaatgcctattcattatagaactctcagaaactgtacatatgcaaaaacttttttgaaaacctagaagacaattacagcccaccagataatataccgttaagattttgctacatatttttccagtcatatgtacaagtgtatgtgtgtgcatatgtgaatatacacacatttacacagatataattatttaacacaaatatgtatttttcataagtgggtttaatattttataacctgcatattttacttaacatattgtaaatatcttccataaaatgttttaaaataatattattcttaatgactgcattattgttcattaaattgatttgctgtaattttgcaaattactgattattgaatattgagaatacttaatttttctctgttttaaatagtgtaatgagttaggcatcttttaaagctgtatcttttatacatacctgatggtttatttagtatacatttgtagacatggaattcccagatcagaaggtatgtatctctttttttaaaatatactttaagttctgagatacatatgcagaatgtgcaggtttgttacataagtatacatgtgccatggtggtttgctgcactcgtcaacccgttgtctacattaggtatttctccttatgctctccctccccttgcctcccaacaggccctggtgtgtgttcccctctctgtgtccatgtgttctcattgttcagttcccacttatgagtgagaaaatgtggtgtttggttttctgttcttgtgatagtttgctgagaattatggttttcaacttcatccatgtccctgcaaaggacatgaactcatccttttttatggctgcacagtattccatggtgtttatgtgccacattttctttatccagtctaccattgatggacatttgggttggttccaagtctttgctattgtgaatagtgctgcagtaaacatacgtgtgcctgtgtctttgtagcagaatgatttataatcctttggatatatacatagtaatgggattgacacgtcaaatggtatttctagttttagatccttgaggaatcaccacactgtcttccacaatggttgaactaatttacactcccaccaacagtgtaaaaacatcctatttctccacatcctctccagcatctgttttttcttgactttttaatgatcaccattctaactggcgtgagatggtatctcattgtggttttgatttgcatttctctaatgaccagtgatgatgacctttttttttatgtttgttggccgcataaatgtcttcttttgaaaagtgtctgttcatatctttcacccactttttgatgggtttgtttttttcttgtaaatttgtttaaattccttgtagattctgaatattattcccttgtcaaatggatagattgtaaaaattttttcccattctgtagtttgcctgttcactctgatggtagtttcttttgctgtgcagaagctctttagtttaattagatcccatttgtcaattttgggttttgttgcaattgcttttgatgttttattcatgaatatctcttaaaggtcttttatgtcaaattgctgtctataaaggttgcacttaaaacaaacaaaaagcatatatagttttctctgtgttgaatgatatatttgagaactctattgatcaagagactgtaaggaatatttgtaaggccactttaaagaagttttaattaaaagctagtacattgtatgtgtgggaacatagatgttttattaagccttgagataactaaactcttgttagaaatctgaggaattagttagctggtaacagaacaatcgtaaataagcttaaattataacataaagtatgagagaagtacatattgtataatttcccaagtgtaaggattgggagccagttattctgggagactacagaagtgatttttagatgttgataagaatagcacagtatcttctgtgtttgggatgatggaagggaattttgtttcagacaggcagcttcctccctagtgcctactgggtaaattgccgttatatcaagtcagtaggcagaaagatttagatggctttttggtgctagtgctttcttcctcctttctggaactgtgcaataaatgcattattattccagagcactcggagaatgtggcagtagtcaggcattattgaaagagggccatttagcggaaacattctatagagatgaattatcaacactatttttctttattatttaacttgcttgaaatgttgaaatagtgtagacaagcttttattttgtgacttttgtcttcctagtgatcaaattgataatgcctacaaatgaatataccttgcccatccggtttccctaataagacagataattattgtagcttaagggtacaactgactgaaaattcctaaatggtctttatagtaaatattatgctatataattaaaatgtgacacaaagcatatttttactccaaagtttattttataataggaaaaaatgactattagaaagccaataaatcatttagagattactactttaaagttgacattcagaagccataattgatacagacctctaaaaataatttaaatgcactactgccataatattccactgaggggagggggtggaactgttatagtagtggagaaataggctacaggtttgtgaagatgctgaggcccagtaacaaacactaggtaacttatccaagatctcagggctggtcctcgttgaaaggaatgattggtctgctatgcagtggcaaatctgaaagacatcttgccaaatcaaccattgacttcagaatgtgaatataataaagaatagaaacatcctgcttctataaattgggttgggatccaggatatcctttttaaaaataaagacataatttctccaaaatacacacggacagtttattctattaatgtgccgtctgtgagactcagaaagaaagaaagagagaaaaaaaaaagaatcctagcttacaagagaagatgataactaggaaaaagaagtgaacaataatatcagccactatcactatgatctgtttattctgtacttcgattatactgaagtgttacagaaatcttcccaaaagctctcaaccagaggctacctaccactcagtggcaatcggtcacatttgaaatttggcttctcaaatagttgacaccatcctctctgccatgatttgcatctgttgttgagggttaattgaacaagttagactagtagttattgagtggttaatgtgtcatgggtacaaattttggggagggaatgcagaagattgattacttttacatgttgtcaggaagaaagggtcaagtgcaactcttataacactgagttttataacactacatctgatatattttggttaaaattacatgctagcaaagaaaaaagatattttacaataaaatttgtgttccatcttctgtgtaataaataggcatatttgcatttttgtgatatgtgtctttgttaaaatccacaatgacatgagaacaattggttgtcttactggagagttttctgggactaaaagcagcagcccgttgttcaagtctcatttttgtacttagtctctgtgtggcctttgtctgcaatggaaagtctatatgtgagctatgagagtgggactctatgtcctgtgcctcctcatgacagataaccaatgaacacttactaagtcaaagggatagagtagattggtgattttaaactgggtttcttgtagctctacaagagtttagggactgttacagaactggggccagtagcagtggtgattagctgacaccttagtgggtgagactccaagtggggaaatctgctgtgtcctgatcctcagctctaggcatttttaactttagccctcatactgacactacaaagtgtcctcattccctgaactgaggttcaaagttagtatgttacaaatgatcacataacttgtataaatgatgattttccaatacgaaattagaaatggttccattgtttgcactctaagcacatctccctgcaataatattctggatagcgaaaaataaaggtgtaccctttgtgtaaaccaggccaataatgtatcgcttttgtgtatgtgtgtatacatatatatatatattatattaaaagacttgtgttcagtaataccagagatttagagtgagatctggatttgaacccagctttgagtgttactaattgtgcctcaatttcctaatttgtaaaataggataataacaggttgttgtggagactaaatgaattgatacagaatgtgtactttgaacactgtctgttacctagtaagaattcagttcatctacttatttgattgatgtatttctgtggctgtgttctggaaaacagtctttttaacttaaatttaatgctcagaatggattagcatatttttattgttatatgttccctttgcttatatatctctttagcattattatttgtaatgtcatttcaggttcctatatgatagtggactcttcagatcacgaccctggagaaaaagccagacttcagctgcctacaatgaaggagaacgacactcactgcattgatttcagttacctattatatagccagaaaggactgaatcctggcactttgaacatattagttagggtgaataaaggacctcttgccaatccaatttggaatgtgactggattcacgggtagagattggcttcgggctgagctagcagtgagcaccttttggcccaatgaatatcaggtaatcatctgtacttttctggtgtatgttttgatgtcatcagttctcactatatgtgtaatacatagatgtaaatatgcatctcatggtaatgagagattgccctcttgcctcccccacccccattattggggaagtgtcatacatagatatacatatgcatcccatggtaatgagagattgcccctctttcttccccaccctgttgatgaggaagtgtttggagacattggcacaaaaccttcaaactagagaaagtatttctatgtgttaaaataagtttaggtccaaaatttgttggtggtttgacaaagagctacttattgacagattctttcctacagctttgttcaggaagaaatagcctttttgagtttattgtaatcttcagactggactgatttactgactttttgaaagtaacatttgggaaataaatgtgatgtagagtttcatgaactatgttaagggggaggcattttcattaattattttaattttgattaattaattgaataaattaaatgacatataaaaataagccaaaaaggataagttattcacaaagctttggatgtttgtttcagaaatgattcattgaattatgattaaatcagacaatcaatagtgtcagtacccactttatgattctgtgactgagtttatatgctcttaacaaaaaaaaggttcatttactagtttggagagtttgttcagtaaccctcactatgaggttccgtccctggatgctgttatttctttaaaaggtcaattttgtgttagaccttgagatttaaacttttaaaggacttgtttatttgtagcttattataaagcctaaagagaatacatttatgtaaaagtatattttatgatggtcagcaagcaatatataaactaatagttttatttctgccttttaaaaatgaattatgtctttaagttaggtttgtctttattcttgaaggggaaaaaagaaatgctttgctttaattgctttgtcttgagttgagttttctgttttattaaaagcctcctacattgtaggcatggttccacaggtaagattttcagttcaaggttgtatgtttattgagttttcaatggattttcattagatacaagttgattctattattccggagcataaggatatttctcttcagtcagagagagccatctgctttttcagggtccacagccccaggagggctgcatatatgatatggtaggtaggtggatgggagtgtgtgaaactaatgctagagcacttgttgcaagatcagtgggctcaactctgacaaaagtgggttgatggctgtcatcaccaggtcactctcacaatgcattatcattgtactgatttcatgagaatctgtcataggagcttaacttagcactggaaagaagttctgattcaacagagtcagcctccacaaaacaaattaaaacccccaataaaaattaatctagcacactccttaaaaatatgggttttgaagtcagattgcctgtattcaaccctgttcacaacttgtttcctgtgtagatagttctttaaggaatcagactgtcagttgtactttaaaacaagaacaataacaacatagaagtaactgttgataaatccagcaagtagtatatctgtgatatatttctttttcctcgtaactacgaaataacatacatgtagttattttttctaagttgttaaagatctatctttgaatcattgatgttaataacattttctcatggcacagattactgtggtgttaattctactattaagttacagtaatttgaactggattaataattctttgttcagtctcattttgcatgacaaaacccccttcgttatatgtgcttgtggtgtatttaagcaagaagtacaaaaagtgcctgggtgagttccagcctggccagtgacatcattttggagatgttttgtcagagaaaatgatgactaaataaatacatggaacctatgggtaaatgtctcattgttgcagattaaaatttgagccatagataatttcttaagtgattgttttgctctcacatctttttccttaacctacaaaacttaatcaatgagagcaaacaacagagtactttttattcatgtgcttagtgctcagtaaattacttgtttgatgtttttatcaatttaatcatttagattattagttgtacctgtacatttgtgattagaaacaaccaacataacataaactatatttatgtgctttctttctcttggaaagtaacatgaaaaacattaaatctcccatacattttgatagctttcaaagtcaaatcaatacctgtgaagtgtttggtaagtgctggtttgctggcaaaacacggtagaattttttgattggtgttttaggtgctgatgtctctatatttaaagagaaactcaactgctttaaataccagatattggaggccagtcttgagattccatcaggttcttaaagaatatccccattttcttttattttgaaagcatgacattcttttcaagttttttatttattgtaacatctactattagacacatactgtgaggtcacatcatgctaactcctggggatacacaggcaaagtcccttttctcatgaagttctcagcctagctttgctctgtagaagataaaaatgtaaatcagatgtttgctctgctcttaaggaggctagtccagatgggaaatgcgagatatacatagatataacttgaaataccatagcgatggttaaatgacataagagaggtaaatataaaatgcagtggggaaagcaaaaacaaaagatagtttagtttctgaagtaatttcaagtagaaatgagactagaattcttttgtcgattcctctattcctagatgctttccactgtactgtgtatttttcttaaatcacacttacttagagccagcaaatgtaaattttgctttttgacatatcattacagtgatccactaacatataaggaacaaactgtttttcacctatgtgttcagaacaatcaatgccttttcagcttactatactaattatagaaattatcgtattacatttgttttatttgctatggttgaaagatgctattctacgtattttatgggccacaaataagtactgtagattcttaaattgattgctaaatagaagtaaatagggaaaatcccgcaaatccttaggtgtcatctccatattaaatttcagctgaagatcagcatacctctaaaagcgtaattttctccactctggaaatctgacctgtcttgtattcataaaactaagttctgctttgggattaaatccattaccttcttactgaacagtgaggttgttactaaatgaggcaggcagacgtatgtaacttgcaaaactattagtggaaacctaatctactgttttccattaactgggtgcccatcattaatcacaaaaatgatgtgtgatgaaaactacaggggtttgtccagaaattggaatgtgatagtatagcagaaagtgcctttttctcccccaatacatggagaaacaaacacaacttttgcaatgcattttcttcttaacattttccattggtttgaaaaaaaatgtaagaattgacaggcatgagattttctgtttttgtctccttttaaaggggttatattaatgtatattatattgatattttgtcagtagaaagattgttatactccagagattccactggctttggatctgaaaagattggggcttaaaccaagtgaccatttttacttgaataaaaagcctctaaaagattgatcttcaggcacagaggcctgtgtaagaagaacatactcatgaaccatccatgcaaagagtaaaaagaggggatgtccctcctctgtcatagctctcagaactcttccaatttttttgctgatctgcattcatccatatagagacccactttagaaagacaagcagcaggatttttttttctctagatatatcatatagcggtaacttcctgcataagcattgtaagtgactctgctcatgatcttgtatagcagtgttgtggatattgtttgttgtctatttattagttattctcctagctttcttccatagtggcaggagttccaaccagcttacttgctttcccagcttctttgtaggtaaggatggctatatgcgacacagttctggtcaattaggaaggaaagtctgccaggaaacttctgggaaagatgttcctccctgataataaagagagtgttgtatgagaacatggctcttggtgccattgtgatcattttgtaactgcgaggaaggaaatagctgacaaacagggtgacagaagaaggcattcaaggagcctgggtcctattctcaaaataataataataataaaattatttaaagaatttttagatgactattctcctgtgcagccaaaagcattgttatacatcatgttgtgtcttaagctttcaagcaatactacctgtcagcacatactgtttgtggatggcacatatgagacacgtggcagaatttaaaaaaatatatatctaccaatgaatgaagcagtttttttttttcaatctatttggagagagaagacttaaacagggctataagacagtggatcactgactaaacaggctagaaaggaaggaagaaagatgatctattgggtatctactgtgagtgggatactaggctggatactttcatgtttgtcatcttttacttgtattaatatttgaacgtgtgctaagtaaatgtttcttaccttcatgcacagttgaagttgtgcttacgtagtggtggagcaatattatttcccattttttgtctttagtaaaatagtatgatttttatgagtttggtctttagctgtatcagtgacttctgaagttagccacaactagatagacttattttagttacggcaacaggatttacctaacacggtcatcgtggcttatttttacactggcaaaataccttttatttgataggctattaacaaaacatctttgctgctactttttaatcttaacgattctctttgttgcaaacagagtaccccaaatgggttggaaaggccctcatattattatagtcattgttttcttgaaacttagaatcctgaaattagccgggcatggtggcgggtgcctgtaatcccagctactcaggaggctgaggcaggagaatcgcttgaaccaggaggcggaggttgcagtgagtggagatcgcaccactgcactccagcctgggcgacagcgtgagactctgtctcaaatttaaaaaaaaaaaaaaaaaaaagaaaaagcttagaaccctgtgaaggtgacctctctggttcctgatggtgatttgcttttattacaaaatgtctgctctactttgactttaaatagttgttgttgattcattgatgaaacttatggttgtgtaaataaattttaacagatgaacaaaagagccctggtagttaacagaacaattaatgtaaatctgtgacaagcctcttttcattctgctcagtcatacctgcttttatgtagggtggtggcagctgccacagtacccttcattgtttcttttgagaaatatttccataaattagtccaattccctttcagtaactgattgaaaaataatgagcggtcaggagaaataagcattgtttgttcaatgcatgattttttcttacttaggagtttgttttatctaaggggaatgaggaagacagatgctaaaaggagcagtggaagagataccagttctttgcttatgttctcaactagcactcactttggtttgctgaatctgaaaaaatacatttctgatttcttgttttgcatacttctttattaattatttagcgtacattgatcaggcagataaatgtgagaaccatttccgtctaatcagtttaatgatgtttctgacaatgctatactgtttcatataatacatgacaaatagataacaatttaaaattatttttgtcttcaattatgttgtctgctgactttgatagttaattggaattggtctagtttttagggctttccagtttttgaacaacttgaatttttgtgtgaactctgtccattttcatttcaaagacttatttttcttcacttcagtgtgtatataatatgtgaacaaaatattggtgttataagggacaaacaaaaacgaatacgttttttatctaaaatttaacttttgtgctgtggtgatttcagtttcaattcttagaaaacaaatacatttttcatttgagagaatgtgggaagaaggaaatatacagcaaatgtcagacatttgtagtcttttcaattttattattcattacataatattacatagaatctaattattctgttgttagtggggttggaatataaacgaaaacaaactttggacactaaattttactcatgtaatctagtggacaatttatagttaattttagctgtcttgattttcaaaaggtgttcttaaaactatcattataaaactagctactacatgttatttctgcatttagttataaataatcattgcacacaccactggaattcccttatgagaattagattcttaatattctttgaatgatctgttaaaaaatcattcttctcagccctctagaagcagtaaatcagttcacattttatgtttaaaaataaggtctatagtcaaatttataccaagtaataattcaataaaataataaagaatgaaaaatgtctagtacctagagacaaggtttggttcaagcttaaatatctttagatcctggcattttgcaacaacatcacaaatataataattagaaacagataccatggttctctgggcttatatttattaaaagacacttttggtttggttgtaaactttagtaatgtaaggcttacaaagagatgaagtcaatttagctccataaataccaggatgaatttctgtgttttgtttttggttgttgttcctttgtttgtttgtttgtttttttctttcatttaaccccctctttctatgtcttggggggttggagtgagacccattgtaagcagaacaataaagagaaccaaataattgtttttctgatacgtatattagacattgtgacatgaagtgtgagaattagaagtagaaggtctccttttttttttttttaaatagtggtggagaaaaaagtagaggccattttgtatattgggtaaaggtttggattagttctcatttgacctgtgtttaatatccattatcacatgttcatgtccattctgtcaaggcctccttgctcactgagtgactatgttgtgggacttcttgagtttcagtccctgcaatatgggatgatagctagtctactgtgatttattaggttcacaaaattgtctatttaaagctcttatttaaaaataacagacaccaactagagctagttaagtagaaaagagacagaattgaaaagatttgggaatcactcacagcatttaagggaagtggaattcccagcctgaagaaggcataggacccaattagatctgaagaaaacagaaacactttctctctgaaggactgctgtactgacttatttattttatccatttggtgagtggttattgagcaacctaatccatgccaggcacccttctgggtgctggggttggacagtgctgaataagtttcaaggttcctatagtcccaggaattctactctaggggtcagagccagtgggggagaaaatccagataaataaatgagaaaaagattagaatacaacaagtgctaaagaaataattaaaatttaaaaaatatgaaagcagaagtcttagaaactgcattagaccaggtgttctaggaagaactgtcacctggagatctgaatgacaaaaacgaactaggcatgcagagatcaggggaaataccttagagacagaaaaaaaccaaggacctaaatatggaaggaaattggcattgcagagggacagagacagatacagaggtcaaaggttacctttttcaagatgagatgggtagattccagttatgtgagctttgcaatctgaggaaagaatcctaatgctttcagataatttttatcaagggaccctatttactcattcttagtctcatcttgtacgtgcttcccatttatatttttctttagtcttttttactgtttactcacagctctgattgtgtctggtcttgataacggtaatttcctattttctctcaccttaaaatctattataagtcaattacttgttgggagatgctaatttgctgatattgagctcctcagattttgccagtgtttcctttaaagtcaaaacactcagcctttatttgaggtccttcgtcatttagcctcaggcaactactctaatctttctaccattcttttttttaggatgtaatatatgtatgtcctgaaatggctttgtttcttccttttcattgtccaagttctgtttgtcctttaagacccaactttatgtccacttctgccacgtagcctttgcttaatacctctgcactcagtggtctctcccttctccttggacgtgtgttgcctgtattgcttattagacattttgcttgttatatgtatttcaggtatttttcctccaatagtattataggccctcttttaaaaaggtcagggtgtcccataaagacaatataacaattaggtgctttatatttcagaaagcaattgtacaaattttaaaaaaatcatcctcacaatagcactatggggtcactgggaaaagtacaactatttttattttagagataagggctgacagagggtaagtgacttgctttaggtcttgtttctagtgagaatagagctagccctcctctctcttgtgaaattctagtccctgtctcctgtgccagactgtatattggtgatgattttccagtcttggtgtcaaaagaaaattggcttgctgattaagtattcaatgatggtacaagaataaagttagaattattttatatgcatacactttctcaggggacttattctttaatattatttgttaatgtttctttaaaaacactgaatggtttcatgggttgtgtatccaagaattgattggatgaggctgaatacttcatggaatgctcagaactttggtgaactgaagtttaattcatttccacaaccaagtgctaagttcttagtacatgcttagcactagtctgtgtttagggacaaaaccagcaaaaaaaaaaaatgaaaacaattttatacttttccttagagaatataaagtccactaagacaattgcgtatacatcgataatttttaatggaaaatgatggttaaatgagacttggttatactattatcgttaactctatatatgtttgaaaatgccataattaaacaatgaggggaagaaagtcttctgagagagataaaacatccacattggcagccttgtattttgtgtcattaaatgtccaaagagttgttagggtgcagaaaacaatctccaaaatgaagacctccgaagcagtttcagaaataaaagtttctctctgaccttctccttccttcctgtttctcacttctactcccccaaggctagccactgaaactacagttggcttccacaggaacctcttccccatggcagggcatagaaaccagaacctctctttttcttcaaagccagccataacacctaaaaacaactgctctaactttcccctgcctttctgtgaagtaactggccatgaagaaattatctgacctgtcttatttgcatgtaggtcaaaagacccgaatactagaaagggtcctgccctgtacccaggaggaagaaatgctgtacaaagtggccaagaagaatttgaacagacaggccttgctgggtttcttcacctcagtctactagcattaattagatcatactctttatgtgaaatcatatttctacatgggtgtccatacatcattgaacctaagcataaaaatggattttttgccatatctttgggtcttccttctgaaggttcctgtgtcgtctaaactatgatcaaataaatttgttatgtttttctcttgttaacctgtttttgtgataggagtgttggtcatgacccttaaatgggaaggaaaaggatcaaaatattagtactgtggagaaaatagtactaataaaggatctccaagaaggaagaaacacataggctctggggtccagtaaaagttgatctggtacttgagaggctgaggcaggaggatcgcttgaacccaggagttctaatccagcctgagcaacatagcaagaccctgtctcttaaaaaattgagctactatggtgggcatgaaaatggtgggtgtgtaaaggcaggagtaaaaggcacttgaggtttcccaattataaggcatagatagcagtctcaggtggtcagaaatgagaacgatcatactgtgtaaggggccagccatactgctctctctggcccacatggagggtcttgaaatgaggagggaagtagtatgttgaaaaagttgtaccttattgagaagtttccaaatccagggtgggagatttttctgtctgactcctcggtgcttggaccactcagaagaggctaatcagcagaacaatgtgatgacagtgatgatttttacaagtcaatcttatgactgaattcagcagatcaaaggggcccataacacagcatttactggacatccacacactgtacgattcaagccccatcggtctgaactagacctatgaagttgcgttgttcgcatttttagatgatgacctgtggaaagcaaggcatatttttgttacttagttccctttctcttgggtagagatttatttttttgttatgaaaggtaatcaggtttttggcttacaaactcatattttttaaaagtctattcaaatattcttttgtcaacagaattgctaaattttgttcatttaagtttgttctttctgctgggatcccgggggaactttcccttataataaaagctgaaggatgtccagattatgctcttctcctccatctgcctgttaagtccttaatctcctacacctgggtgttctaatcctttatttgctttaagtaccaagtggttccaagtcggacaagttctgtgtccaatatgccaagtaagattcattgtgccatagaagggcatgctactccccaagatctcctggagaataaagtgggttgctgttcacaaatggacctgctggttttaatgcagcccagttaataaatggcattcactcagcatacagccaagagtactccattgattggcagcaggaagctccttgttcatgttgagagttcctttttgcggtgccacttgcctctgagaattgtcagtgggctgccttcacagtgcagcaaaaggtcctttctgctttttcattgccatttgcttcccagtttggagccagttgagttatttagctatgggcctgagttgtgtaaggtacagcatttttaaatgagtttgtttttgtgtcttccttgttcggagttttttgtttgtttgtttttttggaaaaacatccagcaaaggatacggaaggcaacgttatcctgtgcttcttagttatcactatgctaactgaaattcagtggactacccttgtcaagaggttatgccgtatattgagtttcagccttgggtctcactctagttcagagagagctcatgttacagaaacaatcctctcacctcagccaataaatcctaacaaatcatctctacacccagtgagaccatgtatatctatcagctatcttatggagtgaccagaaatcagagagaaagaaggcacaatctacttcccctgttatccaagtaaaagcttagtcatctataactaacttaataaagcatgtgcttgttgggtaaagacagagtagctcactaagcttagaaaagaaagataagagaaaggctattcattgtctagtacctttgcatttctgattagcctgcatataagtggatggcattttttttgtaggcaccgagactggaactttccatattatttttcaatcttattacctctactagaaagacagtggataagggagattacttaaaccattttttgtgatcatattgttgggagggagtgaactggtaccagggagaattggaaattttctataaaaatggtgttaatttattagccatgagaaggagaaataaaaaaaatcagaatatcttaattcagagggaatggtttggaaaatatgaattagaatgacatttgtacttcttattacaagctggccacacaacattttttaattcttaagtttttttaaggttctctccttccataatataaaacaaagaggctgatgagaagttatttcagctgctgaggtaacagactttgacggcagtaactccagtgtggggaggtcagcaagctgctttatgtagcagctaccacacttcagcatagccattgccttgtgtagggtccgaacgttggttgcagaccaggactcctgcatctggtctgtaatgatttcctactctctagatgatctgaattgatttctgattactcctggactctaggctcccccacccctctctgccatcagctttgttccaggaagccccatttataccctaactttcacttcccactcctcttccaagaggaaccatgtccctattaggaaaagattttgtccttgcaccaggggttaagagaattgagagtaggagaggtgatgtctgtaccatgtcttttagttggtctcagtttttaaaaaggtctagtgaatgctcagttggattagactgtgtggtaagtgaaaaaagaatgaaaaatattaaatctttgaattaagaagttgttctctagcagggttgtaattgataacctattgacttgactgttgagtggtgagacatttaatatagagaatggcaaccctatcattttttagtgcccaagattataatattatttatttaaaagtgacatgtaaccttaacaatgatctgccttctcctgaatctttgattcttttctccaggcctactccggtgtacaccacgtgtccactgatgcctacctgtctctttgcaaatatgtaaaggtttcattcagctgcaaagcttggcgaaagtttatgaaacttaagaagaattgatgtacagaaggacagtgaaaaactttgccctgtctttctggacatatgttcttcatagctggacttcgtagggtggtttttacttaatgcctctagttcctttcaaattgtctcataacttgtaacttggttgctattcctttcatgcgtcgaaaattgctgtcttctgatgagatatctctgacttttcccaagtccttattcccgttgacttccatgtaatatttgagattattggactctccttccttccttagatataaaagcctatactatcctttattttttggtaaacttttttgatcgttttttcttttttcacctttttaaaaaaaattcctctaaatgcaagcagttcgtgtatttaattttcttttattaatatttatttttggtgaaatattttatacatgactaatcaggaaatataaataataataatatatgtatgttttatggaaatcgacttaatcttaccagtacttcctaaaagtttctctctattaatcactttccttctatcctaaggaatgtagtattttgaattttttgttcatcattttgtttcttttttctttaatttactttaaacaaatattttgttttatacagttaacaaatgttttataaatggtatcatgatttgtatattttttggctactcgatttttttttcccagtcaatatccaggtttatgtagtggtaatcatttttttcagtgttgtatagcattctatttttgaataagctgaaattgattattcagtcatttgtctatggatagttgggttgttttctggttttctagtggtaatatttttaaaaatgttgttatgagcattcatgtacatgtgtatgatattgctaagtagtgatattgctaagtcatgtggtttatgtattcaacttgttgactctaagctgttcaccaaaatgactgaacaattggcattccagctggcagtatgcatttctattgatgcatatgctgagtaacccttggtatttatttgcacattttcagattatttttcctattaggtaaagataatattgtggtccaaatttgaatttttctgactaccattgaggttgagcatgttttcaaatatctgatatttgtgtttctttccctttcatgttttcatttgtgtcttttgctcagttatctattggtttatctgtttcttatcaattgggaagccttcttttctggtctagatagtaatcatttgacaataatacatgcttgtcttggcttgggtttattttttcagtttcttatagttctttggacaaaaagccttaattttaatattgatttttttttgattttttttttttttactttacaaataaaaaaggaatgactttgttaagaagctcttcccagcactgaggttatttaattctatatttcttctaaaaattttatgatttgcctttccaatttaaatatttgatgactttgggtttgattttatatacagcataaagtaggatatttatgatactcttccttagtgctggattcatgcatatacatttttttctgtgtttttttctttgtttctctgtgtttgtcttgtatgtgtgtgtctatgtgtgtgtgtgtgtatgtatatatccatatatatatatatatatttttttttcttctgagctctgagccttctatctgcctgctagaaatttccatgttgatgtacatcaccttaaactaattatatctaaaatggaaccagtttctcacactttcttactccccctacatctaactggcatctagatcctttaaacatgtcctttgaaatgagtttttatctgatagtttttattcctactaccaccctatttcatgccatgtgacctgaacctcagacctccgaaatgtttcaagtatacctcttgaatttctgttttccccacacagatcatgtgcagctgacaccatattagtattaatttttctaaagtataaattttgattctcttaattttttttcttttgagacaaaatatcactctgttgcccaggctggaatgcagtgctgtggtcatagctcactgcagtctctaactcctgagctcaagtgatcctccctgcctcagcctcccgagtggctgggactacaggcacatgccaccacacccggctaatttttaaattttttttttcagagatgctgtctgcctatgttgaccaagctagccttgaactcctggcctcaagctactctggcttcaacctcctgaaatgttggggttacatgcatgagccaccataccttgccgattctctcgaatgaaagtaacattattaattcctctttgtcatagtaaagtggctggtccctaaggctctctctgtttcttgtctagccccagttctgttttataacatctgtcttctaacttagtttctctttaaattatcttgcatttttgttttcacttattagctcattccattgtatccattgctccactaactggcaaatagaaatccaatccattctatcattcttttggcattcatgattcactgagctataaccttcttgaatgtttttgttgaaataaaggtacagattcttatattttcctttattccctggtatggttaggctctgtgtcaccacccaattctcatcttgaatcgtaatccccataatctccatgtgccaagggcagaacaggtgaagataactgaatcatggggatggtttcccccacgctgttcttgtgatagtgagtgagttctcaggagatctgatggttttataagaggcttcccccttcactctgtcctgccaccctgtgaagaagatatctgcttcgcctttgccttctgccatgattgtaaattacccagtctcacgtatttcttcatagctgtgttagaacaaactaatgcattccctatagcatccatcataatagctagcatataacacataattaataaatactgagggattgattagtagaaggatactggtcttattctatgaaattgtatttgggttcttctgggtgaaattcttttaataacaattcatttgtgtagttaaagtttaaaggatgctattaattttattatggcaaaaatgaaacatttgagttttacttagaataattgacagaatctgtatttttctgaagatccaattttcaacctgcatggatagcctttctttcctaaattacttgttttttaaatgttaactataaatgtttcatttctatttgttttcttgatttcttttctttttgtgtgtttcttgactttctcagccagagaaaagtaatgctaccatagcaataatacatttagattctagtagacttgttttcttacatttctgttttatataaacaaggcgagtcatagtgaaagtacctagactaactattcaagcctgatatgtttatggactctttgtggaaaaaaggaaactttaaatcctctaagctactaaagatgtagaaggataatccagtattatttggtgattcatgtaaagaagaaaaataaaagaaggagaaaaatctggttgaagccacctctattagtcaactttatttcagatattaattagtctgcactaaaatgacagtgataagccaataaaatgatgactttgaaacgggaattcttcaaaaatctagtaaaaagagtatcgactctttcttgtcttctttttcaaacttactgtttagctcatctttatagcattcaagaaaagaatacttgagtagaataaagagctatttttatcttcagaaaaaaaattatttaagaaatatggaagtaacaaaataggcatgccagagaactgccatttgccactgctttttgagcagcacggtggtatatgatccatttcttaaactgccatggtgagttagagtgccttgtttctcacaagttttgttttattaaaaaaatagtttcttgtcttcttctctcttctaggttttatcagtttgttaactgtcttcctagctggactagggagcatgtgctgattgtatgtgaaaatgaactccttgggaatttagcgttctactgaattctcttgaacaaataaatctggagatgcttttctttgtgcaaagttgcatttctttaaacaggtaatcatcgttattaaacttagcaattggtagagttatatatgttttaatttcaagggctttaatgattattttctctaacaaccagattttagagactcataagaagccacttgatttgcacatatcacacacagaaagggttcttagtgagcctttccattcaactactttcaaaaaaacttaaatgttttatgcattttacaaataactttttctcttaaagtccaaccaaaggggtgttttgtgtatttttatcctttacatccattgaaattacctgttctgtatgatataatgaaacatgggtacttatttaagctaaaatatagttgctaaagttgggcctccctgatgttaaatgctacccccttcagtagtgacattaattaaagaaaacttgttaatttgtgagttattctaaaatactttctctcataaagaagctatgtttctccttctaactagtatacttaggttttgcttggcaagactatgtggaaagaggtcttatgtcaccccagcttagcagtgaagagcagaaggcactactgtgcctctcttggtctttttaggtaaaccacaggcaaaatatggagcacatttcagaataatgttaatgctccaaaattgcataagtcctgggctccaaaattgcataagtcgtggggctgtgacacaaccatcttccatgattgtgtttcagtctgactgcagtgttgcttttgtcttcgtagggtaaactctgttgtttcaacaggtatctagacttcaaataattgttaaatgagtgttgtaattgaaataatcagcccttggaactgcaatcattatgaaaattgtatgctctttaaattctatgtaaaaatagattgttttaaagaaaaaaaattcattttaaaaacagaaatgtgcttgaacaacttattttaatggaataaagttaagcaacgaatcttcattccacagctttaacaagtcttccagcttaaggtaatcaactacagcagatattattttaagatattgaggtagcaaagagtcctatctacttagagaatgtatgatttataatagaataccatgcactaatattgaacagcatcaacccatatgaaatcattttattacaaatataacctaggcagtagcatggaagagaactgatgagaaatatagtaggagtaatacactaacggatatgatctccaaatgtttattctctgtcttacttctcacctatggggccgctttcactccctaagggcttctcatagactgacaaagacctcagctccttaatgcaatgccagtaatacggattcataggaaaacttcccagtgaatctagggggtagagtttagtggaacaaaaaagggcgaccagctttggaagctgtagttaggaatggggagacaataggcagaactggagttagcctgcagatttagcgactgtaggtcagagatggggatgcaaaacctgaaatactggtgatgcagattgagtgaagtcagttgatttcagaaatgccttggagatgtaactgataggagtagaaggttattggcatgtgagtttagggaaggaaggcggacatgttgcctggttttctaattgtacaagcgtagtgaatcgtgatgccattttttgatacataagttatttgagaggaggcagattatgagtgtgtatgttttgtgtttgtgtgtgtgtgtatgtgtacactgtgagttgtggggttgaagatgctggtttaggtgactgtgggccagccatgtgccattggctcaaagtttgaatatttaagggttaggagaaagatcctaactaaggagccgttagcataaagatactgacagaagtgagaaggagctaagctagtattgccctggaagaataaacagagtatgaaaagggttcatgaataccaacatttatgatagtctatagaagagccagaaaattgagcctgcaaaaggggccagagaagcaacatataacgagttaagtacaaaccacaatattgagtaacaggaaatttaaaggaagagaatgtttcaagaaaggaacaggtaagactgacaaatcttacagaaatctcaaagaagttaaaatttaaaagatttattgactttagcctagaagactggttttaacttcttccaaatgcatgttttgagtaaataaacagagcaatggaagtatggatagttctgacgcacatgatattctgtttctttcctggcttttttttttttttttttttttttttggaattgagtcttcctctgtcgcccaggctggagtgcagtggtgcgatcttggctcactgcaagctccgcctcctgggttcacaccattcttatgccgcagcctccctagtagctgggactacaggcgcccgccaccacacccagctaattttgtttttgtatttttagtagagacggggtttcaccatgttaggcaggatggtctccatctcctgacctcgtgatccgcccaccccggcctcccaaagtgttgagattacaggcgtgagccacctcacccggcccgtttcctggctttttatgaaaatgatgtgttcttctggtttgtctttggttagcttttttgtttctttatttgtaatttagtctcgggaacttaagataaagttatctgtattatctgctattcttaacagaaggccaatttttgaatgtgctacaaaataatctacctaaagcaggcaagacaatataaatcattttatttttgcttatatagatccagaacataaatccctgagataatatcctcatcctaaaaggaagagtaaagtaatatagccttccagcttggaagaaaggcagtctagttatcaaataatatatgatcaatgatgatctccaactctaaagtaaactcaaacagtgtgtatattcagatgaattaaaaccatatattcatttagtatatgtgataagtagatgtgcatttatagaattactttcttctgaaaaggcaaaaagactctttttataatgtaaataaattaatgttattttaaaaatgaagatactatatgcctgaagttttaatgtacttttaaaaattggatcagagtgtgaaatcaaatgttagtgattaatattattattattatcgtaactaataatattaatgcatgtgcttaacagttctctcagcttcttaaatgttaaattttaaagcaaataacaagtacaatgcaaaatttaccaacacaccaatgtgatacatacttttacctattatttttttttaaaagagagtattgaaaaattatcattttggtttaagcatttgagcaaacaaaataaaatttctgattttaagatttaaaataatgtatgagtaaaaacattattttgggaaaaatgaattgtattaaaagaaatgctgaaattttttacagttggacaaattgctatatttttgtggctttattaaaaatagaaatagtgatatccaccctccattaggggaaacattcacttgtttattcaagaaatatttttcaagtgtcttcttcatgccaggcactattttcagtacttaaaatgtaacaatgggtcaaagaaacaagtcttgactctgaaaaagctctcctgttggggaaggtggttacaaacaatgaacagctaacattataagtaagactagatggtagtacagttatgggaaagaagatagagcagtgtggtgggggtggggtgtgtatgttgaaatctgggaggtaaggacatattgtaattttttttaaattttattttattattatactttaagttttagggtacatgtgcacaatgtgcaggttagttacatatgtatacatgtgccatgctggtgtgctgcacccattaacttgtcatttagcattagttatatctcctaaagctatccgtcccccctccccccaccccacaacagtccccatactgtgatgttccccttcctgtgtccgtgtgttctcattgttcagttcccacctatgagtgagaatatgcagtgtttggttttttgttcttgcgatagtttactgagaatgatgatttccaatttcatccatgtccctacaaaggacatgaactcatcattttttatggctgcatagtatatgtgccacattttcttaatccagtctatcattgttggacatttgggttggatccaagtctttgctattgtgaataatgccgcaataaacatacgtgtgtatgtgtctttatagcagcatgatttatagtcctttgggtatatacccagtaatgggatggctgggtcaaatggtatttctagttctagatccctgaggaatccccccactgacttccacaggggttgaactagtttacagtcccaccaagagtgtaaaagtgttcgtacttctccatatcctctccagcacctgttgtttcctgattttttaatgattgccattctaactggtgtgagatggtatctcattgtggttttgatttgcattcctctgttggcccgtgatggtgagcattttttcacgtgtttttggctgcataaatgtcttcttttgagaagtgtctgttcatgtcctttgcccactttttgttggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaggctctttagtttaattagatcccatttgtcaattttgggttttgttgccattgcttttggtgttttagacatgaagtcctttcccatgcctatgtcctgaatggtaatgcctaggttttcttctggggtttttatggttttaggtctaacgtttaagtctttaatccatcttgaattaatgtttgtataaggtgtaaggaagggatccagtttcagctttctacataaggctagccagttttcccagcaccatttattaaatagggaatcctttccgcattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcagtgcgggctcttttttgattccatatgaactttaaagtagttttttccaattctgtgaagaaagtcattggtagcttgatgggggatggcattgaatctataaattaccttgggcagtatggccattttcatgatattgattcttcctacccatgagcatggaatgttcttccatttgtttgtatcctcttttatttccttgagcagtggtttgtagttctccttgaagatatccttcacgtcccttgtaagttggattcctaggtattttattctctttgaagcaattgtgattgggagttcactcatgatttggctctctgtttgtctgttattggtgtataagaatgcttgtgatttttgcacattgattttgtatcctgagacttcgctgaagttgcttatcagcttgaggagattttgggctgagacagtggggttttctaggtatacaatcatgtcgtctgcaaacagggacaatttgacttcctcttttcctaattgaataccctttatttccttctcctgcctaattgccctgaccagaacttccaacactatgttgaataggagtggtgagagagggcatccctgtcttgtgccagttttcaaaggaaatgcttccagtttttgcccattcagtatgatattggctgtgggtttgtcatagatagctcttattattttgagatacgtcccatcaatacctaatttattgagagtttttagcatgaagggttattgaattttgtcaacggccttttctgcatctattgagataatcatgtggtttttgtcttttgttctgtttatatgctggattacatttattgatttgtgtatattgaaccagccttgcatcccagggatgaagcccacttgatcatagtggataagctttttgatgtgctgctggattcggtttgccagtattttattgaggatttttgcatcaatgttcatcaaggatattggtcttttttggttgtgtctctgcccggctttggtatcaggatgatgctggcctcataaaatgagctacagaggattccctctttttctattgattggaatagtttcagaaggaatggtaccagttcctccttgtacctttggtagaattcggctgtgaatccatctggtcctggactctttttggttggtaagctattgattattgccacaatttcagagcctgttattggtctattcagagagtcaacttcttcctgttttagtctttggagagtgtgtgtcaaggaatttatacgtttcttctagattttctagtttatttgcttagaggtgtttgtagtattctctgatggtagtttgtatttctgtgggatcgataaagaggtgatatcccctttatcattttttattgcatctatatgattcttctctcttttcttctttatttgtcttgctagcagtctatcaattttgttgatcctttcaaaaaaccagctcctggattcattaattttttgaagggctttttatgtctctacttccttcagttctgctctgattttagttatttcttgccttccgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgctgtgtctttgttctcattggtttcaaagaacatctttatttctgccttcattttgttatgtacccagtagtcattcaggagcaggttgttcagtttccatgtagttgagcgattttaagtgagtttcttaatgctgagttctagtttgattgcactgtggtctgagagacagtttgttataatttctgatcttttacatttgctgaggagagctttacttccaactatgtggtcaattttggaatagatgtggtgtggtgctgaaaaaaatgtatattctgttgatttggggtggagagatctgtagatgtctgttaggtctgcctagtgcagagctgagttcaattcctgggtatccttgttaactttccgtctcattgatctgtctaatgttgacagtggggtgttaaagtctcccattattattgtgtgggagtctaagtctctttgtaggtcactcaggacttgctttatgaatctgggtgctcctgtgttgggtgcatatatatttaggatagttagctcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccttttattttgagcctatgtgtgtctctgcacgtgagatgggtttcctgaatacagcacactgatgggtcttgactctttatccgatttgccagtctgtgtcttttaattggagcatttagtccatttacatttaaagttaatattgttatgtgtgaatttgatcctgtcattatgatattagctggttattttgctcgttagttgatatagtttcttcctagcctcgatggtctttacaatttggcatgattttgcagtggctggtaccggttgttcctttccatgtttagggcttccttcaggagctcttttagggcaggcctggtggtgacaaaatctctcagcatttgcttgtctgtaaagtattttatttctccttcacttatgaagcttagtttggctgaatatgaaattctgggttgaaaattcttttctttaagaatgttgaatattggcccccactctcttctggcttgtagagtttctgccaagagatccgctgttagtctgatgggcttccctttgtggataacccaacctttctctatggctgcccttaacattttttccttcatttcaactttggtgaatctgacaattatgtgtcttggagttgctcttctcgaggagtatctttgtggcattctctgtgtttcctgaatctgaatgttggcctgccttgctaggttggaattgagtagtctgagtgggcttcattgagttgatttttgagcaaagatgtgaagaagacgagggtatattctgaataggtatctactagaagagccagggtaaaggccctgtggtggaagcatgcctgtccatgggttgcaaggagtcactgtggctagatggcagtgagcaagaaggggagaggagaaagaggagaaggaggttaagacagggagggaattgagtcaggtcactttagaaacttgttttgcttcgaaggacttgcccttgactcagaggccatggagagtcattggaagcttttgagtagagaaacttgctaggaacttgatttcagtgatgttaatcgttttttatgttctttagagcacactctgtaaggatgtaagtctaaacttttcttttttagccttttcaacagtaagctatacataaaagttacagtgtagcctactggccatgaatagaagtgctatgtgactttatggtgtcctgaagtttaaggtatattagctctgcatatgtcctgtttccagaatcttaaaaatttaattttggagaatcaagctttgtttaaaataatcaccttaatatgtagatgtggaaaactaacttgcttaagtttattgaaccggatttaccagagctagaattagggtttaggtctcctgactataaatgagaatgagaagcaagaaccaaaaagtatcaactgtgatcagatttgtattcggcactttacttattttgtaccaagctaggctcagtttcccccacttaaatgacattgctgcatcttttacacatttctttgaccaggtgttagtagatcattgcttttactacttagtgttactttttaattagtatgtaaaaaaatccatcctccttttcctccttagcaccaatttaaaaaaaaatcttgctttgtactcacttgagaaatacttgcaatccattaccagcctatggtttttccgtatcctgtaacagaggttggcaaattaccaccagcaggccaaatctgtcttgtggcttgtttgtgtccactatccaatagtggtttttacacttttaagtggttggaagggtagaaaagagaagaatcatactttatgacctgttaaaattattttaaagttgaaggacaatagtttgaaagtattcatatgttgacacatagtttattgcatagtttgtatttcaaatgtaaattaatcatatagttaaattttgaaagagaatcacatattactgacttaaggacttccaaactgtataatggaatcacatgtacaattatgtatctgtttatgtggaaacagataaacatatctgtttcatactgtaattctaaccatatgtctttcttaattactctttgttcctcaaagtctatggtttctttttgagttggtcagccctctgttctttactcatatttacaaacttatcattatgtctacattcataagttatttaataaaacttatttgaatttatgataaagcagaagtagaatgtatattatacacatattatggaaactttgcacttagcatgccttaagtggataaaaaagcaaaaattggcttcttagccaatgtgaaatttaggtaaatcttaaacttttgttttttactgcagatatatttttaattactatcagatataccctctgtctaccaaaatgatagagatgaaatgcaataaactttgtatcttttcccaaaactgtaatgtggtaaattaacttaataaaaatttagtatgaaaaatgcaagtaaacatttccagacttcactaattgtaaatggaaacaagatgctagagtctgtgaaacccaagaggactctaaagaagaccagcttggtaattcaagtaacagaagagaaatagatatgaaacagcatttctacttcagggtacactggagaaagaaaaaagaaggactcctttatgcatcattccaagagaaatagggagaaaaaaactgtgtttgaaggaaaggctgtgatttaatcaataatggacaccttagaaagactgattcttagcaccagggttaggaataataaaataatctgctcatagaaggcacagcaaacattgatttcttctttttaagaatatttgtttatatgatcaaatttactaaaataaaccgttaattacagtgtacatttaaataatgtacttagtttactaatgtatcaaacataaacatttttaattgtccttgtggaaaaatatgtaatatgatggagatggggaagtataaaaaaagcaaagattaaaagaaaaaagaatcatctacagctataagcacaaaggctccatcacagggatatcaagcatgtttcccttagattctgtcatatgcgttactgtctgcttgagtccatctgatcacaatgtatgcacaaggaaacatgtctatgatatgatcgtgtgtctcttttgtgctttttgcacctgaattgtctgtactagagaattgcaaaacaagtttgaaatgaattgtacctcttttcctcagttagttttattgttattgttatttaattgtagtaaacctaagagcctgtaattcagataattcctggaaaagtattttgatcaggcatattggtttggaataggtctgagctttgcattctctaaaattttattacatgctttacttcttccatgagatactggtaagtgatgtttggtatttctgataaggtcttagaaatcccagtccaattaaataataagggagtaaaggtttatggaggtctgcagtagaggatcactattgctatggtttgaatgtatcctctattaagagggaggacttttaagagatgattaagtcatgagggcacctgcctacacaaatgggtttaaagcccttataaaaggtgttggcttgtggggttttgttttgttttgttttgccactcaccatgtgaaaacacagcatttctcctctctgaggatgcagcaacaagtcaccatcttggaagcagagagcagccttcaccagacaaccaaacctgctagtgccttgattttggacttcgcagcttctagaactgtgagaaataaatttgttttaaattacccagtctctggtattttgttatagcagcataaagtgaactatgacaaaacaatggctacctccacttattctatactgatatatttattgcattatatactttgactttcataataattgtatgaagtgaaatatgttcattttataaagaaaaaaactaaaagcctgggtgaaactttcttaaccagggtcacaaagctaatacacaccagttggctgttgaaccccaaaccatttcactatttggctattctttgaccaccaagacacttttctttctttaacaaaggttattgatggtctgtttgcaagataggcattcatttaggtgttggaataaaaatataaattacccacagctgttgcgcttgtctagcttctgtcttgtatggggtgaaaataattataagtaattagtcaataaataattacattaaaattcaaatactataatggatatatgtcaatgtactagttaacacagagtaggattatctattacctgagactggcaaagaaagaattcataggacggatgccctatgaactgcatcctatttttaggaaaagaggaggaaggtcatgacagagaaaataacacatataaatccaccgagttgtgaaagaaatgttctgggagttatatttctttgtgtctgatgcctggggaaaataaatctaaaataatatctgaaatagaaaccagtatttccaaagggaaaatacattatgctctaatttattcacatattaatttttagttttgataaaattgcaattagaatagcaatgggattgttatttaatatattttaaaaatattcatctaggtcagtattcttcaaagtctttttaaaaaatgcatttggacttttctaaataaatactatgagaagatttatgtttacaatatatggcataatttccatgagaaatatgtggaatacaatcaggaagtcagcaatacagaattatctaaaacttattcatgtaagttttactgatatttgttttatttttctatgagcaaaataatttttctttgggtatcctcaattgctttttacaagtccatgtgatatatagtaatctatcttattgatacctacggatttatttaattaaaatagttttttattggtagctgatgataccttctgcaaagaatgccatatttatcttttcatttctaacagtggcatattttatttctctttcatgatatattgcattagcgtgaacttctaaaactgtaggtttttcttcaattggttaaaggagttaaaagttgtggtgagagaactttgccctttttctacaacaagagtagttaaaaacaaatgcctaccagggccacactgtagcataaatatgtgaacagggatgactgtaagaacacagaaaatggcagagcaagagaaattgagaatgtattgtgttaaaacaccatgccaaacaaacacaacataagtttgcatatgcaagcttgatgcaggtaaaggactgatggaggtgatcccagttgagaaagggtatagtactcctgaagagattgctcattataaccacagcagtgggagaaatatcactgtgctgtaagagctgctaaattatttggtatcaatgggtattgattgcaaaacaacatggaccaatgaaagtacagggattttgaatctgagttcaaattataactcagttccttactagtattgtgatcttggacacgtaacttatagtattagttttctaatttatcccataacaaattgccaaaaacttagtggcttaaaattacatttataatcttacagttctaggtcagtagcctgacatgggtctcattggtctaaaatcaaggtgttggcaggaatgtgttcccttttagaggctccaggaaagaatcttggcttttgtagcctcagaaggccatctacccaccttccttagcttatggccccttctgtcttcaagaccagcgacagcagggttgagcccttctcccattgaatccctctgacctcttctgtagctacattgcttcggagtcttatttttctcttttacttttaaagactcttatgattacattgaacccacctgggtaatccaaggttaatgtcacatttcaaggtcacctgactggtaaccttaattcctccttgccatgtaacagcattcccacattctggagattcatatgtaggcatttttcaagaagccattttgtctactacattatcttttaatttctttccttatttataaaatgagactgttctgaagattaacagcaaaaaaaagataaagtatattaaatgccttgtttaataccaggcatatagtcagaattcaataagtgttatctgatgctgtttcctgcattgcttttcctattacacccttagtttttggcttatagttatcctctatttttaaaatcaatcttcagatatttttcaatgattaagagtttcattcagtatgttgcttttacactgataaacatacagggtataagtttaaataagcttaaaaaattaaattgctaatgtgtagaatcctttaaagcagctccagttctctatcctagagaactggcccctgttcccctaatctctacaccagggtttcccaagcctgaggaggtattctgatgaatgcctggagtacttggtaaactgaaatctctgagccccataccaaggatttctgacacggtaggactggggaaagacctgagaatttgcatttttaacaagtcatcagtgtatgtcatcagtggatactgatggctttggtctgtgaccacagtttgagaaccagtgctatagaaataatggggttaatttggctttcttcacatgtgcagttaagcatatctttgtgggtttttttggatgctagctctccaaatactgacaaagtctgcttagtggtagaaaatgtcagttttaagtggtaatgcgtaaacatttttctttatcccagaatgcaaatctaccctcaaaagcactgttatttgaagtgaagcaaattgtaaccatagagtagatatcaaaacttgtgtgcctttctaaccaaagaagcgcatctgaacaagattcatagggagattttggttgtttcccatctttgttcagtcagtttagctggctatttttcagttttgaaaattgtaaaaatggaatggttttccatctgattgtgttactgcttcacaaatcaagtgtcttttaataatactgtcctgaagttactaaatgtagtgccattttttgccacatgacatttatgcagtgcaaagatacttcattattatataaggcatgaaaaacaaagtgttaaattaataatattgtttgacacatccttgaaattgtccttgaattatggtagtatgaaatacctaacaatttgcatcatgtttaaactcagattgctttgatataggaatctagaataagtttctgaaacttatttcatctccataaagtatattacggtggcaaaggtcaaattttctgtatttatctatgtgttaagaggctaagactttaaaaggaggaaaaagagcctagagatgtctcactaaaaccttcaaatatgttatttaaaaggtatcccacaggatcaattgctctttattaaaaatatgattttttaaagaggtttaatgtcattgcattgattgaacaacaatagagaatcaaatacattgttaaagaaatttgacctttaggtcatttaaactgtaagtcagacattctatttcaatactttgaactaagactgtacttagattttataaatttgatttgtggctcattttcttgaagaatagcacatataacaaattgtatttggtgtagtgttaataatgattgaaatcttagtaagacaatataattggacatttctggaccctgaaacagacactgcttctaaaactttgctgtgaacaagaatttcaagtccattctagtggtttataatgtcagagtctttaagaatcacctggtatgcttttcaaacatgcaggtccaagggccctaccactcagaaatgatgactttccatatctttagtagaacttagaaatgttaatttataatatatattttagatgggtctaatgcaagtagttcagagacaccacttcaagaagcactggtgcacgctgtagccatagtgaccatagatttggtggaagtaagaatggattgctgaacatgggattcagatggaaaatggaagaaagccaatgcagtaataagaaagaagaaaggtcaggagcttgaggaaacaattataccaagagaaggtatttcatacttttaaatttaaaagtgctaaagtggtatttgctaatttttaaggaattctcagttttcaaagctaggttccactaaattatataacatatacttaatgttaactgactatagagtgtgaagggggagagtatttcaagcatatgaggatgaataaacagttttttcctaaaagtatttgtaatttaatatagtaggtttcaaatgttcttgtttcatcatttttatttgaggggtatcttacttgtaattctaacatcaaaagcagaaccagatgtctaaaatctttggtttgatttctaacagagctgaatcccatgcccttttatcctctgtttcatgtattccacactcttctaaagtagagcattcttaaagcatcactatggaaattctaggattcttcagcacacaaattgaaaatgattattttagaaagttctcaatacaaaattgagtatgcagatagagatattttcacatgaaatggggaaataatctagattcacttttgtattattatatccaaagcgtatagatgtagacttcaaaaaaatctgtgaattaactgatataaaatttagtatttaatgtgctgaaagccatgtgtgtatgacaagaaacgaatcttggatagcatccatatttatgaaagaaatacaaagaacccccaaaatgagaacagccaacgagtatacagtgaaataactttcagttttgtgaaagctagtgtagtcaagtgtcaagaagcaagctatcacagagccagaaatctgaagaataatctttgtatttaattatacagtctgcttcaatgagaaagcctccagtagagatttgagtgaagaagccatatctcagtgggaagacaagttagttggagatgataaaaaatagaaagtaggtagggagtagaaaattggataagaagagaatgtttggacagtagccacaggataatcatgatcagaaggctttttaaaaaatgaaagaaactacttgagcatatttataaaaggctaatggaaaggagtaaatagaaaggggatgttaaagatacagaagaaattgatgacagacggaatgagatccaggaaaagcaaatagtcaaatgcttagagttggccctgaacagctaacgtcagctcatcttccaagaatgacggaaaggaagtaacaatagagaggatgcacagaggtttttagcttggtgacaagaagttaagggcaatggtgtctagttttgatgatttgtcttgataaagtttgaaaccaaaaagtggctatactgtggtttgtgatgttgaatttacaggtaagaggaacttagatgatcaactgtgaggttgaaggtagataaaagtttggaagtccctctgaggtgaaagagcagacagtgaaaggaggttttggattatcatcacgcttgggagaaactctgcttttgctcatgaaagatttgctcatgaaaatgtggaatacatgaaacagaggataaaagggcatgggattcagctctgttagaaagataaccactgcagttgtctttctgagcaagagttttcggacatggtcttcagggaagacagtactgctattcctgatagatgagaaacaaatgaggtgccccctacgttcatcccaattcacagcctcttggtagtatctgggcctggcagagggagaggaacctaaataggatctagcactttcacttgatgggaggagactgagatcagagctggggaagctgaggcagtgagacattgtagggcaaggaactggagagaaagaagatgcacagaaagaaacacctccagagattaacagagggatcatttcaaattggaatatatatcaggtaaaactttaagaggcaggatagaaatccactgaaaagcagtaggacaaaaaaattctcaaaattcacccagatctgggaactagttggcactcccatcagccaggctagaaaaccttcataatacacaaagtattggatagagtgttcaaaaagatactgccttattagtgggactaaattggctttactctgaaggctacactaacaaagctttaaattaatctttgtgagaattagattaatttacacataacagtgtgcacccctcaaaagcttgatattctttaaaggaatacaacaatatccagcatcaaacaatataaaatctgcgtgcaaagaagcagaataacatgaactgtagctagtggtgggaaacaatccatggaaacatacctgcaaaaggtagagatgaccggactagcaaagatgttaaacagctattaaaaatatgtgctgtgtgctcaagagagaggaaaatatgaacataataaggagagaaatggaaggtacacaaatgaaccaaatggaacttctagagatagttcctatacaaatcatagcaatagaaattattgaaaatgaaacacaaacagaaaaaaatgtgaaaaaagattaatataagctcagtgcactgtggggcagtatcaagtagtctgacatgtaattgggtttcacagcaaaagagaaggagaacaaaaatatttggaaaagtaatggccaaatattttctaaatttgatgaaaactataaacgcacagttcgaagagcacaatgaaccccaagcagagtaaatgtaaagaaaacaacaccatgacgtcacctagtagagtggctgaatactggtgttaggagaaaattttaaaagcagttagagaaaaaagacaggatcaccactggctgctgtggggagggtgcataatagaggcagggcaagagcccagtctttaccctgggtttggttacagagacaacagcttttaaaagtaggtgattctgggtcccgtacagaaagggatttaacaacagtaggatcttccagagggctcgtggatcacggttcgaacaaggcaggggaaggagtcataagattaagtagaactttctggtgcccaggattaaggattgaggtcataaagaatgacctcaatatttctaactttcctatgacatttctttcttatttatttatttatttattttggagacttttttttgagacagcgtattactctgttgcccaggcaacagtgcagtgtcacaatctaggctcattgcaagcctcccgggttcaaggaattctcctgtctcagcctcccaagcagctgggacggcaggcacacgccaccatgctcagctaatttttgtatttttagtaaagatggagtttcaccaagccaggctggtctccacctcctgaccttgtgatccacctgccttggcctcccaaagtgctgggattacaggcatgagccaccacgcccagcctttttttttttttttagacagagtcttgctctgtcacccagactggagtgcagtggtgcaatctcagctcactgcaacctaaacctcccaggttcaagcgattcttctgtctcagcctccaaagtagctgggattacaagcacccgtgaccgtgcctggctaatttttgtatttttagtagagacagggtttcaccatgttggccaggctggtctcaaactcctgacctcaggtgacccgcctgccttggcctcccaaagtgctggaattacaggcgcaagccaccacgcctggcctcctatgacatttcgatataactggctcagattctcagatcatgaccagcgtggcctgagaacattagaatttgctacaacatttgcaaagggatggcaaaagtcagtttttatctgtttttgtgtaatttgggtaagaagacaacagtattcctcttagtatattgtgtatgtataggagagtattggtatgtaaactgagaaataataaggtctccatttgtttcattcaactttatattctttttgtgtaacacaatgctagcccataacttgagacttaaggtatttaatgaacttctgtatactcagttttaattggtggcagttctttaataccagaaacaaattaaagtttttaaagttgacaacagaccccacatacttcccagtcaagcatagtaagaatgacatgaagttttattaagtaattgtatagtagagccctacagaaatttgcactctagtttccttagctttacagggaaggtgacgcttctgacctactttgtatgcattatgaacattaattataaaacatcatgtactttaaaaaatgtcctataaatgcatcttttctgtaaatatcatgcagattttaaaaaggaggtcatcttgtttttgtcttccaaactccagtgaaacagagaataacctttaggagttttgctgcaaagtagaaacattcattcttgcattggacacttttcattgagtgaacatttgaagcagggtaccacatgagatcgagttgtagaagagagaatttctgtcctctcagaacaaacacacatgggtcagtatctataaacaaatcagtatgtgaaaagtatcatgtgattagtccaggatatgtgccctgattgtgaagggtggctgggggccagggtgctgagcatggaggtggaaatcaaatctacataatgtggaaaagatgaccaggatgaaaggcatttgaattgttagtacttaccctggtgacagcaggagagagacatcatagtcacaggcattggcatttaaaaggtgctttgggaattgagagatgggcattttctgtgaattacagaagtccaaattgagtaggagttgggctttgttttggaacagaaattgagaacataagaggctgaatggagccagactgtgaagagctgtgaatgccagcctaataagtttgagctgtatccagtttttgaaaaagagagagagaaacagagagaacctcaaattttaacctgcaataaataccttcagagtcttgcttcagggaaatttaattttttgccatatgtaggccacatggagtcaggcagacttgttagtgggtcattgtggtagtctaggtatagtgagctaatggcctaaaagtgaaatacaatgcaaaagaaaaatgaagaatagataccagaaagattcttaggaactggtgataacatactacaaattgagtggatctttggctaaattgctgctttgtggctcctttcaagggcagtttatttctaactactaaacctattttcttaatataataaatgctcttgattttaattttagtatgaatatgtgcattgcttctatttatattatttttcggtctgtatacttgtatctgaaaatgatagtttaggaatggtcatattttatagattgggccattgaaaattatttaatttaccagacaatgtttaggaatttatagtgttaatgacttacatataaaagttcatgctttctaaaaagccctctctttcccccagcattattacttctgagatatgagaaggaagaattaccttacatttggctttataactgagaaattcttctcatacatcaaaaatgtactaattgtattttgagctctcctaaatcacttttgctccttggtttatatatatttctgagtcttgtttgttgactagaatggactctatttcagagcttctgctttttgtttctgtgtcaccttgtcattttctaaattgattggggcacccttgggggaagtggtctgtgaaggacaagtgtgcaccaaggactctgtaggcagggcaggaaaggagtgagccttgggggcgagcacaagtcaaacacaagctgggttcttcctgtcctcaccttcctggagaaatcaggacactttgctgcgggaaagcatgacctgttttaaccctttgtggtgggggtgttttgttgcaatactgctgtgggaaggcaccaccctttcttgttttccacataggactcatatattcatattttttatacttattctgccctctaatctctttctgcagccatctcattcattttcatcccaactaccattccgttttgtacacttatagctatattattgcctctttatctcacaagttgtggtatgataaataagtgatgtttgtacactgtttttgcaaaaaagctcacagtgctttctgggggtatctactaattaatctttacagaatccctatgagatagatagggctggatagggtattcagcacacaattcactagaccatgctgtctctctattatgataaaggattattattatgttaaaatgtttatacactgaatacataaatttgtagagattgatgtaaaccgaatcccttggcaaaaatatgaacatgcctgtagcataaaattgcaattgtgaagcaggttttatcaacttctggtgtttaaagaattattccagatttgcacattaaacctctgttggatagcttgttttcgttatcttgcctcttggggaatgacagggagcagtgagctactgaacttctgggatttcagcaagtgacaaactcagattcttgatagcgttatttaaaaagtatagcaagctcctctggcttgtgtgtgactcatctacatgtatataatagcttgattgacttatataattagtacttttatgtttatatactgataatatttgtggaaatctagtcaggtattttatgcttttgcagagtttgatgtggattagctgcattgccttttctacaaaagcaaacaccctgaagagttgtctcctttagggagggagcttcactcttttcagtcaacagccatgtatagtcctaagatgctttagtagtgtttcccccaccgtagcatatggattcactggggaaaaacacaaataaaccaggcagcagaaaagaaaagctagagaatcagttctttgctaatcttatgctatcacttccttctttttttttctctcaatgagtccatgttgcttttctctctttaccttccctttaatttcttttagctgttgaacatgtcaaaaactgcagctgctcatgaactcctatttcagctaaatacgtaaagatagattaattctgatagggattcatggaagttgaaagaaacttgagtttgtgtataagtatatggccactggcttgcacctctctgccttctattaggattccaagagagagggatgtagagtgggtttggaattggtgggatggtaagtgcagagatagggggttttaattcctaggcacagggggctccaggaagataggaagttctctaatcaccgaggtacagttctgcttccagggaaggatttatggaaagtaacaaaatatgtatacagtccctgattctagactactgagtgccaggcataggggtgttcttggaggtttctaagacagagaatagggtgataaaagtgaaacaatgggaaaactaacttatcaacttaaactccctggttggctcctgaactctcttccttcagcctttgcccctttcacattcatttggaggaatatttgaggggagaaaaaggagtgcgggaaggataattatattcttcctaaaatatgcgtaagatacagatcatttttggataagtgaaacctaaaaattgttttctttaccattagaccctaaagctcaatcagcacctcctgccttcgctttatttggagaagtccacatctggctggccctgttctcagatactggccttgcctgcttggtcttggcctgccctttgattcctgacctgctctgcagggttcagcagagtggatcatgttacaggggtcagcaggatatcaaactgcctttctgtactgatgtagagaaatagttactgctttgtgctataatatgacccaatgtttgcaaatacagatttctttctcttctataatcttcttaaagggtcaaaataagaaatcactatcacctagatttttttttcctaaaaagtttgattcgattaactgggaagttatttttttaaaaataattactcaaagaatatgctacaaaaagtataaaaatagactttaaaaatattcgaagtcccaaacatctaacataactacaattaatttattagcattttccagatttttctaaatatatgtttcacatactgtgtgtgctctaacatattctgtttgaaaatttaaatgttttaattgaatatgttttcccactttattttgatattgtttttgtgaacataattttcaaagcctggaacatatgcttaagaaattattatagttgaccaagttattctcctaatgattccatactttttctcttaaattttatatatatctttaaaaacacattttatattatttccataaacttaatttcccaaaggtgccttttgaacacagaaagtatggccaatgggctgtattgttaagttgctttctgaaagcatcatgcaagttacctttgaagcttctgtgttattagataatagtattttctttgataaactttcctgataggatagtcacaaggaggagaaggatagtgataattttcttgctactgagatcatataggaacagtattttaaaatgtattcactgacattgagaagctactaggagctcattattgtgttaagtgccagcctcccagggatgagtatgcagaactctgtccctaactttacaggtcctgaggagagtctggcgtaggatacctggttaccaagaagcttgatgagtgctgtcctggagttttgagttgagagctggaggaggagatattaagtttgataaggaaatagagtagtttaactcaagctgtgttttcagatttaggagatggggaagaggttaattttgtttctgttgatattattcatacatgcatgaatttaaaaaattgatgctaataaaggaaaacatcaaaaacccttaacacaattcatatacacacatgcatgtccaatgggtctgttctagtaagtcagtgattaacaaagactttactgcctgatgataggcttttccaggctgatggcaactattatttataaatatgctgtcattgagatgggaaatggcttgggatggaatgtgaggagttgttaataataagggcgttagctgtgatccacgaatactttcttccactcagtacattaaaattttggaggtaaacatgtagcaaaaattgtatggctacttttgtcaaaattaaaatagataatattttaatcttcactttggggatacattatttgcattccccattaagcctaactttctgaaataatgcttcaaaagacacttggtaagagtgttttcttccagtggcttcacgttaaaaaagggaaaaaagaacggctctttggttaacgtctggagtatatgtctacttggcttccaacttcattgatccctgttgaagtagctgctgccataacagatttacctgataagcaattctgcagttagctgaggaaagccattcattggggaatgagtccagttattttgtgtttttaattaaaggtatctaatgctggagtgcctgttgtttttccattttcttaaacatcacaaatcaatatttttttaaacttctcttaatctaggggctgacttatgttaattttttgttgttgttaattagaatcaagctgtaacacattcacagaacaggcatacatgctaaacaatttttccagacatctttttttttttttttaatttaacctcagtagaaatttgggggacttgttctcccagggatttgtatgatttccagctctgttacagtcaacttctaatggctcacagtctgagcctctacataagtgcttaggctgtatctcagagtgattaatgactgagtaggaaagctaaacacacagcactttgtgaactaaagaccagatcaaaccagtctggattctacccccatccctggcctctttgctcaggaccccatcctggactgttattactgattaaaaatcatctctcttttgatgtctgaatgtgttggagtgtaacaagagcactgacctgaaatgaggaggttggtatttgaaccgaacttgaacattgtctctaatacattttatcttattggatgtgtctcattatcatagcctgttaagaattttttatagtaagtttttcagacagtgcattcgatgtgttttatagtcttgtgtgtttgagaagtattagttagttatgttatctttcaagtgtttgataataatattaaataataagtagactaaatctaaagaccaagcccagtggccttgtgcaggatggcatctttctggttgataacaatgcattagtcaatttttttccagtatagaggttagactagtcataaagtgacattactttgttattatccagctctcatttctgcaccttgcccataagtggagggtgagagattctttcaaatgctttattgaaatgtagacatattaagacctggccaggtgcagtggctcacgcctgtaatcccagcactttgggaggccaaggtgggcagatcacaaagtcgggatttcaagaccagtctggcaaacagagtgaaacactgtctctactaaaaatacaaaaaattacctgggcgtggtggtgtgcacctgtaatcccagctacttgggaggctgaggcaggagaatcgcatgaacccaggaagcggaggttgcaagaagctaagatcacgccattgcactccagcccaggctacagtgcgagactccgtctcaaataaataaataaataaataaataaataaataaataaataaataaataaaaaacacaaaaacacctgcattgtttcctttacctatttttatggtactactagcttttttgggaaaagagccagaaagtattcatttaaaatgtcaatagaatttcaccaataatttggaaacactgatttgtaggttttttcttttaaaacaaactcaatttattccatttaaaaaatatttggactgtatttgttctcatgttctcatatcatgcccatttttgtcagtattagcaaatagcaaattagattattcagcccctcattcaacaaacagttttaagtacctcagatgggccaggtacttctgcaaattttctccataccttaggatattctttgtttggactagaagactagaattaattcaagacagctattcaaacctaagccatttgctgaggtcgattcataaatcatgttaaaatgttagtctaacctcacataaattaatatgcgtcctttccccaaccttcacttctttggccaggagatgaaagctcaacatggacttcccaccccaggtattgatctcctttcagaatctgcctctgtattactgtttcgagagtcagggtcagcaggaatattgttttgggagaacaggtcacatattgcattagagtaacatatgattattttctgacctctcttctctttaacttaattctcagtgttttgacagagctcttgcatgcctgttccctaataaaggacaaaagacaatcattttcttatgacagtttcgtattttatctcaatctaacagcagcatgaattgataactacttgtacaagtaatgttattttatttggttcaatgtactatgactgacttttatttaaaagacccgttctgcaaattaccttggtttatacttaataggtagtttttataagcttagctccaagttaaacgttcaatgtttgttttattgaattactttctatatgaacttgagtagacagctgttttcatgttagtgagacttttttttttttctttcagactgacactgttgtgccaagctataaggagtagattcttcaggcagaggtcactcattgtctttcagttagagatttagaaaaacttttctaagctagtgctcctgtggtattgcatgctacaaagtggggaggccctttgggacatggtcaagtctttttaaagatcaaatcctcaatttttggaagagtatatatatctcatatacacagtttcttaaaatttagggtttgttgagacacatggaaaaaaatttaaatgccactgttgagtaattttatgctgtatactttttcagggaatagtcttgaactcatcggtgcccacaacttagagaaataatatttggggaacattatttgaaagatacgcaactccttctatgtttcttcattttctaaaaatctatccccaaatcaagccagatctacagagactggcacaaggaagaatcagtttacctcccaatggaattgttttactgaatcacattacactgggagctgcttgctgcatttattgccagaaagcttaaagccagtttatggctctctaataagaaatatataaatgtttatggtaaacatgtttgagctttatttctggctctaattgatggctttattcccatttttctttcttctttctgtccagttttacacttctggaattttcttgtggttaatatatcctttcagcttcctttagtcttttctagaatggaggcagaatctaaataaacaaatacaaaacatctgcagtagaaaaggataatgagaaaagaatgattttttctttgaacttctgttctgtggtcaaagacaatatttctgctttcttaaataaaatagcctggtaaatgctattagtagacaaataaagaaatttgtatttaaattacttacagataccataaaactttatatgtgttgcctcaagtagaatcttatgctcttgttgttgaataatttagtatattggcatttatagttaagacatcctattttaacatgattttaatagtgaatcacttaatatttaattaaatagttaatgttaccttatgtgcatacttaaaattttttttaaagtttacatatatcatcatactgataggaaaagtctataaagtaggcaaggtttatatattacccccatttaaaaggcatggttgggttatgacttgccaaaaaacaaaaggcaaaaaatatatcatgtggcaaagaaaaataagacattaaattttgaaagaaccttatgagtcagacataattcatcaagtacagtttgccttttagttttatgaaatattaatactgaaagggaccttagaaagtattttgtccagccttctgattttatgagtgaaaacaaccaactaattttagaacattcaaacaagtattagaacctctactcaatggaaccatatttatcccctgtataacttcaaatagagttgagtagtctaatgtatattcccaaatacgaacattaagaactttaacacctggttcagtgttttgacccttttaacctctcattactgtaaccattattaaaactaaactgtactgtcttcagttagcaattgattagctcttttttctttagagccaaatagaccccaaatgaaaatcttgccacaggcccttgaactctttcttttactcttcccatgtaacattatggagtttgccggttggttataaatagataaataaacaaaaacagagccaaacaaataaatgtaaatagattaacatatcagggctctgaacactcagcttcacatagaaaaaggtaaacaaacatagataagtaatatttgcagcattgtttataacataagagcttgagtcagaatcctttgagttcaaatcctcattctctctcatttcctgtaagcttggtcaagtgagtcagtaactgtagctttgtgtctttatctgtaaaatagggatgatacctatatcataagtgttatgttatgattaaaatgaaagtgtgtgttgtacagtgctagtgaagtataaggaaatatgcatggtaagtgttcattctaacatttggtatattgcaatcgcacagatttatttttttcttctctttggaaacaggagcataacttgcttatcctataattgaattatattattataaggtgttttcaaacaggattctattgaatgattttagttatcagacctcaccagcaccaaaaaggccattttaatttatattgtttttttggttagctgaggccagaaatttgtcttctgaattttttcttgataatctaaaatggttcaaacagacattaattttagccagactttcaccatttcagtttgtactctcctgtaatctggtctacaaattaaatattgagacaacatacttgtcactttttggaggcatttctaaaccatttgtttggatacagagtaaaaatacttttaagtttatttatatagtgatcaatggaacaacctgagtttttaaatctgggtgtgaatgctgatgattgcttctgtagatcatttgctcaaggagctgtgatataattttaaatttaattcatgaaattgtagatcccggaaagtagtttattatgagacgcatagtaaattttaaaatgccctcaatagtattttcacagtatgtttttaataattactaagttgtcttcataggcccataatagacttagcaaaacactggtttatatttgtagttttctgaattttagagaatgtgagggtttttaagtgctggaagatggaatttagtttgtcagggaaaaattctaggcagagcaagtaaaccctgtattctgtgttgtaggaatgcagttctttcaggaaatttaaggcagtaacaacaaagcaacaataatttagtgttataattttaaaacctattgtttctttgaagtggtgggtcattatttagacttgctattctattggcaaatattcattttaatcatattgtaaaggtataatttaaatattttgaagaggaaaaatctgtaccttgcataacagagtcttgatcctttagggctgttagtctagtagattctgttgttttcactcttaccatattaataaattcaatgaaatatgttcattaataataaaaaggcacatcgcttatctctgtatgtatgtatttggtgaaaagggggagtataactttataagagttttcattttgcttgctgaacaactaactgtttgattttgatagtgaggagaaagcatgtaaaattcatactattcaggtgcttttgagacattacagtgataaattgcgacttatgcactgactaattttccatgtatcctttactggaatgtttcttattaggaagtccatgagtgtactcaatggagataaccctagacatttcattcctgaatctcaaatgaaaggactcttggcccaggacacttacacgttttcgtctggagttcaatcttgaggtgattgtagcagaagatgttgcatcttagactgtatgtctgatggagttttggagattcgggttcataatgtggggacagtggatctcagtaggttgtttagttttgagcttcaaaggcttgtaaactcaattttacataggaaggaggatagatgcttttcatagaatgggtataggactttgcaaagattaagtgtcactgctttctgtaaacagttgatagttatacaaaataaagtccatctttttttttctttttttattatactttaagttctagggtacatgtgcacaaagtgcaggtttgttacatatgtatacatgtgccatattggtgtgctgcacccattaactcatcatttacattaggtatttctcctaatgctatccctccccactcccccgaccccgcgacaggacaggccccagtgtgtgctgttccccaccctgtgtccaagtgttctcattgttcaattcctacctatgagtgagaacatgcagtgtttggttttctatccttgcgatagtcagaatgatggtttctagcttcatccatgtccctacaaaggacatgaactcatccttttttatagctgcatagtattcaatggtgtatatgtgccacattttcttaatccagtctatcattgatggacatttgggttggttccaagtctttgctattgtgaatagtgccacaataaacatacgtgtccgtgtgtctttatagcagcatgattaataatccttcgggtatatgctcagtaatgggatggctgggtcaaatggtatttctagttctagatccttgaggaatcaccacactgtcttccacaatggttgaactagtttacagtcccaccaacagtgtaaaagcattcctatttctctacatcctctccagcacctgttgtttcctgactttttaatgatcgccattctaactggtgtgagatggcatctcattgaggttttgatttgcatttctctgagggccagtgatgctgagcattttttcacgtgtctgttggctgcataaatgtcttcttttgagaagcatctgttcatatcctttgcccactttttgatgagattgtttgattttttcttgtaaatttgtttaagttctttgtagattctggatattagccctttgtcagatgagtagattgtaaaaattttttcccattctgtaagttgcctgttcactctgatggtagtttcttttgctgtgcagaagctctttagtttaattagatcccatttgtcagttttggcttttgttgccattgcttttggtgttttagtcatgaggtccttgcccatgcctgtgtcctgaatggtattgcctaggttttcttctagggtttttatggttttaggtctaacatttaagtctttaatccatcttgaattaatttttatataaggtgtaaggaaggaatccagtttcagctttctccatatggctagccagtttttccagcaccatttattaaatagggaatcctttccccatgtcttgtttttgttaggtttgtcaaagatcagatggttgtattggttttaacctatattttaatgactaatgcatatgtggataaatctgttacaatcagtcatgcagaacttcattatagttaacactaagatctttgctttaggaaactgaattactatattaacgagtactattaatatgataattcttttaattttcttgatacactacacaataaacctttcagttcaatgttaattttaagtaaaactcttgttccaactcttcaaagtaaagtaaataaaccagtcaaatgtgctaaaggcacaagcagaagcgttggccagagattatgcatctatagtcttggaggagaaccaaagatactataatcacaatttgccaagtctgactaatgactccttcaaagttgagaacaccagtgtgctgctagggttttgtgaatgctttaaactttgattgagaagggggtcttctgagcttaggccaggctgccagtagggatttgcacctgatcagacctttcttttttttgagtacttaatagctgcttctgccagaaaaccagatcaaagaatagcaggggagattagtacattggttttatcagccattttccagctacagctcttataaagctgataacaggataggggtgaataaaatcatctgctttcaacctccctgcagtgctttcatcttgatttaagaaccaaggaggaccatgtctacagtggacaccaggccggtcccctctccatccctgtcagagtttaaagcacttaactagtaatcactgctctgactctggagtagtcagctaccatgtttcctttgcttttgacttggcaactgctgtggcttctttagcacctggtcctctgccagccatctcagttaccttggattgactacagaagacttttttgaggtttgtatttctcccactattatgaaggcaaacggttgcagcctctatccccctccctaggtagatgacagaacacatatagccttttgtctatcctttttttttaataccttcaaggctactcttgatgttaaggacctaaataaaacaaatcttacttgcccaaagtggacagtcgaagtagtcggaatcatagctttttaagattttttttttaagaccttagctatccagttctgccctctccttttatacagcatatgtgcagctaaaaacaaagcattggtctcttaatgcctgattggtacactgatgtctccttaaccaaatagtatgcttggtctatttaaacagaatgattcctgagatggttttggctgagaaataaattaaaattttctgaatagcattttgaagaaatgtgtactatctgaaaaatttgcaaaaatacattctaaaagttaagactactggatgctgcgtattgtacattatctaaagacgcatatataattgatgtttctgacattgctagtatctgtattgtatatggaaaatgcttggaattgaatatggtggaattgcagttttaatggaatatgcttactttgtaatacattgactctccttttatattcaatgtgtactaattagttatggtcactgtatgtgtcttcctaatgttaggggttgaagtataatagattgtaaaataccttgacctttgagccagtagaactcagttaaatttttatttgtcactaatttaatgaagcatttggaattctatttaagctatatgtgtcacttttctcatcccagaaaatatgttgatccattttagatactttctaaggtttcctcagtaggaaaatcctaggagaggacttagaatataatcttactgctcaaaatgattatatttatgctgattgcatatttacatttttcttttattttaataacacatggttgatattgttgtaatttattgatgtcaaaaactctaccaaaattataatataactatgagaaagtataatcccctttacagctatcttgttttatgaagtggtttccaggaaacgatcttagcccaaaagccagaactgcctattatgggataaggataatcgactagcaggtacaatcagcagaaaggaaagtgaatttacttggtttaaagactttcttgcagtcacagaaaatgctaaattgattttgtttttctccatagaaaaactgcagcacgttatataagaggagttgctttgggagactataataccttttacagactaatcagtgattttaggaaatgttgttgttggaattagctggaaactttgtaattggaattgactcaactttcatcacaatctctctctcctcctttttttcatattaaaatcagctgatgaattacattgtctctgtaatgtgtttcatatccagtaaccttctctatttccaccagcatatggatttctatatgccattctcccaattaagtgccctcccctgtcatcgacatccaaatgtagggcaccctgcaaggtgacattaaatgcattttctttatacactttaactgactttggagaatcaaaatcttttgcctctctaattataccttttttttttttaaatttatttttttaaccatcctgttagttaagatgccaccctcttttgggcctctccagcttcacctgacagtctctcctctgtgtttcagcagatttatgtagctatctctgtcatagaccatatgatgtcctcttgttactacctttattttatctagtctctggctttttggctgctgggattgtctttattttagctttgttacccattgccctgcagcagtgcctgacatattacagatgctttctaagagaatttatcttctcttgatgacaggatccatgtattctaccctatcctgccttctatacactgccttgcacagtattgggcataaaatttggtgttaaagttaagaattgccccttaaacccttatcataatttaagtacttaggtattcttgatttatgctatgtgttgttttttgaactcttaatgaacatcttcattaagagttcatatttacaatttattggtggaaagccaatgataagactaataattattcccttcaggaatgttaaccatacagtttctgatttcctaccaaggtaagaaaaaagcttgaaaagtatctctcaatagaatatttaaatcctctgtgtttatttacctatgtgttggtaaactcatcaagaaacattttagttatctcagtttatcttaagagaatatatagctagcaaagaataaaatggtaagaatggattcaatatattgaaagtattttactttagatggctatatttaaaggggacgtagtactccagataaaggactgatttaaaggtaggtgatcaggtgactgtacagtaattttattagagccattctgttttagagattgtaaaacaaatgaattgttaaaaataattttactgttcactggggcacaatgattattacagaataatgactttttgttggcaaggcagttgggcaaatataagtaaaccattttacatttttcgcctgtctttgatgctttgtctttctgaataaggaccccattcccaagaaaggcgaaatcataagcatttctaatagctctgtcttctttcatataaagtttaattaatggttctctcactttttctgcattttatgtttcctctcacgtagaaaatatgtctttttgtgctcaataattgatgacccttggagtttagtgacaaatgtgagttaatttaagtcatcaccatcaatttaacaagcacctctggtaatacgtttttcacttttaaaaaattgtatcatgaagcaaaatgtgtttctctgggaagcagcaaagattataagataatcacacacctctagggcatgagaatgggaaaggttcaggtaaatgtatctattcatttgacataatgattatttcataataactgaatgcttccatttcagccttccccaccgccactatcccattcctccctattctgttagtctgggagaagaataatataatttttcttgtgtgctaaaatatgatgctggtagttttatgatggttccgtatatattttagctgaactgtacattttcttataatcactagaaaataagaatggtctcttagccccagtagttgatgtaatagtgaaaagagatatatcttgaagtcttttgctcacgcctttcccaataaaacttatcagatctcctttttccagaagtctccaatttaaactcatattctgctgttacttacaattttgatgtacattcatgtgtttgtaggtttttactgtttgtagaatatttaagctaatagttaacattgtactcaatatttcaagtactgttacatagccacagttccaggactggagacaagggattgtatatgttgttattgtgaactgtggtgtcttgtggcttgtttagtcaattactcaatataaacttttttgaggaagttttttgggaattattggtaatagccaactattggagaggaagttacacagttttaaagagcattggctttaggatcaaatccagttaaaataaaatcccagtggaatcacttgccatctctttccttgtacagcttataaagtgtttttattctctatttttattatggctatcaggtacaaaaataaaagagagatatttccccccatggaatacatgggttttaaatgatacagcagtcaataggttttggtgaaataataaataagacagaagaaataagagaggacataaaataattcatattttgtggactcatctagtgatttctcttcttggtaaattggttgaaaaaatgagttacatttttgcctgtttaaagatgcatttatggcaggtagataaatcacagactttattcttttttccatttacttcatactgactcatcactgatgcacacccagaaaaataacaaatcagcattaatatatgagcctttttgtttctgcttatttgtgaaaaacttaaatatcgaattagcattgaattagctatgtgatttcataagatttttatgagattaataacaatgttcaatatcataataaataagtttccttacagttgatgatttctagaataaagtgagatataattttcactcagattgtttagaatttttgtttttcagaaattactctttgctatattcctccttcacatcccacttcagttttggtcttcacttccatgcacaagccccgctggttaggctagcttgaaaacattgttttcaggaagcacacaaaaacttccgagttgaaagctggttcagcacaagtttgttttatttctgactccctgtgagctttgcttggattcttccctttggcattgtgtgtgcttagatgtgtattcagtatcctgcacttttggacatgttgccttccatgttggtgttatagtctcgtgattctattctaggaaagaccttagattttgtggtccaaggatgaaaattcatagaagaaggaattgtggtctggagagagtaagtagcataatcaagattcaaatcaggcttgacctctaaattcagtgtttcttagcaaattgcacgtaaacttattcttttaaaactgcctaatccagtgcttttcagactttttccacgttggtatactgagcctcattaacccatctgtctgggtccccagtcactgccagaccactggaaagtgaagggaaacaggtatttggtagacatttgctatgtgccactgtgcagcgtttagtgatattgtcaaaagttcaagcaatagcacttacttctgtgtcctttcccagcctcaggaccttttgctcttctagtagctttagccttgtttgattcttgttctgtatccacaacctactgccgtccttcctgcaagaaaatgtgtgtgctagcttagtcacttcagtctgctatagcaaaatgccataaactggatgtcttataaacaacagaaattgatttctcactgtcctggaggatggggagtccaaaatcaaggcaccaacagacttggtgtctaatgagggtctattttctcgttcatagacagtgcctactcactgtgttctcacagtgcagaagaggcaaggatctctcatgaataagggcactaatcccattcaccaaggtggagtccgcatgacctgatcacctcccagaaacctcacttcctaataccatcgctttggggattcaaatttcaacataagaattttggagtcaaacagatattggaccatgacatgtatgaatttttaaatttttaatgtctctaaaatacactaagaagtaattaattaaatgttgtaccaccttagagattcaaatgctttcaaatttcaattcttagttcagggcaaaattttgaaaggtaattccatttgatgagttcacttatatatcacactgcatagtaagcaaaatgcaagaactgtggcaccagactatctgggttagaatctggtgctgccactgaatagctgtgcgaccttgggagagatacttacctttctttgcttctatgtcttcatcagtaatattgcccctacctcatagggttgttacaagaaccaaatgaattaatatttaaagcagttggaagagtttctagtacatgatcagtattatctatgtgtttgttagcaaatgactaattaaaaagttatttatatttatagtaaattttctttaaattgaaagtttcaaaaattagttatcttagcagaatgtatgtatatttgccacctcatgtataataatcaaatcagtcctaaatcatgtagcttttgtggtgatatgatgatatacggagtaggacaaggtatatcgggtaattgtgtagatctttgagtgtattcaaagtttggcttttaagtgagcttgtcacttcgtttctctcagctccatttttagtatctataagatgtgactattaaaatctgttctacacacttgtattagtctgttttcacgctgctgataaagacacacctgagactgggcaatttacaaaagaaaatgctttaatggacttacagttccaattggctggagaaatctcacaatcatggcagaaggcaaggagaaacaagtcacatcttacatggatggcagcaggcaaagagagagcttgtgcagggaaattcccattttaaaaatcatcagatctcgtgagatttattcactatcacaagaacagcatgggtaatacctgcctccatgattcaattatctcccatgaggttcctcccaggacacatgggaattgtgggagttacaattcaagatgagatttgggtggggacacaaccaaaccatattaacacctagcaagtgttttatggggatcaaatgaagtaatgttcatgaatatactctgtgagccaggtatggtggtgcatgcctgtagtcccagttattcactgaagtgggaggattgcttgagcctaggagtttaagtttgtagtgcactatgatcatgcctgtgaatagccactgcactcgagcctggacaacatagcaagaccctgtctctaaaaaaataataaaattaaaaatactttgtaaactataaagacctatccaaagtaaatatattcttaatgatgacgacttatgtatttaaagcactgtacagttttttgcatttgctgtaaatatatgatggcaaaatgcttacctagaagtaacagaactgcatgtattactgtgtatctgatatcaatatttaaaatagtgggctgttcttctttaaagaaaaacttatctttgcttatttttaatttccttgttagcagtgggtgcttagtacaatactccaaataatatcactcctgagtttggaacagacataagggaggcaggcatcttcttcgttaactggacctacatcagatgtggggaggaccccccatcttcctctggcttttcttcttttgtcatgttttagctttgctgccaatctccactgatgggtatggcttttttctcattgttggcagggtagtttgcttgatgtagtagtctgcttcataccaacctcctctatcttcaaggacctccttggaaagaaacagctgtgcttcttctggagcaaagtggttcactactctggcctttccaacggtggtggtctctcacttagatgctgcctgggaagcccttagagtcccagtgccacctctacaaggtactctttcatgtgaagacaggaaaacctcttctgtgtcctcatgacagcagaaaaactcccatacacttatcaggcacaccactggtgtgcaagagcggcttgtacagactctcaaatgctaactgttaaatttttaggaagttgtgatcttgttgttaacacaatcattactaattatattatgtaagtgattaatcaaaaagattattttagaaactgtactaaatatttaaaatatcactttcttattattttgctgcattttgttattacctgtgctcctgatattgctttatatctgctgtatttttatggtagataataccgtataatggtgtgctactgcacatctctccccactccacattctttaacttcacactagtagcttgaaattggccatggtgagagcatttctacctctgaaatcaacaagtgccacaaaccatgatctgtcattccctgccatttgttgaacatttaccagcagactactgggctcactgtattctggtctcttctggttctactgctacaggctacagcagcaagtgttccctcattaatagtctctataatgagaaagaaattgcctcttccttcttaggactttttaccaagtcctcccaagaactctgtcatgaagcatttatccagaagtcagttgccagccacctcttctcataggcaccccagtcttgactgattcttctacagtcttccttgtgtttggcccagggagcgttcctgtggggtgagcactcgcttcccttcctttgtggaggcaaggaagctcatcactatcagtactggacttctctgcctggtcctcagggctcagttcagatcagctgggtgtatgaaggtgaaagactatggtagacgtgggtctgccacctcccagcaaacactcaaggaaaattggcccagttttttatgaattatctagaatgtaaagcacttagacttttttttttttttttttggttattggttttggacccacctaaaaattcttgggaaaaaaaaaaaagaagtaccatttaactttgtattataaaaaagactgaaagggtatttcatttacaaaatttatttcacaaaaaagacttttcgtataaatgcatcacattaaacagaaaggtaggaattcctgatgtctaagtgtctagtcctaaactgattttccaaagcaactgagagtttagttggttttggagacagtgtctgtcattctctccctctccctccttctttgccttgccccctccatagctctgtagttgggtctagtttagggcttacctatatgaaagattaagtaaacactctgttcttttctttgggaagttagtgttgttttagtatgtggggagtcgaacactctttaaaataactcatttctagaaaacaaaaaggccaaaaatttaggataagataacagatattgaagatcaatgattacatattaagtctgtcagtgtgattctcttgagataaaaaatccttttttaagagagtatagtgcataatatatttttgcttctatgaacttatttggtttcaataatttaatattgaggctgtctcacattttaaacctagggagaaaacaggttggaaactacataaaattggtgtatcaacagttttgagttgcagtttaactttcactatgctgcttaatttgtcatccataaaattgggatgaatccaaacctggaaagtaatatttgactgtaataccaagccatacagcattgcctgatccacataaagcacacttgatcagttttgtcatttgcacatgtggagagttttctcaggctgagtaactcctggtattggattctaggcataatcatgtcattcttgcttgttggtgccatgaaataattagcccaccatgtaagggcccaacttgatgctgtgcttaagagtagagcctatattcttgattcttgtggaatttgtgtcttatatgaaagtttgcttgacccaccagttgcttctttttgcttttaactgttaatatagctccaaaagctattgcccaaatttgtcaaaattcatatttaaaagttctgctgttcaatgagctagtcactagccagatgcaattattaaaattaaaattaaaaatgtatttattcatttgcactatccacattttaagtgcttgatgcctgcaggtggctggttagtggctactatgtagacagatacagaacatttttcttgtggcagacaattttgctggacagttttgctctagactgaagctctgcacacagtacttcccctgtaataactatagacatctggctagtttttactgtgttacaaacattttgctaattcaagtttggagacaatggatttcataaagaaattataataaaatatacctgtcaatgtacaatgtagtgtttcaccatattatgtaataaaatatcttaagtgctagtttggaaaatttgctgttttttgttatagtgtttttaacatcttttgccctctagaacattattctcaaattttaaatccatataactattgaaaaatctgtataagtattgatttctgcttttacatctttaatcatatgaaccaaaagaaatacaacaatgaatcatctaatatgtttgaacaaaaattgatgggtttttcttttttgaaagttttatttggagcactgagcttggaatataaaataaataaagacaacatggaatttaaatttggatgggtaaaatagaaaatgaagtttagaggcttgatagattgacagatcaagaggggtaaaacagaaactattgctatataagctcaggatgaaatactaagtagagacctcagcctatacataaaaagagatggaaaaactaagaaaatgcatgtttgttttgcaatttaaatttttattttcagatcttagaggacaactatatcattaaatgttaagcttgctaaagcagtattttttaggtgtctttaaagtaacttactacaacttcctatatttttgcagcatcttctaatgtacatgaaagttcagtgaatgtacatgaaagttcagggaccacatgcttaaatactggagttgaacggagaactaagcttgttttgaaataatttttgttgtccctgcttccaaatttgttgtggtagtggttatatgagtcttttatttattaggagattaggaaactgctttcataaatggacattatacaagcatcttcaagaaacatgtttcgcttctccagctccaattagaaaagcggtaatctccatcccagccttctggatggctggcctctcttcctaactttcttacccgaatacctctttataggaggcttactacatgccatttgctatgctagatattgtgggtagcaatgataaaggccatcttctctattttatttttgggcatcctcagggttaatgccgtcatcttttccttcaacaactgcagtggtctccttaacattgtctctgcttctggatcttggtctcccacaaaccacttctcacagtcatcaaaacaaacttcttcagatcataattcagattatgtcactcctctgctataagcctgttctgttacatttagaatgaaatccaatcttttaaaaaatagaataaaaaaaaatatattttaggaagccatgtcatcagaagtgtaatccagagaataatatactctataggtctaaaaaaagattttctaaattatgcaattatattttgataaatacttataaatattcaaatacagacatcagtaaaatgaaaagtgaaactcatttcacccatttcattcaatttctcccccaagatgactactgttaattgggtctatatagtttaaggcctttcctatgaaattacgtccatgttgtacgtttgctttacatatgttatggactggaaaatgaaagcagttgtgtggaagggttcttatgttacagaaggaagtcacatttttttagtttccttttaactttctttaaatgaaaaggaaagaatgttttaagttatatcttcaactgctagaaaggtagtatacttagaatttttatggccctttcctagggatttatgattttcacataaaagaatgaaaattgaacacacactgaattatacttctaaaacatacttgaaattttttgcctctctctattcgtgttacttaaccagtgcaaacttactgtaagtaacgaaatcattgaagaaatacacagaaaatgaaagtaatccataatctcaccttctgctttctagagatgactcctaatattttgacaggtggcacatacatatgcatgtatgtatgtgcatatatgtacattatatatgtgtgtgtgcatgtgcatattaaacttgatattcagtggaatcataatacataatgttttggtttccttaattaggttattgtgaaaagctttcctcttcatattctatttttaagcaacctgtcccaatctgacaatttctcactcttagtttagtggttttgagctgtggcatactggtgttccctgacagtggtattgcaggtgttgaaaaatttgtagtgtgataacctagcctatagggtggagcctggaactatgacagttgtctttttacttcaaggtgccacacagttgttgtcatctcctgtttgtttttcataatataaaagcatttgggaagcactgctaaaaatccatgctttccctgtctccctcctcaaacatggacctccccacacttctcccagcttcccttattacctctctgaggctcttctcctcacagcagactgatcttttaaaaacacatgtcagatatcaggaacttaggaattctaccccatatcctccactggcttctcaatggagtcaataaaatccaaatccagttattggctagctccacgttaaattgtcttctgctctctgcctccctcattcagctttctgatcgtggaatgctccaagatcattcgtatctcaaagtctttgtgcctgtcattccctccgcctggaatggcattacctccatcttcccattctggtctctactcatattttgccttctcagaggctgacctaattaccccgtctctacccttctgttcgttaactcctttgcctccttgccttagcactttggtcactgttccatatgcttgtttagtgtctttcttccatactagcctgttttccatgaagacatcaactttgttttatgtttttcatctcttgtacatatcaggtgctcgagaaataattatctaatgaaaaagtacatatacaatgaaaaaagtacatagcgaaactaacatttttattcagtatttgtttcctttatttcattttcccagtgccttggatttttctggtcagttatctctagtgttagcatgagcacttcaggaagaggtaagggagagatattagccagttaaaccatgcatgattactctgtgatatcagttttatgtaacatattttgatctttttaacatagtcaaatggatgttgtaacacttgcttgatttaacattatattttggtctttattatagaaattttaaggaatttcacataatcactattttcttatagaagaatatagggacaagcagaatggtgattttcttaaaggccttatttcttaaagagaataaaatttagtttatgtataaagaaaatgattttattctcagacactttcctccctgtgtgtatcccctcaaattatcacatttaaataattctcagtggtcctaattgatttctgaataaaatatattctggccatttttctttctcccaggatttattatgagccatgacaataaagtttaggtctatttacaaatcagagaaccttcatatttttgagaactggaactttgaactagattagttgagtatatcatgttggtttttttggtgacacgcagtatagagaaaattaaaaatgaatttccatcacacctatctttgaaaactgaatttagcttaaattgaaaggggtgaaaagttggcattttattacatcatttcacttatcttataaatcttagagtgaagacaatgtttatgacattattttaagtctgaaattaaatttaagtgaagcctttctgagacttatttattttaaacacttgttattgcattttggattaaaaaattacatacacaaatttgttttcctgaatatataatgtgtttgatctctccataaatatgtatgttaatatagcactaaaatctaaatctttccacattattgtacacgtaggtatgcaataaatatttcttgattggttgactaatatccaagcatatttaggcatactattacatgtttaggtctttctgatgagattccagttcttgaatctggttgttgctaccacactgacctttttaaggtgcaaatcacattatccctcatgtagaaccctttaaaggcattacaacaccttcaaaaataaaataaaataaaatgaaaaaaggcagactcctttttgtggtgtagaagtccatgcaagataaggtcccagcttcctatctcccaggtgtcttttttttttttttggatggagtttctctctgtctcccaggctggagtgcaatggcgtgatctgggctcaccacaatctccgcctcccatgttcaagcaattctcctgcctcagcctcccgagtagctgggattacaggcatgtgccaccatgcctggctaattttgtatttttagtagagacggggtttctccttgttggtcagtctggtctcgaactcccgacctcatgtgatcctcctgcctcggcctcccaaagttctgggattacaggcatgagccactccatctcccaggttttaatctcttctgttctattcttcctaactagatgttctacaaaattgcttgtgccaatagctcattatatttcctcttgtcagtcttttgcaaatacaccttatttggtctgtaacgccctctttttttgcagtgttttaaaactgcttggaatcatcttttttttgaatcattgtccgctttcccagatagaaaatagtttgcctacagccgggcatggttgcttacgcctgtaatcccagcactttgggaggctgaggcgggcggatcacgaggtcaggagatcgagaccatcctgaccaacacggtgaaaccccgtctctactaaaaatacaaaaattagccaggtgtggtggcatgcaactgtaatcccagttactcgggaggctgaggcagaagtgcttgaacccgggagttggaggttgcagtgagccaagatcgccactgcactccaacctggcaacagaacgagactccatctcaaaaaaaaaaaaaaatgaagaacatagtttgcctactctttctcttgttttacattattgctctacatatgtcatagaggtttaccttctaaaaggtgtggctctgccttttatccatcttcgtatccctagcggctagaatagtgtgtgctcactaagtgctgggttaatgaaggatgtttcaaaggtcgctttctctgaagtcttgctgttttcccaggtggagtaattttctctctcccctgaactctcatagcgttctaactctgctttatcacatataactgtgctatagttatttcctaccatgcttatctcttctgccacattgtgactctcttgaggacagggaccaaaaattaggtatttctttctgtcagatattagtccagcaaatattagacactccataaatttcttcttgttgaataaatacatggctaattgttcaaatttttaaaaattggtattttatacaggcttatatttttgttttagctggctatctgataaagaaaacctatgaatctacttacagtttttttcttgaaaaggaaaaagttctgaaggaagaaaacctataggattgaaactgtcatgtaacttttagctcagcttggagatcagcctagatgaatggttctcacattttagcctgcatcagtatcacctgcaggagctctgaaaccatggatcggtgggtcccacccacagagtttccaagaagtttccaggtgttgttgatgcttttgttgccaggaccatgttttgataacttttgacctgatctgtcttaccagtatttttcagccttcagcatcttgataatttgttcatactttaatgccgatatgtggagtcagtgcaaaggttaaacaggttaaatatctcctgatgtctttggcaaaggccttctgttttcatagacaacatctaaaatcatttgagtggctctttcagtcctcctaaatcactttatgttagtttctattctatacactctttattaaaggaggcacttggtcattataatgtctagtgctttccctcacttatgactagatactgccaataaaattaatgctttccctcgtctttttcaccatctcccatattgtgttctcaatgaagatgagtttatctctctccatctatccttaaaacctgatttagggcccggcatggtggctcacgcctgttatcccagcactttgggaggccgaggtgggtggatcatgaggtcaggagatcgagcccatcctggccaacatggtgaaaccccgtctctactaaaaatacaaaaattggctgggcatggtggcgggcgcctgtagtcccagctactcaggaggctgaggcaggagaatcacttgaacccaggaggcggaggttgtggtgagctgagatcgcgtcactgtactccagcctgggcgatagagcaagactctggctcaagaaaaacaaaacaaaaccctgattttattccacttattttgttttatatgggtaacaacattggtctatgaatcaggcccattttaaaagtagagtttcaagcctttataattgtacaaaaagttccaaggatttatttctccctagtatttcttaatttctctgcttcaacccatttttactgattgtcggacacccagagaggtcataggtattcttcaaaaagtttgtgatatgaaaaggatgtcgtttccttcttttttttttgactaacttctgaataatctctgagtattctagataaaaatattttgccttaaaatttttagcaagattcttaaagtcttacagacttcatcttttgctgatttatgacacatgaatattttcttaagcatatcgtcaaaaatttgagttcatcttctgcaaagaatcaagtgaaccatatacttttaatgtcttcattttaaatatatgttttaagaaaaaagtcaagacaaatatagatatgcatatttgtgtgtttgcacccattatttttagtcgttctgggatatcttctaaagttccctattattttctcctgttgaacctgactgtcaaacgtattgtttgttacatctcttcgtaaatatttttcaatttcagctgggcttttactagctaaaagcactaacatcataaattatataataatatgtaattatatttgtgctatttaaacgttatatagctaatgatatcactgttcttgactatttgtcttgtaaaataaaacagaaaataaaagttcacaggcgttctatccctaaattcaactaagagtacacaaactagttactcttacaaactttatgtcaaaacctttctcctctcccctccaaccataactaattttttcagtagggaaagttcacaatacttttgaaattacttaattcttaaatcaatattatgtaagtagagaattctctttttacaagaggtttaaacaaaacaattacttattaatatatctgaatttgtgatgtgaaaactcaagtttagcatctggctgaactttgtctgtatgtaggctcatccatttatcttatctcttcactcaaaattaatcatctggtttacttaaaggttgcttttctttgtaagtgcatactgtcatcagatttcatctgttaatagatatttagtatgatggtacatgtaggctgaactactgattttaattttcttgagtttcataagcataaattaaagctattgagagttgtttaaatttgttaagaacagacttactgtgttagtttgaaagcattatttttcaaatatagttgtgcaggtgaagtgatctacttctgctatgtgtaagattggactgttggtgctgaaatttaaaaggttctgcttgtggattgtaggaagacaaatggcacatctctagaagtgaggagaaatagtactgtaattcagtgtcatgttgatagaagtagaaaccttcaccagtcatcttttatttttgtaccagacaactaactataaaatataacccagatggtggagctatgatagtaaagatacagaaatgacattttgctgatgaattttctgctactctttgcttccccactttcagttttataccaaatcttttatggtgtaggttgcttgcttatgtatctaaggacagatccataggatgaaaaatgtgtttaagggcatttttagatcttggattatttcagtaaacttttattttcctcttttaattgcctttttggtttttcctctctttttgctaaactcatattctcacataaattagactgagccatgaatagtgggtcctatttcaattttatttctgagtttcatatttaaggcatttgggatgtattattatgctctgcctgtctgtctgcctatattggaattgggaagcctcagaagagagcaggggtttggcataccttatactgtggtctctagtctcaggcagcttcaccacacttaggccctgaattgaactgtaaaaggaattatggaaaggggctttagtgataggggtgtcagacattaggaatgagcaaggtagtgagtttgtggtactgtttttgtagcacagaagagctaaaaggtgtatctgcgatggcaaaggtcaggaaaggggctaacatttatgagaaacctcctaatttgtgtataatatcttttaatctttacaatggcctcatgaggtcggaactgggacctgagttgaggtctgtggctcagagttggggctctgctgctgggaactgtggtgtgcactgtgttgagtgggtgtgcttgtgtgtgtctctgtcttaccttgagggtctatgtcaaaaccttcttgagaaagcaagtatataatcccttctacccccagagccattttaatgatatagagaatatgcagagaacacaagaactttttgtgggtttattttgttaaagttattcattctcagttcaggttttgggtttgttttcagaaatgagaagtatgtcttagtcactttaagactaagaagtcatgtgtttttgatacatataaacctgcgtcaacatctattctaattaaaaacaccattgataatcgtttacaagtgcaagatttcaggaatgcagaattaatttaaataactagtggactattattataacttcaacatactagcatacactctgaaatgattattgttcattcatttatttagattttctagatacttttagtgattacattagggatagccaactccctgggctaatttgaaacataggaatgtagtatgcttgcatattcatttcagtatggaacttgtgaaaatctccgtctttgggcttttctttcatacaggctacttttgtatgaagtctgttaggttttattttctccttctgatctgtggtcctgactttttacagttacctggacactgccatgtgctttgactgatgttctgttgtttattaggcaaaacacagtatcattcttgaaaggcctgcagttggtggatgctctagctgcttttcatgcaactgcactctggttatacctgatgtcatccctgttagataatgtggtagtccttctcatcatgcaggcaattggtaatgctaaacctcaggatatttttgtaatcaaagcccttgtaattggataaattgatgttttattaaagaatacctggtaacattataaatagtattaacattctaaaattaacttgtcactgtaatattaattacagtgatatatggatacatagaattatgtgggcacgtgtatatatgtatgtgtgcgtagatatatgaaagtgaaagaatatttaaacctatactgtagctcctgctgagtggcagatgctgtaactatgcaaaaggcctgtgtgtattcaggtaagagaatgttggtatttagaatctctggagccctagttactccctgtagatagtaaaatcctgatgcgaagtcttgataatactagtctttctaaggaaccagccatttttaatctcaggacatcttaaggaaaattatgcatctatgagtcatggaagtgctaaggatagctaaaatctgaaattacttaggggttagatgaagaatcgatttgggcttgattatatgtcttaattgccttccatatttagttggcatataattagaaccccctcattactttctcaagaaactcgaaaatcaaagagtttacaaatagtcaaataattgactttagcaactctaaagcaaagagtatacaaatatttcccttgtttagatattttatctatgtatctttttgtgattgcaggtatatatctccttcaggaactaagtaaacaagtaaacaacaaataggaaaaggttaataagaattcatcagtttcagagtctcaaggccttgactaaaggccttttcacactttagactcttagaagtggactattacatgagtcaataggcaaaccagcctgtcttgcaggggtctgacgaagagaagctccttttctctaatatttgctgctgattcttagttgagaaaccataattccaaattgccagtgtctatgagaggagctacagtgagtgacagtaactgctagttgtacattgcacttttggtatcacctgtcagttatgtgtgtcttcatctttatgtatggatgaaaatagaatatgcacatttgaaaagtaactagattctagaattttaagttttcatgtagatactggacttactctgtagaaaatcttctggggcctatcagcagaaatttatgccttatagcattatttagctgttcaggggaggtttatgttttcatgatttctaatatagcttgggaaaattatctagaactttctcaaacaagtgtcattgtattatttcaacacaattttgtgagttcagcaaaaatgagctaaatgtctattctcatatttcccttttaggtaaaacagttaatccactgatactgcattgttgttttctgtgacatattgggactctttgagccctgactgtcaacaggattcatgtggttcaatgatgttgtgaggaacatgacaatccattgccctcagtgagtttatattttactagaggaaataaacatcaaatgtttacttagagttaattatgtaattataatcatcatatgttcatggctatagcctacagacactttttcccaaatattctctaaaagagaagatattaattcccaagtaacttaggtcaatgggtggtgtattagttcattttcacgctgctgataaagacatacatgagactgggaagaaaaataggtttgatagattcacagttacatgtagctaaaggcctcataatcatggtggaaggtgaaaggcacttcttatgtgccttggcaagagagaatgagaatcaagcgaaaacggaaacctcaaatctcctgaaaaccatcagatctcgtgagacttattcactaccatgagaacaggatgggggaaactgccttcatgattcagttacctctcactgggtccctcccacaacatgtgggaattacaggagctacaatgcaagatgagatttgggtgggggcgcagccaaaccatatcatgtgggaaatgtctttgcaccttcgagtttttttttctttcaaccacgtcatcatccttattattaccttccactggacctgaaatcattttgttctactcatgatgaacttgggtaccagcataatttagagttgctctctccactttcaaggctcatcgtcttcctgacgacatcagtatatgtgtggaaagcgcctggatagttttttcacctcaccacttccaaaggtcacacctctgtttactactctggttacatggatgttgtaatatctcacaactgttctaactttatgcatatgtatcatacttcccaagtataaacctatcttcttctactatactcattttgcttagatcatccagtaacttcatggagagctccaatccatcaaaccatctgtctttagctagttcatcaacttgcttatcatcaaatgaaatcaaaatttgatttcattgtgataacttttgttatacaattgctgtttccataaactctttactgacttttattctatccactttttctgggcttaaattaaaaaaaaaatactgtttttttttttttttaaatcacaccacatgatagattttgatcactagaaattcagggttatcaatttcaattgggtccaaatataactggaaattctactactatatttttctgttcagttatctttgttcttctactctgtatttcaactcctttcaattttctccagacttcaaccactccttcttttcactagcctattacttatagctgagaaaattgtagtcatataatggaaacttctttggctaccagtcctagaaattacatttttatgcatcttctcatttcctcttactataaaaaaaggcagagagagcctgtcttacagcctgtgatttggattttatcctgtttcacactaacagttatcacttctttcatgtgtatacacaaatactcgctaccaaattgaattatcctcaatatctaaacaagtttaagtgtttcttaccttaaaagtaataagaaaaattttttgaaagttgaacctttccttgatcccatatctttttctatccttagtcaaatttttctttatccattcagacaaacttcctataaagcattcttaaccttggtgtctctgtgctttcactgtgttcttcattgtccaatatagtttccacttccattcttcatacagaccgctctttctttgggcacttctgatctcaatggcacaaataaggggcatttccaataaccattttatgtagtatttggccagtattgggttcctgacatctcttctcctttagatactcttttattaataagcttttgtgatgccatgtacttccattttccttttgtagttctatatacttaaatatatttttttcatttccctctgtcctcattgtagcctcatcttcctcaatcttatcagagttgaaagtatagggcaaagagagtgaaagattgaggacacatcttgtggaactacaatgtttaaggttcacatggtagaattcaattttatgtgatgatgttttatatatatgcacatatatgtaatgtgtatatacacacagatgtatatagtcttgttatcatttgttgaatgtctactttgtgatagacagtatttgagctttaaggacacaaagttaactacagttcctaaattggaggtcacaccttgtcataacagataaagatacatgtgctttactggtactcatagggttggatctgcagtgtcattctatctttgtgtgtgttacagatgcctattttattcgttactgaaatttgggcataaatatttagaaataggttttgatttgggcacatttgttctttgaaggcagatgtgtgatttattctgaacgttagcaaaatttaatgtttaaatattaaaataaaaaacatgaatttaaggaggtttataggaataaaatactagtttattcatgtttttccaaactgggattggggggttaggtttttagtggagggagaagggaatggaagaaatataattttagtacatgtgtcttttatggctattttctgctcataaaagtggtgccacttaacatagcatgcttactgtgtggcaggagatgtgctaaatgttttatgtgcattatctcatttaatcttccctataaactttcctttatagaagaagaaattgaagttttcattttacataagttaaagttacagttaaagggtacgaactaggccaggtgtggtggctcatgcctgtaatcccagcagtttgggaggctgaggcaggcagatcacttgaggctaggagttcgagaccagcctagccaacatgttaaaaccccgtctctacaaaaatacaaaaattagccaggcgtggtggcatgtgcctataattccaactactggggaggctgaagcacgagaattgtttgaacctgggaggcagaggttagggtgagcccagatcatgccactgcactccagcctgtgtgacagaccaagaatctgtctcattaaaaaaaagaaaaagaatatgagttaaatatatatctgactttggagcctgggctcttaacactatgatatattgaaagaatattaaggggaaatttttttcagatttttctagtatctgtaatatcttgtattacatattgcatatattaattaatcatttcacatataccattcagtcttcacaagaaacccgtgatgtacggaaaggcagtattgtcaagatgagactacagagacccgagttaaatattaataacttgcttgggttacacgtgatagtagatcccaggcttccaaacacccagttcagctttccattataggagacacttcctgtggattcattcagtttgctagaggaaaaagttgtccttgttctctagggtttcccatctcccccaagtttaattcaactttatttcacttatttagttaataatccaggactgttgctggagtagcaaaaatttgattagaatcatcaccttcagtgtttcaggtaatggagtggagtaaaaatggcttagaaagcagagcctgttcattctgctcccaggctggcctcctggaaggtttaaagttgacatctggtatggctttcattgctctcttcttctgggaagcctggttgactgcttgacatcaagcattagatctgacctgagcattagcccaagcacgctttgcgtaattaagctattgagatttgttttccctgacaggacagaagagccctacaaggtgagggctctgttgaagtgataaagctgattagatctttagcagtaaaggaatctgatcttagaaatttcttctagctctcgttaatgaggcaaagacaacatttagcagggaaaatgaggtcactaaaaagaggaactttttttttttttaaataaagaaccaattattttgcctccttttaaatcaaggcctcaatttattgtcctgagtaaagctcaatttaaatgaacacatatgaaactttttctcaggggtgtagtaatcttgtttaaagtacaagaagttaaacaactcaagaaagtgaagctaagatagacctagaaattaaaataatttaatgaatactgacaacaaaactgaaataaccaacaatgatgtgtatttattcattagaatgtcattgttttcaaaaaaatgatttttaaaaactttttttctgtaacttctctttccttaaaccacaaacaagcaaataaaacttattttcctaggatacatttatacagacttcaggtattacactgttgacaatcacaccttttagtttagatagcacctttctatatgctgctatttaatccttagaaaactttttttgaaagctgtattatattcatattatggggttaagacttagctctaaaagtttcaaatctcaaatttatgtgaatcctcaagaatttgtaaacaagagggcttggagtataatacagggtttttttcacccctgagaaagtggtctgtaccagagttgtctcaagttatacattatttaaagtttttaatactattttctatttcttgctaagcccttgttccagtatttacaaaatgacatgggaattatgttcccaccaaatacatttatgtgaaatgtaaatcatatgcacacacatattgcacaccctcctgtgttcatagatggccacccttccatcatgaagcattctgcttaccacaaagaccccatcctccatctcactttcagcttattccagtaaaatcaattgtcacaaagggtaaacttggagtagaaaagaagtaatgcaggtagtttatgattgggacagatggaagggagatgagccatccattccagcggcttaccttatctcattgttattgactttgaggtggttgtagtgtgagaatggaaagggtttaatggaaccatgctgccatcttgtcaatataatgtctagtcagtgtgctagttaaaatgaaattcattttttaaatttaaaatttacttaacattttagacttttaaaggaaatttaaactctaaagtctacttaaatgaaatactctgtgtcttctttttcttgagaagcaatgtagtaaagttttcaaaagcaacctagaggcaggatgactcaggccattcccggcttcaccacttgttagcttttgtgccttggttcaattacttttctttaaaatgaacatgaaaataatacctacctcgtgtgattgtaatgaggattaaatcaatttatgtgtgtgtatgtgtgtgactgtagcttgggacagtctactttatatagtaagtgcttgacaaatgtaacttattatcagcccagtcaatcaaacttctcctcctccaccagagtaaaaatgtcctggcagagtttaccaaatacctaagagctaaccccaagtgatgcttattagtttcagtttctcttgacctctttcttatgttagatattatttgcctttacctaggtctttttggaaaactcagcctcccaaattttcaagttgttgttctatttctgcagaactgcaccaagctttcacagttttcacctcctcctgctagaggttttcacctcctcctactagaggttttcagtctgtactaagctagaaccatagcctgatctcagaattggcagatactcccatgggaaagaataaaatggctggagattattagataacatcagagacgctctcaccttctaaaatgtgtgtgcatctagatgccactgtttacacacgtatctgaaatctttaaattattgttattgtaatatgcctggcctttcctaatccttttattaggagtgttgacctgcttgaaacctcctggtaccaccaccctttctttcttaaccattcgatgttggctttatatccgctggtggccttttcagtcttgactttcatttccagtagttttcttctcttatttatcttcttatgccatcttactcaccaatcactttaactttcaaattagtcgcttattcccttccatggagttatctgatatccttcgtcagataacttcgaaatttatacctttattttaccctgataatcttctcttccaaatctatctatctagttattacttaagcattttccactgtgtgttatcataggcaaatcaaatttgaaatgttcaaaacatacttcattattttctccctcaatttgtttccttttctgtatcactagtcctgagaaggaatcctgacagcatcattcacctagtagtctaagccagaaatcattgagttgtcctatatttcacaactgagtcagtaagttctaccttctctgcttccttagtattatttttatctttcctttttcttctcatctcaccattcccactacttctagcatattgacttattttttctctccatatcatctttcactttatagccaaatatgtttctattagaccaatttgattatattctattcttactttaaacatcaactttcattacattttaaaaaatgctttgcaaatactccaaaataatgtatgtatccccatgaataaaggaatcaaatacaacattgaagagctgaatgctaaatctgttttctcttgaaagtcacagcacacattattattgttatttttttttagagtcagggtcttgctctgtcgctcaggctggagtgcggtggtgtcatcctacctcactgcagccttgaactcctgggttcaagcaattctcccaccttagtctcttagtctgtgaagtagctgatactataggcatgtgtcaccacacccagctaatctttttcttttcttttcttttctttttttttttttttttttttttttagcgacaggctctcactgtgttccctaggctggtcttgaacttctgggctcaagtactcctcctgcctcagcctcccaaagtgttaggattataggtgtgagttaccgcacccagccacagcacacattaaaagaaaggccatatcaagctttgctattgactataactacaaaactgtaaaatgagcttatatttaaatctagaaactttttttttcttaacattcttggatataaaactattgagtgctgtactcctgacctcaccctcatggtatttaaggccttccatgcctatgtctctaatctcatctcttcccttttgagcctttgtagccatagagattatatttatttagttttccaaacatgccatcccaatctttttcattgtatttgttcctttggcctggaacatcaataatctgttggttgacactcatccttgaaaattcagctgtttaaaactcagattatcttactaatgtgttcagtggttcacatactgcttggcacatagtaggtgctccatgtatgttaagtaaacaacaaaaatggaaaaaatcaatatgcgaaagtttacctttaaagagattttctatgtctgcctatatattgcctattcaggatatataacaatacttggtaataactgcttaaaaaatttaagctgcttaacctctgtaacgtaatttttcttcaaattttatattttgatttgtttacctgtacaagagttaggaaattacttacattataaggttaaatttttaattcttactgaacaaaaattagatttacttttgcatatatttagctattcccctccactgtagaaattccttgaaaactattgttgtaaatattttctgtttctttttgacaggtaatatttgaagctgaagtctcaggagggagaagtggttatattgccattgatgacatccaagtactgagttatccttgtggtaggttgtgattaagaattgtatttttctatgtcctttccacacttgccttatattggcagtgactattgattgtttatcacttggtttttgctgtctctcttgttattgttagtcctagccttctattgagttttaaaaggaaactgatatctttctagagtttttgaatcaaatatttttcaaacttgtaactaattgtatacctattaggagattcttttaaattatttcattactgagaacaaaatatacatgcaaaggcagctgttagtaggacttgttcatttttttggcatcattaaattgtctagaaaaacagagaagaatagcaaatcagagttcaacagaaaggaaaatataaagaagcctcatgaagttatttgatctgagttgagggctggggtgaaatgaagagaaataattagttcaccttattccaaatttaggactactttttttctcctctgtcataataaatgtctggctaactcatgaggtcaggagtttgagaccagtctggccaaaatggtgaaaccctatctctacttacaaaaaaaaaaaaaaaaaaattagccaggcgtggtggtgcacacctgtaatcccagctactcaggaggctgaggcaggacaatcacttgaacctgggaggtggaggttgcactgagctgagattgcaccactgcactccagcctgggcaaccacagcaagactccgtctcaaaaaaaaaaaaaaaaagaaagcaaacaaaacaagaaactcggtttattaatacacagttttgttatgcccttagaggcacattgattggttttcagatggtgtacctaaatttgtgtttacatcacagtccatgaaaaacaattactgcatgcattcagtagagccaggcaaaaaacagctggcataaattcagactttgcctatatttcccaaaagcagcattttatagggcccgtgaattctgggttatctgttcagcaatcctccctgagaagcatctataacacattgtaagcagcaggctggggcctcttgtgagggccaagacctgtgctcctgctgagtggttgtcaaactctagtgtgcttcggaatcacctacagctgtggtaaatcacagattgcttggctcttcccctggttctgattgaataggtctggggtggggcctgacaatttgcatttctgattccagtgcagctgatgttgctggtctagagttcgtaaattgagaactgctgctttagttcatgttctaactcaagaattccttattttaaatctcttcctgagaggtaagtcactagagaaagatgtagccagtaagggtcagattatatataccacgtggtggttggtaaattctaagaaaagagagaacaaaatcatctcatttaaagttcaagctgccttactaagttctttcaatctgtagtttaagagagctgtgtttttatctactgtttatttttcacttcttgaatgataggtgttaaggaaaggctttcataagtgcacagaaaatggtggattgagcacaacagcagttttagggtgatacggccctccatgaacttttctttttactcatgagccttagcttttgctgtttatataaatttcctttcaatgggaaacatggatgaggcttcagttttaaaaggtagtttcagaggatacttgtcagtcataaatcttacttatattttgactgcagtcattatttttgttagtctaatatgggtatttattttggattactatactatggttataatggaatagaaaaaaagtttaccagtttagctggtgttctttttctgagaagcaaaaatattcccttgttctttgaagtgctgtagagggttataactattgatgttttttttaaaaaaagatctaactgcttaaaatgtagcctaataagttcaatggccgtgtcactgccagtagtttagaaatcattatatgttttcattatatctttatattaggttctgatttcatgtcaatttaatctcttttggttgctttgacttgtaagtttgtaactgttttattatcatccatatacaacatgctatggcagcagttcagcagcaattgttgagtgctcactctgtagagaacaatactccagcaattatggaacagtaagtaatagagctattgagaaaaagagaactatgagagtcacagaggaaatggtgtcttccggcacaaaaaaagcccctcagttttcttctttctgatgttagtcttggccaaaggtaaaaacactaatgataatattcagctggagaaaagtaacatggcatattttcttcatgtgaaaacaaatacatttttttttcccttccttcacagataaatctcctcatttcctccgtctaggggatgtagaggtgaatgcagggcaaaacgctacatttcagtgcattgccacagggagagatgctgtgcataacaagttatggctccaggtaaggccaagttggcagctgagctaaagagtatactttatgttttaaaaacattgcaacaggactgtttgttgtctcatccttttgagtgtgtgtgtgtgtgcgtgtgcacacgcatgtagtgggacaggctgtctgcgtgagtttaattacagattcatgttagagatttccttttctgaaataaaacacatgagcaaataattaataagtatttttgttaggatctggtgaaacacaattctctctgttatattcaaactgcaaaaaattctgtagatccatttgaaatatgaataagaatgatattttttcttatttaataatatttttaaaactgaatttacaagagttaagtaggagctgtcatactctgataaattctttaaagtattttaagaaacccttgggaatatttcaggaagtatgaattggaagagagccaattaaatttttgagtttgagggttaatcacagatctgaggtgaagacatttgcctttcacatattacttccttaatacatttgtatttaattatgatttaacatacatgttggggaactgtaaatggtgcatataaacagatttaaaagaatctgagataaaactatagactaagaaatatgccttgccttcagagaatttatagaaagtctatctgtcagtgctagggtgctaggggctgggaggagctgagagcagctctaaagccaggaagctggacctaaaacagatggctattgagcgaagtatttgaagctagatgatgtgtaagtaataatattctctgagcacctctattattattttttaggttctctgcatcagaatgaggaaagagatttaataagttgtgaattttaaattcatgagaatgccaatagagaccaaaaaaaaaaaaaaaaaaacaagatgagtttaatttcttcaacataggcatcatgattttttttttactacatcctttagataggtgaaagtagtgttggggataactattagtttgcaggtggttgtaataaaggttataataaatgaatattgaaataataccttgtataatgactgatatgctgggtgttatatttgtgttatttcatcaagttcttccagcattccaattggaggttacaacaggtgtacttcatattaatctaattattactacttttatagcttatttgattttcaagtgtcaggataccatattttgtgtccaaatatgaaaaggagatgagggtcccttttttctgtgattatggtaatttctcctacagagattgaaaaataggataatttttcctggaaagcatgttgtataatgtgcaacctgttttatcaaataaatgtcaagtcagttttcttatttctcttcctatgcctaaataatagtttaaaaatgattttagatatatgttctaatcgttttgctagtgattttttcatttagatgggaacattagctggcatttggctttagttgtgagctatatagtcttttcttggagatctagaggctctgtaggtctgcccttggttttatgcctcaggatttaatgtgacattgaaataaaaagggttttgtatcctcagtcaccagctgccttgtggcaacaaagactttctggaccctgctggtctgagtgggtggtagtcccaatactgctcattttttttttttgtttgctttctattttgtagatagtccatttcatgatggttttaaaaaatgttcctcctgccatttttgtagcaaagatgagaggtaaaatattctatgaaacttctatgttgctttctcccctacctcacctcttttttttttcttttctttttttttttttttttggcgtttgctacagaatggtgaatttatgtatttctcttccactttgacatggacattgcctcattcttcagtagtgtgcatattcaccttaatttattcaaaagctattttacctttttcaataacaccacatcaattaccttaacttattcacttacatcagtcttccccatctacaagaaatattgaaatctattaattactaagggtgttttcaaattaaaataaaaacttttattatgaaattatttaaaaatgaaccagataagattgatcattatctatatatcaatcaattagaaggtggcagtgacttaaaaaacttgctcaacttttgccaaaagtaaaaaaaaacataataaagcaggaagaattctggttccaaagtgaatctaccagctaactcatgcaaacagatgtcagattattttcatttcacgtagaataacagcctagagttcaagaagctcagttctgaattctaacttttactctaaccctcctaaaccttttaacccagttaattgcagtggccttagagatttcatttatgtgttctgggcctcaatttgcttatttataaaaggagattctgaatagacactaaaatcccttccagctgtaagatgctaaactaggtctttacgttatttttggtggcttgaaacatggccttgataacctttttgtgtggaagatgaaaaagtcttgtaattcgttttgcatggggaaaaatggtacctttaagtatcattgtgagaacaaatgctcaaaatatctgctgctagtactgagaatgaatgtacttgaagcactcaatgaaaggtcactgcagtctatccacagaggtaatggaataatacaacagttgttatacctgccatggtcaggtaaaataccaaatggcaatcaactttatatgtcctccaaataacttacattatgtagtattgagcttcaattggcaaaatgttgtctaaatatgggctaaagtaacaaagactagaaaaacagccaattttctatttcaaaggaaaaatgatatactataactctgtgaaaggtgtacagaacacaatgcttgatcatatttgatattttaaataatttgttatggaaaaactgaaaaatttctctcacttctgtattctttctaggttataattaatatatcagtcgtttttgttgtctaaaataatatacaaattgagtaaattgaaaaatgcagggaaaaacacaaacaatgaattgcctgagttaatctaggataatttcataatgcatatcatggtagttctgaaagtatctatagggaatgttctttcttgtaagaattggattatataattgtagagtatttgaagtagatctaccttcttgtacatgctaaatgaactaatgatacataaaacaacatcgaatgtttttataagcctgagtgtcagtagactaaaaatatggtgaaatcatgaggttttctggaaagtagtttttaaaaatatgttatgcggtacatttatgcactaaaagaaatttagggtcgggcgcagtggctcacgcctgtaatcccagcactttgggacgccgaggtgggtggatcatgaggtcaggagttggagaccagcctggccaatatagtgaaaccctgtctctactaaaaatacaaaaattagccgggcgtggtggtgcgcgcatctagtcccagctactcggcaggctgaggcagaagaattgcttgaacccgggaggcggaggttgcagtgagctgagatcatgccactgcactccagcctgggtgacagagcgagaatgtgtctcaaaaaaaaaaaaaaaaaaaaaaagaaatttagaataaagtctttagtcacccttagagaacttccagattatttttcaattgagagctcagtgaagtagcatgtattctggatataaacgcattttttggttaatgatttgtaaattttttccacatgaacagacattttttaaatcttctaagttttagaactaagccattttaattttgtagtagtgttctcctatccttgggggatacattccaaaaagcccagtggatgcctgaaaccacacatagtaccaaaccccacatatactgtttttttcctatatatacatacctatgatcaagtttaattaataaattagacacagtaagagattaacaataataaaatagagcaattataacaatatactgtaataaaagttatatgaatgtgagctcttgtagcatatctttgtactttactcaccctccttaggatgaagtgaaatgataaaataactcataatgagaataagtgaggtgaatgacataggcagtgtgatgtagcattaggctactattgtccttctgacaatatgtcagaaggaggttcatctgcttggggctatcctagatcattgagccatgacgattttgatggttgggatgtcagaaacacacaatgtcgatgactaacaagtgagggatggcacaagatttcatcacgctactcagagtggagtgcaatttaaaacctatgaatggtttatttctgaaatttttcatttaagattttcagactgtgattgacagaaggtaactgcaactgcccaaagtgcgaccttggataaggaaggatgtctgtattcctgaggaacgttcaatgatacggaatttgtgattcataacttgaagctatgataaagctctacttatgggaaataagatcaaaagtgaaattataacatataatttatactgaaatgaaataataaaaagcatttggttatattcttgagaagtgtcaaataattttcttacaggaaaaataaaaattagattgtacacttttataggttagaaatgttggttatttttaaattttgaattttttgaattatttattttcagtattattgaaaatatttaaaattcaaaacttttaaaaaatattcaaatatttcaatatttgcatgtttttaatattcttgaattatttttattttttaatatcaaattattatcaatacatactacttgtacatatttatggggtacatgtgatatttttggaacaagcatataatgtgtaatgatccaattagggtaattgatgtatccgtaaccttgagtatttattatttctttgtgttaaggacattccaattccactttttaagttattttgaaatatacaataaattgttaactatagtcaccctatggtgctactgaacactagattgtaactcttatgaacactggataaagtgattgcaggaaaaagtgaatatataagcaaaaaatgaacatatggtgtagcagttccattcctaagtatttgcccaagagaaattaagacatgtgcccacaaaaagacttgtacaagaatgcctataacagctttattcataataactgataattagaaaaaacctacatgtccatgaacaggataatagatagacaatttgtggctcattcaaacaatggaatactgcttagcaataaaagaatgaactgctgataatgcaacagcgtgaatggatctcagcaacattaggttttggaaagaggacagacacaaaaaggtcatatcctttataatttcatttacattaagtttcataagaaacaaaactaacctatggtgatagaaatcagaacacttgttgcctgtggggaataaggattaattggatgtgggcagggggaaattctctagggtaatgttaatgtcatatatattgactggggtcttgatctatgagtgtacagacatttgtcaaagattaagatctgtccaatttactaattatgtttacctgaataagacacaaatgaggaaaaaatgagtaagtgacacattttatcaaataacgaacttactggcagtgctaatcaagccatagatggtaatagcctacaggcattacttgcgtttttatccatcttgtccatttcaagtgatttgattacattcaaaggtaatttgtaatcattagcctaacttgaaataaacatgttctgagtttctgctttaagaacaccttataacttgaggatatgaaagggttgtaactggggttggactgaaagttatgcattagtattctattatgaaggtccagtataagtggacacctacagggtaaatcaaatagagcctattgctgcaacatctgtcagaccatatgctttggcttcaagttcggtgtagaaactaaaatactaatgactccatccatcattacagcgcttggcaggcctgcatcattgaattgggcagagaaattcaacagtggagttattgaaagtagggaattgtgtgggtagatttggtggcaccatttgttttggtgaattgaaatgaggctgtttaatgtgtgactggtaatcctatgcagattgtcatcaaaactgtggcaattgggccaatctgtcagtaatcgccgcaggtgctggcactgtgcctcctccgtgggcctgccaaaacaggagagtcagccaccgcttcgcccttggtgaggctcatcattgctagaatagtgtgatacagctagttgctcagccaaaggaaatgtcattccttatggagcaacacataatttaagcaatggcttgagagtactaattggagagtgaaatcagtaaaatgagatgcaaattgctctcaaaaacaaccagagcgaggctgaccccctactgtaccaaccgttctcagtgaaggggcagtgaaagcggttggtctaaaacttctgaccacatagtgcgttacctgtccaggcaaattccaaagccttgttcctgtactccatgcaaacatcaccacatggtagtgggaatctaaagcatgatttctaaacaattgagttaattgggaagcacaaaaattttagctgatgaaaacatagcactacaccatttcagaggcctagtagttacggctcacagtgctctttctgatgaccccatgctatagcatttttctatgcttatttatattgccatttggcaagcccagatgtttgcagcatatttaatttctgcaagagattttactatcctgacactatttattttaggaaaaaaaagataattttccacttattataatgaaggtaagcttcctgaagaaattactgcatgcttaggaactgcagtttacagtaggcaattctttggaaactattttgagaggaggtttttaaagtcaacttgattaaatacataatatgtgatcagctcacgctaggtaacatgcataaagaaaaaacaatgcaatgcaatataataaaagttgctctaatgtctggacgtggtcaaagttctgacattttctaggtaaaagactttaagaatggctgacacacttctgaaatattaaaataacaaacagtagcatataagtaccaaaacagtgagtaaacttgaacaatgatgtcagaattgctaaaggcacatggcacaaatatatcttgagatttgtagaagattaggtaagtgacttatttactaccttgtaatgtaaggaatatacaaatggatttaatttcctccttatagatcctaaagtataataatgacatgatttgaagcttatggtgagagctataagctgattataagggagaactttgtaattgtagggctgttgaaaactacaatgagctgctccaggaggtagtaaaattacaattagtccaagtatccaagcataatctgggtaagcatatgctagagatgtagaagacatttgagcctgaggttaactactttttaagatactttttgccctgacatgtgattctataactgtgtatgggaagtctgtatagagtctaaggactgtactgtttcagagataagcgtgagcaacgcggactggagtatttggtgaaatcattagagaagacttgattgaaaccttgaagtgtacatagtacttgaataagcaaaagtgggcatggttactactgcagattcagaaggcagaaagcacgtcgtgtgtatgtgtggggacgtgggataggaaccgaaggagaaggatcttactgaagtggaaggttcaccatgaggagtggaggtaaatagaatttatggaaaagttggtactagaccacggtggagactgctggaagaggaagaggcttctgttctcagtacagtcatcagggaatgagggcctgattccggacagcgccattggcattggaagatccatgagtagcaaaggagaggacaaattaagaaacaaaacgattttgggcctggtttgcaccattttatagaatttgagaagatgtgagagtgaagtaatatagacagctttgtacattttctcagagtttatttttaaaagacagtcaatgagtttgttttttcaatttctagttttggagcgcatttgtctattagaaccattgttttactttttacctctttctaccttcataatttcatgtaagtgttcctcagtaggagtgaaaaatgaggagacatttcaattccttttgactctttctagctttaataaaagtttaccaagacaatttgaagcttgtcgccaacttaaacctctgagtggcccaggtgtcactgaggagaattaatctatgggaaaactgttggtgccttcaaccttggctgcttctgtaacttctggctcacaagacaggagtgtgaggagtgcaaaccatgtcccttgtgctttcctagtttcttgtcacctgctctaaactttagctgatagatgaatagtagcttgctatttaattctaattttctctgcttttgtctaagcagtagtgattttgccatgtatacactggtttacagttaattctgatccacttaagagaccgtgttctctttcgtagctaagagccaacactcggcagtcctgcttttcattgggccattggtatattctaattcacagcattatcttctttctgcatagctttatataaagaattctgcttataggtcttgagataaagtcaccgatctcatatcatggattataaggtttttcttctgctttctggcattttggatatgtaatgatgagcatcagaaagtttaatcatatttactttttagaattgttaaatactcctgaagtcattttggttgattttatgtggcttcctaccgtaaagagatcaatgccttgcagatataaagctttcttttccttctttaataatttataaactctgaatttaatgtttacagattacataactgatcataaatgaataatgcgtataatattctttaccttccttatctattcttggaacaggactatacaagcctggcagtcatggaagttcaaggattgctttttatcgatatctagaaataatttacttctctttctgtgcaagaacaatatgctctcctgtttgcagagctgccccttcagtgtgtttctaggtgtgtcacgtcaagcactttgtaactttcccattgagctcctgggatcagtattacaacatggatcactggcaggcctggtttcttctttatgaaaagtagtctgctagaaagatctaaaatttacaaaattattttattgtaaaataaaacgtaggtatagaataccacacaaaaataaaaactattgtgactcaatatcgggtaaacatcacacaggacaagaaagagagcttgccagccatcccagaggtgccgtccatgtgctctgtgccaggcataacagagctgtctccctgcctctacaaataaccactctcatgaattttaacccttgtagtttttttgcagttatatatgcatccctagacaccatagtcttaccagtttttaaaattagacatctttttaagtcacttttaatctgtaggtttgtcctttattcctttcctcgcaatttatctgttgagcctaggatgtttgacttctagcttcccctgtccacattttgctgattgcatactaatgccctcttcagttccacatgtccctctttcctctccatttcctgcaacttggcagccagatccagggtcaagtttgatcctttggcaacaccataggtggtgtttggtataataacaggaggaacaaaatgtgtcatctttctttttgtgatcttgtcagtctctgatgattaatgcctatatttattcctgggggtagaaaactgtgatattctatcatttttttgtgtgtcttatttcttttgtatttgtttagttgatgaaaagatacatactccccctaatctactatttggttacccaataacacaattcattaaggaaagggaaaatacatgctccaatctttgctatatttactagtttaaaatgagttggttccctatcatcctgcaaagatgacttactctttttttcttttaatatcattatacactcatggatttaaatatatttaatggagtttaatttgttgcaattattatttctattaaatcttaaatcgtcccatatttgcttagtgggcacctctccaaatttgctcctgattctttttgatatgattatagtaggctttgagagcttccttgctacctggtactgtgagatgtttcactttctcctctggatgtgagatcagtcatttttcaatgatgtcctgtttagttttagtaagaaatcatatttcaagataacgatgcaggttctgagagatactcatttctagatcgtttcagtgaatagagctaaaaaatacatacacatatatttaatgataaaatacctaatgagttcatagggatatttcaagttgaagcctaaaggtttttactcaatgtttatcttattacaacttttcagttacattttatttccacaccgatattcttggttgtcagtgacataaggaaggtggatttagaatatatcataattatacattggttttatctcattttattttgaaacttgtactaaagctccattgtcagcatatagctattgcatggataatatactttcttctacttagctcttatttagtctcacttctaaatgtaactatgtttttaatattcaatattagcccacctgtcatatctagtaattttgtacgtcagaaacaccttttttgcatttcaaattccttaggaactgctcatgggaatagtattccctgagttcttagatgttgataatagttttttgtgcccttgattcttaagtcaatttcacagtatatgaaatctttcattcacattttctttaattgagtaacttaaataatgttacttcattttctttcacagacagaataggtacagtcagtcactataaagccttggtgtctgtctgtacctattttttctagatatgcaaataattgtttctaattaatcttaccagaatatgtatcacagtaggtcactctgagatactgtcatcaggtatgtggtattttctttcattatgtagtttataaactttttttttattttagaaaattttttgttgttgttgttgtttttgcttttttttttttttgagatggagtctcactctgtcaccccagctggagtgtagtggcgcgatctccgctcactgcaagctccgcctcccgggttcacgccattctcctgcctcagcctcccgagtagctggaactacaggcgcccaccaccatgcccagctaaatttttttttttttttttttgtatttttagtagagatggggtttcaccatgttcaccaggatggtctcgatctcctgtcctcgtgatcaacctgcctcggcctcccaaagtgttgggattacaggcgtgagccaccgcacccagaagttttttaaaaaactatgatttgtagtactttatctgtacccttgatcctgtagagacttctgttttctctgtttgatctttgcctgtcatcattgatcactttcaaatatttttattctccttattctaaacattaaaaattacccctttttcactcattattcaggaatcatctgttgactttactgtagttactcataatttcttttttttccctctctatttctttctttctttttttttttaattagactttaagttctggggtacatgtgcaaaacatacaggtttgttacataggtatacacgtgccatggtggtttgctgcactcatcaacccatcacctacattaggtatttctcctaatgttctctctcccctagccccctatcccctgacaggccccagtgtgtgatgttcccctccctatgtccatgtgttctcattgtttgtctcccacttatgagtgagaactcataatttctagtaattaataatgatatttctttaatttctaattttccttaattgtcatttcatttctgagttttgttgtttaagtttatattgtttcatctcatgaatcatttccgtaatatgttttagcttatcttgaaatattatgttgcggttttgatctgttttatggacatatttttctgactgactttcattgacactaagaattatactctgttccttattttcttttaatcttacaaaatctatatgtggggtttgatcttgatacttttaagttattcatttttatgtgaaataagttttcctgaagttttaaaatgaggtggggttcaggaaactttacctgattttacagatttccctcttctgttgctttgagttatgttttaaaatacggcagcttgccttttgggatttctgggatttccccacttttgtctagtccttctatttccatactctcttattagtcagtctgtttttatgtggcaggttcagaaagattaaaaaactacgctactgccatcagcttcccagaatccctcagatctggtggtttcattgcatttgtcttctgacttcacccaccttccctctcactctataaattgcatggttttatagttgtggactcatatgcatcacgtttccactttctacagtgccgtttgaagcaaccagccaatcccattatgtttctttgtttgtttctttgttcttgtttctttgtttgactaaaatgttctaaggtagcaaatacatggttaccaaaactttgccttccatagatacttgattaggagtatatctaagagtgatattttacatgcctctactgctgcatcatgtagtggactagtagtgtcttctttgccactggcaagagaggttataagtacctttaaatctaatcagactgaaaaataaatttcagtaaacccagaatcagaaccaaatcagaaagttcatccataaaaatctgattctctagaagcacttctggtcctaaaatcatctctgtccctctggcctcaagaaagtaaagcagaaccagtaggagatagatatgattttattgaaatatatatatatatatatatatatatatatatatatatgtctatataattataagattacatatagtaggattttatttacaaaattgaagagatttactgcaaggaattggtttatgtgcttgtgcagattggctaggcaagtctgaagtctgtagggcaagcccttggggagggcaggctaaaacatgcatgcacagactgaagctgttgttcactggtagaatttcttctacttcggagaagcctcacccctggtcttaaagcctttcaactgattcaatccagtccactcagactatctaggataatcttatttactagattatggattttaagtccattcacaaaatgccttcacaaggtcacctagtttagtatttaatgaaataactggagattgtagcataggcaagtacacacatcaaaagactgacacagttatcaaacagattatttgcttagatattgtttggattatcatcttcataatattgtgattatcagaatttgctatgaatacctttgcacagcaatctcacagagtattctcatcatctctgttgaataagttggtacaaatacatatacccaatgttagatgaaaaggtagagatttgagaagtaatgagaaattgttcagctcacaaatggttacttcagggctagaagctgggtatcatccccagcagacatggttctgtcacttacacctgctctgtccgtgtggctcctcttattggtcaccttttctctccattgcaaagatactcatgcttcctagggtgaaactctttttcttgttgaatagctgactttatattttgttacacttgattaatctgattctagtatttgctatctccagcacatctttaccctgctttatttcagaattataatattcaccacctctttctctctctgtcaaatggtattcatttaccttcttccatccttccattgccagatagtcaatagtttgaatttattgtcatttcagcatattttttttttctaggagaacactatttacttactctaatgaaataagtataataatttctatggccataaataagaaacagtgcttctctcaaaataataacatagtattttttaattttagaaatttctaaatttaagttttctgtgaaatactttcatgtttttaaaattgtctttaaaatgatttcatgtttttggaattatagaattattttgttcttcaataatggtgattgtgatgatgatagtatctttatcatcctgtgagactgaaaaaaattcatacaaatcttataaagcagacaagctctagtaaggaactctcagttccttgggattaatttggctggaatgttgtaaatttcacgtcagcctcacttggtcgtagttgtgcaaattcactttggaattcattttgacaactcatatgcagtcttcttgatgctgttcaacagggacctaaatatcaaacataagaaaataggctctttctgagtcctacaattttaagaagatgagagaatcatatatcattatgtcaatgacatatgatagtcaatgatatatgaaagtcaatgaagaaataaatatataaataaatgtaatttgattattttcaagtcaatagccttgaaataatctcgacatgtattgtcagtgcagctctttttagtctgaaatgaaactggattgattttattcctcaaactttgaaaagagactctgaagtaaagtgtaacatattttaattataccatatttcttttaggatactttcaagctgaaagtaatagaaaaccaaatgtattatttcatttaacaaaaagtccaaagagaattgggctctagtaattgttggtgtcatttcagagatttgataagtaacttcctctgtctctctgcctgatatgccatcctgagtgcatcagcatttcccttagactggactgccttatggtgatgaatcagctcttccaggttttggcatgacagtaagaaaaagcaaagggaacccattttcttatgtctccttagaagtgaggaaacctttttagaaataacttgaccaattcctatcatatctccttggccagaatatggaccgataccccattttaaaaacatgtcactgttaatggaaagaagactcaggttaacctagtgttaatggcccagtgtgtctccacgtgtaatatcttgatgcagattttgatacaatatatctaaagtgatctcttgactcttcatttgtaacaatctgccagttgatgctgatgctactggtctgtagaccacatggcaaggtgtttggttaatagcctggctggtgaaaatagatgttggagaatcaacctttattaccactatattccaccaggaatgaaacttgtcaaatgaatactgcatgcactgtgcatgatgaagctgacttagtatagtagaggagaggagtgataacattgaggattatagtgacttgcccagggttacttggtaagtgacaagttttatccagcaacttgtattggagacaaaataaatacagaagcctgagatggattggagggcgggatggaaagcaggtaaaaaaagtagtgctaggttataatcccttggatcatatatttgtgtgattcatttttcagtacttctcagaggtgggtatacatttgcaatggagaaatcatatataaaaactcaaagcagaataaagagcctataaaaggaaaagttatttttgacttctagaatttaaatgttttcaattgttacctttagctctaatgaatcgttggaagccaagtaaagaaagcaatgtctaatatagattatattagcccattggaacgatgccttgattaaacctcaatactaaataatcaatttgttggataggaactgtaaccaaaatgaacataacagctttggtttagtttagaggaaagtctgctgtattttaggtcatcaaacctagttttgaattttagtcctgctaacaggctatgtgcatcacatttctaatctttctgaactttaattggatatgactgtatcagaaaagttcataagagagagaagccacagaaccagtaacagctcacataatataaggtacatggaggtgcttattaaatgattattgaagataaacctgaatattatgactgttaattttgttattttatttcaagaaataaatatcacataagtcttttgtactcattaattatataatatacatcctatataagcatatgtatttatagttatattagtatattaatacacacacatataagcatcatgtaatatatcagcttggtgatatcttgcctggatgagtttaagtatacccctcagcctctctgagttgtggtataattatttctgaaatagcttggtgtcagtgatctcttggtgtccttgaaattcaatatttttgtaacctccctttattattaatttggattgatgattaatgtgtattttattataacttaataaaagcctaaggaggatttatgtgactcttgtctctaaaatgttcagtgaatttaattcattttaacaaagtacttgagccacccgctaaataaagataatatatattaaatattatggaggaaaaaatatatataaatgagacatgaaaccctaccttcagaatgatttcagtatacaaacagatgaaaagacattgataaatatatcatagtagaaaagatttaagatagaaaagtcagttaataagtttttataatcttttatagagtttttgaggcagtatccatgaccctgtcagcaggagtagaaagggaagagtatatatgagctgatggaatgcgaacttgaggcagaggggaaggagctagataccatagatcaggtcacgtggaaatcaagtaggaatgtctgcaagtttttaatctccatttttagataacacagacatttttcataagaacaaatgaccgatttctgcaaatgtcagtagttttagaatagttgataagatagtgcaaattcaatattggcaatgcataaacaatagaaagttgaaagaatctggagccctttcaggctagagaatgtctctttgaaatgactcctgtaaagataagggtcacaaaatgaggtctcactgccaatgtagaggattgaaggagtgagagactgaattgcacgggctgttatgattcgagaggaaactgtcacagcacaggaacttggatgttgtaaggtggtaagggaggctgttggggatcactgaggccaaagtgagtttgaggatcaatgggaatattcacaggactgggttagggaggataatttggtctgtgaatattcccagtgatgggaatgatatgtgggcaccctgcgaattccaaaagttgagaggtgattgagtgggaaagtggaagagttgtcttcaagttaggaaccaggaaaatggtagctgtccctgaaagagggtgtaaggtaccataaaatgtaccctcctttgagatagtagtgttgtgagaggaatgccaataaaggtgaaaagatggaataatgattattgagaaggaaacattaaggatactcagaatctcttcacaagagaagggttttgaaaggcatagtgtgagaagacttgagtgggtgtggacatgtgcaagagaatttggaagtcagtacaggcagtgggaattggctagtcgtgcagaagaactgagaaatacatatggcagggagcaaggagagagtttgagaacacacctggagagataagctagaggaagcccagataaggttgtataacaaaagtaagcagcgtggtgggccttccaattaggaagattgtatggaaatgatgtgctaattgaaaaaaacgcagtctgaggtttgcatgtataatttttttttttggtttatgtggtttgtagggaaagagttttggctgattttatggatttatatttttggatataagctgctttttcagttccttattatccaagggaatgagtgggggatcttgctgcaaaaatcctgaaataggttggtaagcagagaaaaattaacaaaagtaatgaataaaaaatagcaaaatcctgatttggatttgatgtccttaggtatttttgtatgcatatgcagaaacatatatgtatttactacataatatgcatatgcatgatttaagatatggagaaaggtatttaaagatacagtgtatttgggatttagaaaattattattattattattattttttttttttttgagacagaatcttgctctatcacccaggctggagtgcagtggcgtgatctcggctcactgcaaactccacctcctgggttcacaccattctcctgcctcagcctcccaagtagctgggattataggcacccgccaccgcgcctggctaattttttgtatttttagtacagacggggtttcaccatgttagccaggatggtcttgatctcctgacctcgtgatccagccgcctcggcctcacaaagtgctgggattacaggcgtgagccaccgcgcctggccaggatttagaaaattattaaagcaatagagtatcctctttattatttactctaaaaatataatttcaaatgtacaaaaaatcatagaaaacaataaaatagccattaatgtaccaccaccctaatttaatagaagttaacagtttatatttttgtctcatgtcatcttatccttaaggaatttttaaattaacatttaaacatgcatacatgtagtactaatcagtggaatgctggaaccaatgagtgccagaaatttgttaagttttcaggaactttgatatcacactgataaactgaagttgctatagtggagtatttacaccccagaaatggacaaatactacaaaatggcattttatgtttcttgttggagaactaacagttccaaattttaccaatacattgctggtttttccttgcctagtttaactgtcccatcgtatcttactgaatgaataaaattcagtttatttatttgctactcagaaatatttggatattttccatatttcacaatcacagataatttagagttcaacatcttgtacgtatctccttgatcccacatacactggtggttcaaatgtggaaacctagaagtagaattgccgggtcctgaggtttatgcatcctcaactttactagatagtaacaaatcattttctaaagtcactctagcagtttacacttccaacaggaatgttatcatttttgtttcccatatatagccctatgaagtgatatttcaagtaatatgaaagataccaggggtagttagaatttcaccaacaagaaatgaggttgtggatcatgaccaattctttctcagcgttgtgggttttctttgtcctttttgctgtctttgacatatagaagttttaaaatttagattgacaatctcatttcatggttgttagacatacactttctcttttttataccctattcacttttgattgagttatctttttttctaattgcatatagaagatctttacgtattctggctatttattccttgatgggtatttccttgacaaatgacttatcactatttgtgacttgttttttcccctttatatatgatgtctttgaacatatagaggttataaattttttatagttgaatttttttcagtcatttcctattagtttatacttattactcttgtctgggatatgctgatatcataaatatggcttccagtatttcattttgaaatttgacaggtatgctttcaaagtttaggctcttttgactaattctctaaaatgtataaattggctgtcattaatgccaaagagagagttgtttgcaaagagtacagattttggtttgactctaaattattcatcattagtttattatcattctgtggccagcacatgctacacatttggaatacagagatgcacaggcaatgctcttactcttctggtggggaaaaacatactacagcacaggcaatacagcataagggctaaaagaagcttgtatatattactctgagagcatgggggcaatgaatcatttgccttggacccattaactctcctgttaattcatttactctggtgtagtagcaatttatggagaactgagaattactaccatagtgtcagccctacaccttttagagcaggggtccccaacccccaggctgcaaactggtactggtctgtggcctgtcaggaacagggccacacagcaggaggtgagcagtgggtgagcaagcattgccacctgagctctgcctcctatcagatcagctgtggcattagattctcataggagcacgaactctactgtgaactgtgaatgcaagggatctaggctgtgagtgcctgtgagaatctaatgcctgatgatttgaggtggaacagtttcatcctgaaatcatcccctcattgttccatagaaaaattgtcttccaggaaactggtcttttgtgccgaaaaggttgaggaccactgctttcgaggataccagtatttacttacattcttttcctgattgacaatggaaaaaaattgtggctcttttgcaacaagaataatttatcacagatattgcttgctaagatgctttatagatttatgaaaatagtaagaacctgtttttaaagattggtttctgtttgcagagacgaaatggagaagatataccagtagcccagactaagaacatcaatcatagaaggtttgccgcttccttcagattgcaagaagtgacaaaaactgaccaggatttgtatcgctgtgtaactcagtcagaacgaggttccggtgtgtccaattttgctcaacttattgtgagaggtaaggtgaaattgttttcacttcacgaaattgcatggctttattagaacaaaagcaactctgtagatattttgattgatttttaaaccatagtgtttctgatgtcaagtcactataaaaaatatatcatcatacaatttctcagaatgtgtgaaggtgaaattaagactgtagtttgtaaagtttttgaagtttctagtaagtgtttgccattgaaagaaatctattttataatgctctaagtggactaaatatatcaaataccttattccacattgtcatcacctcgtttgtattttaactttagatctagttcttcccgtttaaaacagttctgcggatactacttttctttgaagcattgtggcaatgaagtcaaggtccaagtttctatttccatatagtcctacaaattttactggtatcaaaacccaatagtgaattttcactgatgcatgtctcttatagaatcttagaaagttagaactaccaaacagtcctcactaatattcttggatactaaagttactagaagaatgtcagggattatgacatatcagtacatatttgtagtgaatactggaaaagtacaagtgcaaaacacatattacattcatttaagatgtatagagtccctcttatattgtaagcactgttctaggttgtagatattggagatacgattgtaaatgtaatacaatgtccctacccacatggagcatcatattgaattatgttaggcagactatatagacaggtgttaaaaatgtagtatcaagtcatggtatgggctatgaaggaaaaatagacacaaaacgatggaaattgatattttagttaaggtgttctggaaccagtcttaaggttaccactctgagaaggtaacaactgagctgaaagcttaaaaataaaaatagagacttcagccatatgaaaatctagaggtaaagcagctccgttgagtaggatatcaagcatcaatcaatattgacacaaatgaaaataatcgtaacctgtttaagtctcttcgaggagaagtgtgagagactttagcaaaaatatctaaactggggctgagactgtaaaactatcatggaaggcatttgcaagtgagttttctttgagtaaggatctgaaggttgagagaaagttgcccaagtaggggtatggatgtagagtcaggggcaagagaaagaaacaccagcaagcagagaacacagcacatgccgaggcctacgggctggaaggagaatatgagatatgtccatattttataatgcttggcatcaaatatcttttacatatattattcaatattgtcttgtttttaatactttaacctttgatatttttaacgaaaagaaatttgaaattcacactttatgataatttacccagagcaaattaaatctaatgattgacagccagaatagaacccattgtttcttgattcttaatggtgagctcattcttttccactacagttttccctcgcattaccattattggatgatgcgatcaacctcttgtaaactttagtcttggaagactctatcactcattttttaaaaaaactttatagattaaatacgactattttcagtgtaacttgtctgatgtctccgtattcagctcatatcacctgcacaagttcatgagatcccagtttcaattaagaaaatatgatagtatttgacttccgtatttaggcagagaaacaatttatcacatgttcacacatgcatctttgttaagtcccattccagcatctctctcacctgagcctaattttgaaagcctgaaggtgtccttgggtaatcttcagggtgattaatatgctatggctacaggaacgtgggcgtgctattgaattatcatgctcactggatcttctttaccatatatgcgttcacaatttgcaaccagtgaaggagatggtatcttaatagtgtacctagaatgcttttgaataacagtgatgtataatacatagttatatatgttctatatagttatctatacatttttttccagaaaagtcactcttgatgtatttctcaaaagattgtagaagacctgtttatgcttttatccaggtgctccctttatatgtatagtttcttctttcatgcgaacattttctgcctgtttattttaaaagagaatcattttgtcattactggatctcttttgtttatcttaattgataagtagattttattattttatcaaagcctggttttccttacctggagacaactacattacaatgctcttccagcagtattacttgttaaattaataattatttcaataaaatttataagaaagaggatccttaaatttcattgaaaattttgaccttttttttttttttttatttttctgagacagaatctcgctctgtcacccaggttggaatgcagtggcaggatctcggcttactgccccctctgcctcctgggttcaagtgattctcgtgcctcaacctcccaagtagctgagactacagatgtgtgccaccgcacccagctaatttttgtatttttaatagagagggggtttctccatgttggccagactggtcttgaactcctgaccttgtgatccatccgtctcagcctcccaaagtgctgggattacaggcatgagccaccactcccggccttatttttcctttttttaaagaaagtcctgccataagttttgtgatttttatgttggaaaggttgagttgaaagatgatggcattttgaatttgttatccagaatctgctatcattttagaaatatattttgatagttttgacaattttatttttctttcaacacactttaggttgttctatatttaatacgtacaggtgatactttgcttgctgttttatttgaaaaccaatacagaggaataagttttcttgtttgtagagataaccaccaaataaatattactaaccaaaaacatactctcgggggtcagctgtcttggtgttgaaacagtgctgagaattaactgtgctgacaggtcctatctctcattggcacttttaaagctgacatcctgttacatggatacaaaagatggtaattttaaaggaaattttgggggcagtgatatgaatagtctttaataagagctggcatggtattgcctgttgtcaaagatgacccaagggtaagagtttattagtgcattttctcctaaactgaaagtgacagggcatgcttaaggcttttttgttgctgtttgttacaaatgaaaatttcattgcagaattttcatgctgaagagtattgatctatgttttcccacagccagaagaataaaaaaaagtatggagaaacagaaattactttgctatgactttagcattgcttcctgatcattttgaataacgataatgtattcagcttatggaggccaatctctattgacaaagaagtttttatagagatgagatgcagagcagatatttttgctcagtgttttacaaaattgaagtgtaaaaaatttgaaatacaagtcgaagtagtatttataagcttcaaactgaatgcaccaagcttcaaactgaaagcaccaactttgtaatctaattatgctacagattattttgccaatcctcacctcagctgtgatctcctccgtctgtttccatctgtctaaaccgaagacccacttacatctcgaaccagctgacctaagtaaaacttctataaaattctctgattcctacacctcacactcaatttctattgcaaattgttatagttttatatctatcatttttacctgtgaaactacagttacattttaagtacttcagtttgaaagcacagtttttggtttgtcattgttaatggcttgagttttaaattttagtgtcaattactagtcattatcaaaatgctctggacacagaagtatttagttaatattttagtctgttcctaatgaataatagtgacctctagctataaatgggggttagtatcaatcactttacctaaccttactcagggtagttacccaaccttattcagagttggtgtttaacatcataagaaattcaaacagatgtcattccgttgtaagacaatataaactagcttatacataagaatatttactaatttttgtgactgggtagtacaggataggcttcaggatttgttgatcaagtcattaaagatccacgttctttccaattcttcactttgtagtctatgattttggcttctatcctaagccaggcctaccacctagtcttaggagagaaatatgactacatgcttccttggtcttatccagttagggataaagagggcagtacctaccacaactatcaaaataataataataataataataataatgcatcactggttattggataaacagctagtatgtccagtagagagcttttgtacacaggactccagagcgtaaacagtgttactcagaattagttgtttattttattcagataagatagtaactgaggaaataatgtcaagagaaggtacaacttaatcctgaaggacatacagagtttggaatatggtactattggagaagggtgttaccatactaagtcaagtaacagtatgaatcataggtaatcagtaggatcgtagcttatttggtcaatggtgaactgttcatggaatcacttgctttatgtcagttatttactatgcatatgaagaaggaaagcattcaaaacctattagaacttttcagattctgcttttactgtaattgtagtttatgtcctatcagagcctgtcttgttcatctttgtttgcttcagcacctagcacaatatttacatgaagaaattcagtacttttctcaaaatcaacaaataaaattgtttagttgaaatcagaggagtgggactgaccctggcatatgtaggggatgagcaatgaaccacatatttcttctcacctacagatggagtcaagtttgctggcataaaggaagtgatgatgacaattgtggtgtctacaccagactctttcctttgtcaagtgggttattaagggtgacttttcagtttggtgtaaatatttttcatttgaaaaataatattgatttgaccagtattctattccggtactctaatctttttgtacataaaattaaatctgaatttttttggtgtttttatataagaagcaaggttttgctagttggtggctaagggccatggaatttctagcttgagacctttagcaagctgtttaataccatgcagtattgatttttaactagtttccctagcacagcttttaggctcatgaattcatataaagatcctttttcttaatggtgacttgagatcccttttcttctattgtgaaaactggtcatcttgacaggaagtttggaattatcttggagaatgtaatttaaacagctatgttttctaaaaactgaaatataatgaacatttcagaacacactgaatcacatactaattttaccccccaaaacccctaaatatttaaaaaagcccatgcagccagtggataccaaatgtgtcaaatttggaggagtctccaaatctctcatatttaaaaattttactttgctccccttgagtatgataaaagaaacatttggagtctcctctcattcatattatctacttgtaattcaggtgattcagtgttcaagatgtctggtacatatttaaattctaaatgagcaaaagagtgctagatgttcttatttcagatagtatattttggtgcaaccagaaactagacactcatttgaattgttcatatagtccattaaacatacattttcaaagctgaaaagtattaaaaaaaagatagtatctatgtttatttaagagtagtagaaaaattatggcttttaaatctaatatgaatattgactgggacttcatataattactgaaactctacttgatccacttctgtacaccattatgccaaatacttttttctattaattttctccttttctgagtttccttatagctactccataaggatagtaaagtgcagcagttgtgtttgtcagattgatttttttcattttatttattttctttcagtttgtttttaaaataaaaatgcgatgagagttctttccctaaaggtttctcagtttattttcctaggcaatttgtgtgttgagtgggtagggtactggtcactgctctttggagtaaatattgggggtttgcttttgatgaagctttcgtcttaagaatttgaaaaggatcaaagaggaagcagaatcatttgcatcattaataattatttgtgctgaactcaagggaattttatttcagattgttgacagtaggcctgtacacgttttctaagtttcaattctcttctcttggagtttgtgataaatgtaatttggacccatttccgtctaccaagggactcctatctactacatggcccgagtgtcttcgtagtttatattcccctatctgttaatcatttttctttctcttaccccaaaccaaaaataaagaaacagtgtccatttgaactaagattttttagtctttctgggtttatttgcaacttcattgaaaaatcagctagcagcctttattgagttcttaatgaggtaataggcaagtgcatattatgatgttaagtattcaataaagacaaatgccaaaaaaatcgcatacatagtctcagtacttaagaatctcataatttaattctataggaaatgtagaattattgagtatcatgacacagaattttgacttaggttttgattttaaactctgtaagaataaaaaatgtttcctaacaaataaaaaatagtctacctattttctaactgcaatgaaatagcaactatttcattgaaaccccttattaagcactaatttggctttaaaaagttacactgggagagtcttatagaatgttaattgaacagaagctctatagttgacaaattggaatcaatcagtgagggcagggagataaatcagagtgtttagtggtataatgagtaaggatggcaatagaagtgttgtagtgggacattacttcattagtttgagttcttgagtctctcccactctcccctccacttcatcttcaagagagtcattaatagcagggttctctaccactatatgacttacaggtgagtttttgtgtttagtcttgcagttagcataaattatttgccacttaagcagtacatcttttaaaaagctagctaatatacattctgctgaccagtaaagcatgatcaggaacctgactgttactaagaatacaaacatggaaatatatagaaaacaaaaaaatgcataaaatgttatgtagaagccttacaaataaagcaaataataatatgtaattatttattaatgtgtcgatcaaaaccggcttgttcaaagtttatgatagtaccacagaaattgcttgctttcccatctgggttaagataaatgatgttttccctctttctaggaaataatataatctgacaagaattaaaaccaagtataaggtcaacacaaatgaatacagataaataatactttgtcactcctcagcatagattgtgtttagttcatgattattaatttttagaaaaaaagggaaatattgtaacatttcagtattaaaagtgagaatttggggacggagagctggacagaaattaaataatatggcagaaaatatggcggctttcctcaaatataaatatacaacagtctcttcttgtacaggctttactttagctctgatacttgtttttagagaaattatggcctatagatgtgttctcatctcttacaaggtatataaatacagtgacttttacactttaggatataatttatccttgttataggcacataactttcttttgctctccagtttctgttttctgagccctaaactgagaaaatattttgttgtttttctttattgttgcttgatttggagtcatagatttagctatgatgacacagaatctgtccttgtattaaacaacaaaacagcaagtaggtaattacttgtaccttcgttaggaagaaattttacccacctggttatttacgtattgctgattgcccctggattttcattagtcttttttatacatatggagataccatggctactctcatgttgccatgctacctcctccagcagcttcccttcacattaagggggaaaaaaaatcacagtcctttcctgttctaagtgaccttaaatgaaatatcccctgactgccactccaaatttgttctttatcactcacctccttccttgatccacagcaggcaaagccagctcttccgagtatacttctgtctctgggcattagacttcctgctctttccaccctcgcgtattttttcttgaatagatgcacgcttttacattcttattcctttcagctttcttcttattccccaccccccctccccaaaaatacctaaaggccaaatggcaattattttctagtacagaagagaattcattgattttgttttactgttttttttttttcctccggagttatttaggtcaaagtttttgaaagatctttatgtaatgcctactatcagtaagtatatgcataacaagagaatggtctcaaagatttttgtgctgttggaaatgcagtgaatagaaatctgtatgtctgaaatttgtttgtaatatgtatataaatagattccgttattcatattttattgcatagcctttgaatgccccacacttttctttattctcactgccaccacttgtctctgtcaccatcttctctttcgtgtacttctataaaaaacctacttattgatctccctccatgaacgcttaccttctccaaggcagtcttcacacagaagccagagtgactgtatgacacagtaagtcagaatatgctccccctggcactggcagcttcctgttcttgcggtataaattccagctgcctcatcacagctccaaggccctgcttgctcctaggcttttagctgggctcacccccttcagtccttcataagactctcctttgctcactaaactctagcaacactggttttctttcacttgctttaacataccatgatctctcatgccttagggtcttggctttttctaatcaccctgctccttcaaaatataactgcattcataacatctgtctcctccatgagactgatgtacttagggacccctttccttttgctcactcatgattggatctctgtagccaataccatgatcaaagtctagcaggtctcatcaaatattgtcaaaaaaacaaaaatagtgaggtataaagtgccatatgaatgacatgaatttaatgtgtagaatgaggagggcagcctcgtggctgccttttaatggtcaggggatgtgctgaggaggatgggaagttccatcggactcttgatgggtgggtagcatttggatagtggaagataagtaaagggcattctgggtagagggactggcactggaaaacatgttcttgtgaactagcagtaaatattgactgtaacacagtgttttccactgaaaacatctgagatgatcctgaaattgtactttgaggccttactgtggaacaatttgagtgccagactaagaaatataaatgcattgtgttatttaatttgggaacctttaggagttttgaagtaggttacttacatattatctgtctcagaaaaccaggataccagatgatgtggaaaatggcgcgtttttagggagtaagttaagggggctcttacaattttaaaaacttgagatgataagtgataagtgttcctggggggggtggttatggtagaaagaatgagtcaaggatgagagattaggcagcaatgttgttaaagcattgtgtaatgacagtaggaggagaagtcaaaggagacttctagatttttgtttgggatattggataaaatgtggtattatggtcagagatttggaagccttgtagaagaactcatttgagagcatagatgttaagtttaattgtaaactttcgattggggtgctaggaacatatccagttttaaaatctttaggaatgtgggtaagccttaaactaatcatagggcattaagtaaagactcaatacaggatgaattgaacaataggtgcttagtgcatagaaattatttgtatttcctaagtttccatttcatagcctttagcctatattattggaatttttcatgttgtttaactgtggatgaaagcacagttttttaactaaatggaaaatttagaaagagaaaccaggcagttaaatatgatgtcttttttattgctgacattatctgcatataaaaacacatgtaagatatatcatgtggaaagatatcccccactgcttcatgtagattcctgactgtattttggttgtcggttaagtggaaatctttttcctcttctttgtaaaactttttacttcatagaaataaagcaaactctctacaggcttctctactttctcttcagaattttattgctcctgataataatgctcctggacctttttcctacatcaatgttttaaagggttgggagagggaattttttttttttttttttgagggtgtaggacttttggctaacagcatttctcattctcaaagaatgtcattcactgtagtgggtggtttgaaaatatttacttaagggtagataaagagttcccacctgacataatcttcctgtgttaaaatccccactcaatttggcatttctgtgtactgtgcaggattgctaaaaagcagttaccatgatcagactggttgatgcatggtaaagatgtaaagcagggtgtttggaattcaacatggatggtagaaatgcgagatgtcagagaagccatatattaaagagaatttgaattggaaactgaatcccaatctgccaccgagaacattttgatcattttgatttattaaacttttataacaacattcagatggagctgaattaaaacctttagtcttggatagtttatgggacaccaaccactgtgttaccggtatcattttgaaggatctcttagcgtcagtgaaaaggggaaaaatgggtgggtaagatacttaatttaaaggaagttttcacttatattcttgcatctaactttaaatccctcttttgtttgcattgtgtcacttaaacatattttataatttcaacatattagataccttaaggttttgaattttattgtgaaacgtttttgaaattctgattaataattttcagattgaaacactgcttttgtatatatggtacaggctatcttttctttttgtgtatatctgtacactcagaggcatctgtatctgtctatgtttgtgttgctgaggtttatagataaatattcaaatagaaatactaatgcaattttgaagcctaacttgcatgtaaatgagtgcattttcctaaaactattgaattctgtacgtctgattttttaaaaatcaaccatcagcaatcatggatagtcttttctgaacagtagctccataataaagagaagtcaatcactattagagaagcactgtaggtgaaaggcactatagttcacacttgattttgtagcggggagagggtacttagctgtgaatcaggaatgatgcaaaagatggatgagatagagttcaaggagcagtaatgtgagagtccaggacaatcatttcaagctgtctcagcagtaatgatggatggcttggtggtaagaagtaataataccagatgatgaaagatgcatctcagcaccttgagcccgagcacaccatctacctgttggggttctggggcataatgattcctgatttgcaaccaaagggttttgctgcacttagcaacccagatttttggcagctgtgaaggaagcaagtagcatatcaaacactccttcacattgtaaatttaattacctcatatttatgcatagtagttgttgacaggaacttgtaagctatgctaatatggaaggtaatttgttacctccagaaatcactttccatgtgtcttctgatcattatcatgaaacatgataaatgatctagcccatgaggtataaatgaaaatgaaatagataattggattctatgtctacattgtggctggaatagtcacagcaattataattgaatttatctcataaaaatgagttggcaatacatcagtgacctttcatcattttgtgcctatggtattatatgaagctacttttgagatgaacacaaaaaatgtatcataattctttttaaagagtaatctctaacacttaaattttctattttcttgccttatctgcctatatatttttaagtatctagtttatctacagcgagttttaacaattaatactgataatcctttttttatactgagaataaagtgttttgttgttaccagtgccttgactgaatggcttaggaacagtgtaagacactctgattttttttttttttttttttaatgaacaccctttattattagcagcatgtatctttctgctgggtgatggaagtgtgccttcttgctgaatctgtgtgttctctttgattcttataatatgtttctgatatactaaaataaaagagtttgttttaaatatcaccagacttttttctctttaccttctctttaagtcactttaaataataatattttattattgacataaaaaccctatatattcattgatttgattaacatatttgaggatcaccatgtgttaattattggatttattgctaataaaatgactaagatgcatactctttagggggttatagtgccatatgtaactatggtaatatctagttttcaaattataacataatttcttttttctccaccagcctctttccatgagggtccaagaagcaaataaagcttctgtttatgtttttgtatttctaactaagaaagtctattccagattcagttactaacaactatatggaaaataagaagttatctggaaatgtgacttatcttttgaatgaaatatgtcaataagcagggcatgtccctagggacattttctcccactcttatattttttaacttgaattttttttttttttttttttttttttttggtctgtgatgcagattctcactgtgttgtccaggctagagttcagtggcacaatcttggctcactagaacctctgcctcccaggttcgagcaactctcctgcctccacctctcaagtaactgggattacaggtgccccccaccactcccaatttttgtgtatttttaatagagatggggtttcgccatattggccatgtttggtctcaaactcctgacctggacctcaaacaccatcctaagatggtgatccacccatcttagcctcccaaaatgctgggattataggcgtgagccaccacgcctggccttttcttgaaatttcttcactttctttccttttgtttttcttcaacttttaagttcaggggtacatgtgcaggatgtgcaggtttgttacatacataaatgtgtcccatggtggtttgctgcacagattgtcccatcacctaggtattaagctcagaatccattagccgctcttcctgatgctctccctcccccgcatacttccatccaacaggccccagtgtgtgttgttcccctccatgtatccatgtgttctcattattcagctatcacttataagtgcggaatgtggtgtttggttttctgttcttgcattagtttgctgaggataatagcttccaagtctctccatgtccctgcaaaggacatggtccaattcctttgtatggttgcatggtatttcatggtatacatgtaccacattttctttatccagtgggtcatttatgggcatctaggttgattgcatgtctttgctattgcgaatagtgctgcaatgaacacacacatgcatgtatctttataaaagaatgattccattcttttgggtatatacccagtagagggatttctgggtcaaatggtatttctgcctctaggtctctgaggaattgccacactgtcttccgcaagggttgagctaatttacattccaacagtttataagcattcctttttctccacacccttgccagcatctgttgtttttgactcttcgataatcaccattctgactgatatgagatggtatctctttgtggttttgatttgcattactctaatgatcagtgatgttgatcttttttttttttcatgtttgttggctgcctatatgtcttcttttgagaaatgtctgttcatgtcctttgcctactttttaatggagttgttttcttcttgtaaattcgcttaagttccttataaactctggatattagacttttgtcagatggatagattgcaaaaattttctcccattttgtaggttgtttgttcactctgatgttaatttcttttgctgtgcagaagttctttcgttagatcccatttgtcaatttttgcttttgttgagatttcttttggtgtcttcatcatgaaatctttatccatgcctatgtcctgaatggtattgcctagatttccttctaggctttttatagttttgagttttacatttaagtctttaatcatcttgggttaatttttgtatatgttttaaggaaggggtccagtttcaattttctgcatttggctagccagttctcccagcaccatttattaaatagggaatcctctccccattgcttgttttttcaggtttgtcaaagatcagatggttgtaggtggatagtcttatttttgaattctctattctgttccactggtctatgtgtttgttcttgtatcaatactatgctgttttggttactgtagccttatactgtagctagaagttgggtagtatgatgcctccagctttgttcattttgctttggattgtcttggctatttaggatcttttttggttccatatgaattttaaaatagtttttttctaattttatgaggaacatcaatagtagtctaatgggaatgctattgaatctataaattactttaggcagtatggccattttcatgacattgattcttcctgtccatgagcatggaatgtttcccatttgtttgtgtcctctctgatttcttggaggagtggtttgtagttttccttgaagaggtcttccacttcccttgttagctgtatttctaggcattttattctctttgtagcaattgtgaatgggagtttactcagaatttggctctgtgcttgcctcttgttggggtataggactgctagcaattttttcacattgattatcctgagactttgctgaagttgcttatcagcttaagaagcttttaggctgaggtgatggggttttctaggtataggatcatgtcatctgcaaataaagataattcaacttcctctcttcctattcaaatactctttatttctttgtcttgcctgattgccctggccagaactttcaatactatgttgaataggagtggtgagagatgacgtccttgtcttgtactggttttcaaggggaatgcttccagcttttgcccaatcagcatgatattgccgattttgcctgtgggtttgtcatatatggctgttactgttttgaagtcttttccattggtttattgagagtttttaacctgaagagatattgaattccattgaagtccttttctgcatctattgcgataatcatgtgtttttgtttttgtttttgtttttttgtctttagttctgtttatgtgatgaatcacatttatttatttgtgtatgttgaaccaaccttgcatcccggggaagaagccaacttgatcatggtggataagctttttgatatgctgctggattcggtttaacagtattttgttgaggatttttacatagatgttcattaaggatgttggcctgaagttttcttttgtctgttgtatctctgtcaagttttggtatttaggatgatgctggccttatagaaagaggtagggaagaatcccgccttcttaattttttggattagtttccgtagaaatggtaccagctcttctttgtacctctggtagaattcagctgtcaatccatctgatcctgggctttattttggtttgtaggctatttattagtgcctcaatttcagaatttgtcattggtctatccagggattctatttcaaattcaaattgagttgactgaaccacagagatggcaaccaccccttccctggggaactccgtccttcttaggtggacggagcctgtcagcctgtcagcactgtctggctggaattccaagccagttggtcttaacttgtgaagtgccctcgaagtggggcctgcagaacaacactgcttggctccctgtattcagccccgctcctaggagtatgtagtgaccctccctgggaatcccgggtccagagtatacaaaactcctgagtgtctgtgtgtacttaagtggttgctctgctgggacatcacacagctctgtgtattggacccaaggccctagtagcctgaacttacaaggggatctcctgatctgcaggttgcaaatatttacgggagaagcgtggtttccccggggcagggttacataattcctcaccgcttcccctggctgggagtggggcttcctttggcttcatgtctccccgaagtgggccatcgccccaccctgcttttcttcattttccgtgggttgagctgtttgcctagtcagtcccagtgtgagaacctggatatttcagtggaagatgctgaattcactctctgccttcgttcctctccttaagtgccacagatggcatctgcttttattcgtccattttccagggcctatatatcaatttcttcactttccatactcattggtagtgatactccaactaataagattattgttaattttattaatactagtcttgctacttgaagcaagttttacataaatatgaataagaaacagatttgtgagatttaccccttaaatttcaatgattcttactactgtgttactggggtcattatcttgtctctagaaacaatgcatttcctttaagttgcttgactgctatttttaactgattcctgccctaacaagtagcatgatagttattacctaccattttatttaatatttttaatttttaaaatttgatttagtaaaatatatatattttttaatagagatggggtctcactatgtttcccaggctattcttgaaatcctggcttcaagcagtcctcccatctcagcctcccaaagtgctgagattacacgcatgagccgtcacgcctggccaaacctatcattttatagtagattctcaatacaggaacaggagacgtgtgttcctttctaaatcaaatgtagtttatatttgaaactatttaggactaccacacatgtcctttttttagattctgatgtactactgtaaacatacgcacacactcatgcacactcacatgtgcatggatgtgcactcaaccttgatttcagcatggctttgttagaatctaggcagagcctggcataagtgtggtttattaaaagttaagaaattattctgctattgctcttgcatttttcttctcctcttccctgaacatttttcttggattttatgtcaagaattatgaattgcctttgtagcgctaagaaaattttggaagtgttttcaatgtctttaataatatcatgagattctttgagtttcagcactttcctgtttgtagaaaaaataaattacatagaatttaatagcctatcctcttttaaagtcatagtgcttagtaatcaaagaaagtccataagcacctatttttaattaatatgaaaattaaaaacaccttccagggtaggctcagtaaggtaggatcttttaatgtcccaatcatctttgattaagtccaatgaaaattttggactctctgtcccttcccttcccctccctccctccctccctccctccctccctccctccttccctcccttcttcctcctcaccctccccctcctcctccccccctcctcctcatccttcttcttcttcttcttcttctctctctctttctgtctttttttctttttcagaccactccattgacttctcattttcagcttgataaaatagcattagaaaacttttatttatttattttacttttgacagggtctctctctgtcacctagactggttcactacagcctcagcctcccagatacaagcaatctcacctcagcctcccaagtagctaagacgatagctgagcaccaccacactggctatttttaattttatctttatatttcatagagtcaggagtcttgctgtgttccccaggctggtcttgaatgcctggccttaagtgatcctcctgcctcagactctcaaattgctatgataataggtgtgagccctctgcctggcctagaaacctttaaatgtatgctgtggaggaagtttactctaatttgtatcttaagtagggatgtaatctaaatgtctcttcatgataaaagtcaaatcatgagctaaatccccttttaaatgactcatttgcagagtagctccatttctacatttgcttaccttacctagagagatgttattagatgagttcagaatttttctctgaactaacagtggcaatgcagagtacaaataatatcaagacattaaagacctaactttgcatgattccagtataatgttacataaaagaaatatattctcataatagagagatgctctgggaaatgtatgaaccatcatatatagatgaattcaaataagtaattctgaagaacttgtagttagaaagcagaaaaaagtttacttgatgcctttatgtggtataatcacatcacaatatatgtaacatacaaagatggctgtagaactccactgctccttctaacctatacttgatccatctcataggcagaagcatttgaatgcctaaacttttgcagatggctattcttcatgtttcttttgatttcggggattctcttgctttagaagtcaaaagatctggtacattgaagcatttaaggaaaaacatagacgcccatgtttgtgattgatttaggaattttcaagagaaattttgaaggaattagattttgccatacatgctggctttaaatgttaaatctcaggatgagattccacttctacttagtggcccttgcgggggttggcccttgtgggagttggtggattttctggttaagagtttagtttgtttcctccctttccctaccctttccctccctccctccctccctccctcccttccttccttgatatattgtaggcatatggaaaagtgtatattaaacatatagtttgataaatgtatatatagcttgttgaatattaccagcaccccagaagtgctacctcattccattctagttaataacctcttcccccagagtaaccactgttcttggtttataacattaataagtaacaggtatatggcatcttacatatgaatagtttatactcttatctggtttctctcattcagcattaagtttgtgaaatctgtattgctgcatgtagctatgcatcatagaacatcattgttatgaaatcttgttgtgtgactgtgccacaatttattcatttttctgatgatagacatttggttctttttcaccttgagctatttacaatagcagtatttgaatatactactatatgacttttcaggaacagatgggatcattttggggtagcacgtacctgaaagcggaattgctaggtcatagggtatgctgattttcagctcaaggaggtactggcaaaaaattttcttaatttctcatataatttatactccaccttgcaagcataaagtttcacatcttcaccaacagttgacattatcttgctttccatttctaattatcttcttatgttaatacttttatttgttcataagtgcattcattcaacaaatattgattgcactgaagacataaatgtaattcaaaggcaaacaatatacagtccttgccttcaagaaagtcagtaagtgaagagagaggcaaaaaatataggtaaatctcttaccagaaaaagtgcgtttatttcaggctgaagagagtgtagtgagaaaggttttcagaggcagtaataactgaactgaaatttgaagatagataactttgctaagtgtataaatggcaaaaagacactctaggaagtataggataaaggtggaatgatttttattattatactttaagttctggggtacttgtgcagaatgtgcagttttgttacataggtatacacatgccatggtggtttgctgcacccatcaacccatcacctacattaggtaattctcctaatgctatccctcccctagccccctacccccacaacaggccatggtgtataatgttcccctccctgtgtccatgtgttctcgttgttcaactcaaggtgggatgattttaagagaagagtttcccatggaaaacacaagttgttaaatgtgaacatataattggacttgaagagtgataacacatgaggctggacagatgagcaggggacagatcatgaaagggcagtgcatttattttaggaagtttgcatctttctcagaagtttactttcagctgtcttaataagacatagagttctatttatcacctgctgcatcataaaacttagtggcataaaacaataaccattttatagtgttcacagcttctgtgggctataaatttgggtgatatgtatagatcactccagtatgatatttgggtcccgagctgagagtctcaaattgaacagctaaaggtgatttaaactcctggaggctagaatcatctggcacaagtctggcacttgaattgggataatgccactggctaattgaaaattggaaatggtggcacctagaacaagtgttctaggtctcattacatcactttctctgcactatacttgttgaggcaggcatgaggtctctctggattgaaggggatccagcctctcaatgcgagtgctatcagagaatttgtagcgcattttcagaccattgcagtgactaatgttattttgtgcctttatttcatgttctttttgttgtctaccgtaatagtcacaaaaatctatctagtatagtttgattgtcccccctccccagccattctgagtgtaatttgaatatcacctaggggacaccttggtttagagagcacagtcttaaccattgatctctttttcctcacataattgacattggttttataaagaagaaaatatacaatgagtacatttatatctctgtttaacataatttgcatttatatattaaaataaattttgaaagtagatttcaaaatatccaggtacaaattagtgcctttatagtttaagcaaattattatgctgtatagtaatgatacatctagtatacttctctgattaatttccaagtttagtatcttgacatttgttcaatgtcagacttttaatttaaaacctggacatagacatttaaagatagctaatgcatgaggggcttaaaacccagatgacaggttgataggtgcagcaaaccaccgtggcacatgtatacctatgtaacaaacctgcatgttctgcacatgtatcctgaacttaaagtaaattttttaagccaaaaaaaaaaaaaagaaaaaaacaaaagagattaaaaaatgtaattgtatggcgctggagcaggaattgatacccttcagttacaatatggagatctctcagctatcaacttatattagtgcatcattttacaaaatttcataccaaagaaacatggtaccttcttcttttttctataatgtttaaaatagtagccttcctttctcaattctttattcgtcttacatccactgattgaggtaatattttcaggaatcttcaatatctatgaaaatattagtgccattttatgtcttatggttcttttctccagcaaattttcagctgacctggctgagcgtggaaaaggatagggaatttgaaatttacagaaaagagtatatgaatagtctggattggtagccattttatgtccttattttttaaaggcatggtatttatcaaagtagactaggaagctctcttgttacttaggaacagtagctgtgaaagaagaacccaactccttagctgtgtaattgcattacttgtgctctagaaactattttactagcctggaaatttctcttgctgtgcatgttggattatagaactaggactcccttccagtatttcatattttggatgatatgacttattttgatactatgaatgtcagatgccccattaaggtgtgaaagtgagtgtgttcaaggggagttgaaataaaaggtcttttgctggcttggctgtcacactggtataaaatgtctttgaacaggtaactatttttacatggttaagcatcttaaaaatattattaacttgttattttatcagatgggtctataattattgccaaccttcagcttccatctatttataaaactaggtgtggtgattttgatagcactttgattattgaggacaggtattttggcccctaaaggaatggtaatagaattagatgattaaaatattttttcagaagtccttatagtaaccatattgatagatctgctttaatgcattctcttttttcttcccccatcattaagcctacatattctccaattgcccatgaaaacctgcctttcttagttgaaagacttattagaagtacgtaataacctgtcctctggttcccaggtcatgtctacctgacttttttatatcattgccatcaggatagcttacctaaagtcagtgactccatgtagtgaactcatttctccttaaaagttctgtatctcttaatccaataagacacatgattgttttttgtttaattccaaaattgaggctattttggacaattgctaattaatatcatttgatgtccctgaataaatatatattgagaatttttacgttataaaacttagttggatctatataagctaatgacaaattttctttgctatgaagatctttaaataagtctctgaagatttatgtttttttgatccaaagagaggcttataactatgactgctttggagttagtagtacatacatgaatcctgttatctagtggaattttatatatgactgaggtcttgttccattagttttactatgtcatcacaattcctttttcgtaaaaaagtaaatatattagttgtacatacagggatatgcctggacaagtcatcgtgactctgtaccctacatagacatgtagaaataataggtagataataattcccctgattaacttagggtaaataaagttttgcattttacctgactggaaaccagggtcattgagtggaggatgcaagtagtgtctcctgatttattgcaggtctgagtcattacattttaaaatggtcatcagttgttggtttcatgtgcttaatattgacttcgttatttggtattgacttgaaatgattacaaagtatgtatttataatatgcttgtacgttgtatgttacaaagactcatcacaatggagtgtttagacctggggagtaagttggcaaacttagattaggtttcgttacaactaagtgtcacaaaaatcttctaattacataggtttcaaatttcttaaaatttggaatttaggctgatgacattttacaaatgtatttatattctagatgtggaagattcaggatatttttaataatttttttaaactatatatacatatcacatatatttacatatgtgtatgtgtctgcatatatgtatattacacacacacatctataaatagagattatattctcattatagagattttgcagtaggttttttttaaaattgatatcttgtttactggattcagccattgtgtcttaatatgaaatgaatgtggatagtgttattgtactccaagtccttttgcctataatctagaatggaataatagccagtgctatataatctaggcatattcaacaagtaactgggacatatattgccattgacaaacacagttcccttcctttctccaaccatatattttttaaaaagtctcctagctcttaaaggtgactgatgatgtggtgaggtgatcacctgtttatggccctagacttcagtgaactgaacagagttaaaggctttcctagttttattgctgacttgattgttattcctggaatcaactggatgttcttttcttgaaatactatgaacagtttgagctctgacaaagctgaaatgaggtattaaatgaccatgagaaaaatcttctgtatttattagcttatgagtcattcatagggattcataactttcatcataacatggtttgccaccatgttgactgtagtactgagagaggcttttgtaaagttgttaaaattattgctataattggccgggcgcggtggctcacgcctgtaatcccagcactttgggaggctgaggcgggtggatcacgaggtcaggagatcgagaccatcctggctaacacggtgaaaccccgtctgtacgaaaaatacagaaaaattagcctggcatagtggcacgcacctgtaatcccagctactcgggaggctgaggcaggagaatggcatgaacccaggaggtggagcttgcagtgagctgagatcatgccactgcacgctagcctgggcaacagagcaagactccgtttcctaataataataataataataataataataataataatatatatataaatattattgcgatttatcattctaaaccaattcactacatggatattaatgaagagagtagttttggacaaaatgagacgctactttttagtttccctatagtttgattatgagctaaaggacacataaacttactttttaaaattccatcaccttttcatccaccctaaatatgaacctaaccttgttttagtttctgctgacatctaaaacagtatgctgcagctgtgcctttttatttcaagcaggtaataaagttattgcagcaatgttttcaaatcaaggtgaataaaacgccatggtaatgcataggatataaaattcagtatgcaaaatttgcagtttcattgctgaaatgattcttcttatttcagcactttaggcagcaggaaagagccatgtcatagacattaaatactgtaattctacagatcttgcacttcaaaaactgaatacatatcacatggggacttgagagacaaaatcattgttgaatatgaagagcagcatatttagcatcagaattttctcctaccctgaattaaatttttgttcaagggacacacacacacacacacacacaagtattagtacaattatatacaatttcttattgatcttgtgtattcgaattagttttaaaatatataaatcggtgtgttttcttcacatggaaaatacttaaaacattttaattgatgtgatttgtagaaaagacaaaaaaaattaatgctagaattgtagctgtgccttttttttttttttttttttttttcacaagctggataaatcatttgattccacttggtcactaagcagttgcttagaatgtgttcttttgttccagtcaactaactcttttaattaaagagtaacaatttgtaggtgctatgtatcagtgtcagggcatttggcttgctacatcgttcagagtgtgagatgttacatcttactttttaagggcttaatgttaacacctgaaaattaaataagtaaataaataaagtttgggtattgtgttctccaagtgtcgattcttacattgaagtgtacattttaaaatgtggactaggtagaatttacgtagttttttccttccttccttccctccttccctccttccccctctccctttctcccttcttctcttcctcccttcctcccttcctccctctcctcccctccccgcttcctccatgccctcccctcccctccccttcccttcccttccctttttctgatatagggtctcattctgttgcccacactggagtgcagtagcgtgatcctggttcactacagcttcaactttcccaggctcaggtgatcttcccatctcagcctcccgagtagctgggaccacagctgccaccacacctggctaatttctgtattttttgtggagatggggtttcaccatgttgcgcaggctggtctcaaactcctgggctcgagcgatttgccttcctcagcctcctaaaatgctaggattacaggcatgagccactgctcccagctgataagtttttcttacggtggcatgggtaactttttttctttggggcattgttaaggcagtcattcattctataataatagtattgaactttgtcaggcgctaaaagaaacactgggaatgtaatgatgagaatgttttgtgggcacctaacaaattgtattgaaaaacaaggataaaagaaaaagctaagtcactcatggtcctggagttccctggtcactgctattaactttttggtatgttttcttttgcttttggtggttgctgattttgttttttcaggggtatgctttttacttttgaaagtgaaaactaataatctttataacttgtgttctgttgagaagttacaccatgatttacctcccattttcccatcactgattattttgatcaagtttttactttacttttaagcaaagactgaaagtatctccttatgataaatttcccaaagtgttattactttacacatatctatttcttgatacataaattattttccaaaaatactgttatcagttcacttgcctgtgagcaattcgtgtagtcacatgcccatttccctgtgtttccctggccacagtcaagccagtgtgaataaatgatcactgccacagccacagagcttgcactctcctcctcaaaattctgctccattgcccttttgaaaaatggaaatataagtgatatagttttaggtagggatacgtggtaaatttattattttcagcattgttaaaattattttctacattgttgagctgttctagaggaacctattattgttttggactagagattttttttttcgcttcagatttattaagttatgattaacaaataaaattgaatatatttaagttgtacaatgtggtcttttggtatatgtatacaatttgaaataattatcaagctaattaccatatatttatcatctcaccatttatttgtggtgagaatatttaatatctactctcatagaaatgttgaaatatataataaattattattaattatacttacctatattatagttatagtagacctccaaaacttattcatctgaacaaattctgtacactttgaacatctctccatttccctacaaactccccgccctgcccctgccctgccccggtgctcctggtaaccaccattctactctctgcttctatgagttcaagctttttagatttcacatataagtgagatcacgcagtatttgtctttctgtgcctggcttttgaataattgcccccagtagggagccactgggagagaatgaagaaactctgtttagctgaatataattaacagtaataaaaatatagtataaacaaacatatataatatcccattaaatagatactttattatttgtaattcttttttccccttttatctaaagttttctacctacttaccactgtgaaatcatgtgtgcttatttcatggttctcagaagttactcgtgtgtgaaatattgtaagcataggcatgggggcacagtacacactctttctttagttcatcatagctatatgcagacaccaatcgaattttcatagagatggtagtagatagtggtagctccttctgattgatacctacataggtactggcataggggcctcaggtcccaacatccaaactttgtgatgtcttagcattaactttatttgaccagtacaagcttatgagccacctgagtaatatgatttgaaaaaggtctccaggccaggcctggtggctcacaactgtaatcccagcactttgggaggctgaggtgggcagatcacctgcggtctggagtttcagaccagcctggccaacatggtaaaaccccatctctactaaaaatacaaaaattagctgggcgtggtggcaagtatctgtaatcccagctacttgggaggcagaggcaggagaattgcttgaccctgggaggccaaggttgtggtgagccaagatcacaccactgcactccagcctggataacagagcgagactctgtcaaaaaaaaaaaaaaaaaaaaaaaaaaaaggtatctatcacttgaattgatgggtttaagaatagattttaacataataaaacaaatttaactcaattctatcagtgtacaaagtaaataaaacttaatagtaatttagattaaaaaatttatagaatttgctgactgcattgtgagctaaaatatgagctaaatttatgatgagttgtttggcttcccaaggaacttgtgagaactgaaaatttgaagtatcagaaaaataacagtgtgaaatcatgaaagaattctcataaatatatctgggttgcagtttttaaactggcagtgtaggagaaaccttattaaatctaaaattttcaaatgtatacttcttattttaacatctaaggaaaagttaaattgtgttgttatacatatgatattaaatgtccaaataaattgcttctaaatatgaataacctgctttctgtttgttatgggagcaaaggtcatctttctattcatcagtaatattaagtttcttgaaatgctcaagaatttattaaattatgttaccaacttgttgacataatttaaaatcatttaaaattattgtaggggtagctgataaatgcctgaattagatggtccaatgatgtctttcttcttcctcttagcctccctcatgtccatttacttgcacttctagtaggtgatggggaagaaaattaaacaatgagaaacactgtgaatttgttgtctaacaggaaccagaactggataaaaattttagtgagggaaattataaagaaacagagtaaaactgacttcaaagtgattctttcatttaagtaaagaaatggtaacaaataaaaaaaattccatctgcagggcaaacattctagtgttgaatgtgttaatagagcagtggactcctgtaaaacatgattttcatcatctctgtttttcccttttacaaaaaatagtaaaaagaaaaatatgggccaggtgtggtggctcacacctgtaatcccagcattttgggaggccgaggtgggaggatcacaaggtcaggagtttgagaccagcctggccaatatagcgaaaccccgtctctactaaaaaatacaaaaattagccgggtgtggtggcatgcacctgtagtcccggctatttgggaggctgaggcaggagagtagcttgaacccgggaggcagaggttgcagtgagccgagactgctccattgcactccagcctgggtaacagatgagactctgtctcaaaaaaaaaaaaaaaaaaaaaaagaaaaagagtaaaatatgatatatatataaattattaactcttaaataatctgctactctggacccagctcagaaacttttgtaggtgaagtgttttctgctcacaagcttcctaccaactggagaaaaagtggagttgaaatatctggcaggaggaaggatgagatcatagtccatgtctgtggtaggctgaaaaatgccccccaaatagattctaatccttggaacctgtaatgttccttatatggaaaaatgatgtttgcaggtgtgattaagttaaggatgttgaaatggtgagaagatgctggattatacatatggggcctaactgcaatcacaagcatccatatccatatggaaggcagagggagatttgactacagacaggagaggagaaggcattgtgaacaaatgaaaggaatttggagggacaggaataccagcaccaccagaagttagaagactcaatcaactgattttctcctagagcctttataggaagtacggccttctgacagcttgattttgaccgagtggtactgatttcagatttctggcttccaggacttggagagaatctctgttgttttaagccaccaagtctgtagtaatttgttgcagcagccataggagaataatgtaatatcattgcctccttctgtagtggtaggactaatcttacgatactttatgtcaaggccccattgacaaataaaacccttaggaaggaggtaggattgagaggtatttaatttatctaattgggaaattaaatgtagaagtattttttgccttgacatttactttgttgctgacttttcctggatttatggcttctattttttattctgcattttattagttaactgaattttgctaagtgacacatgtgtttgtaaaataacattataataggaataactgaatgggagtattttttcataatgatttgcttgatttcaagacacttttaaaaattatttgaaataaaaataaaacaatttgaatatataattcgggttttataataggttcagttctagaataatgaatgtaagtcattaattggaagttaattggtaacatcggcaaagtttatcttatattttggggattgcatgcttcatttgatacctcctgtacaactgggatttattcgcacctcacttctgggtctggttgtgtattgttatgaagaatattaatattgctgcagaacgattacttgttcatttgtgaactgattaaaattcatgcataatttattgaaatgaatagaaattttataaataagccccattgttatcaagggcctgaaaacaaaatacatatgctaatataaagctactttttacctccaacataaaaatttaatatgtagtggtatattagcctcattaatgctagattttacatcttaaaatcatgctgttaatcaatacatatgcttttaagcctctcttaacattgccacatttccaaatttgagcaattgctttgatgctggactgcccccatttttggcctgaccatggaaagtgagatgtaaaactggccagagtgaactactacccttctgaccaagtcttgactgattacatcaaacttatttcttcatatacaaacaacactagtgttgaatattaattttcagtgttaaaatgtatatgctatatggcaaaacagaacaaagcaacctagcatcacacagggcttgttggtgtatgtaggagttgagtcttcaaaaattcttcaaataatgcctagtgcacgaatgaataaattataatgtgaaaaagttaaataacatatttaagattacacagctattaatgtgtaagcatttttttcatattaggtttccagactacaaatttttgttttcttttatatatcacttccttaaagatagaaatgttggaattaatgttgtgctttactgtttcacttatttctcttctttctttcacttgtttcttatgttgcggtatggctattttttctttccttcctctctcatcttttgctctcctcttaggttttctccttattttccatagcaagagtgtgcagagttttgattggtgagatttaccatttgatatactcacataagttcaggtttcagaatatctataaatttatgattaaccaaggtttgttatatataattcacttggcatattgtgactgtttattctatccctacactggggtagcaccccagcgagatgtgaatttagcattctttccaacttaaattagttagtatatgagccatctggaatgaaaacaaatattgcacatatgaggcaactcagtttattcacaaaatacagactgcttcttaaaatatgtgcagcatttaggtaatctcggaagacatttacattttttctattatgttcacttctcgattcagtttcattttagtttagggtttgagaatatatcaactttctccctctctacaaaaactttttaaaactctgagtacaaaagttgttagagcagttggtaaaatttcatggtatgaaatgtctagctctgtctttcatagttgataagtgaaaattctaaactgtgtttattttattcaaacttttttcttttgtgaataacttctccgttgaattcagtcgtgaaattggaaagagttcacttactatgcaattttgactacatattgttgaaacaatttgcaaactatcaggaatggatgttgtagttaaagtttgtaaatcatatgttaaccacttttctatagaaattataaatgtttgcacttcatatagcatatgttatcatctttgatcttagttttgtttttgttttaaacatgagcccagtgaatcccaaggtcatgtggttctacaaataattagtttaaaagttactgccataatgagccatgaatacttgtgaggagttacttatgtccttcaagtgattttggacaaaaaatattgatattacattcattatttatcagtcttctttttgtttcctatataaatttcagtttaaaataatgaattcattgatttctttttactatgtctcccctacaatgttatatggatacccaatgtgtaggacagcctaacaattaatagctactcaattaatatttatcatatgaattttgaaagaatcttcttgaaaattactttagcctgtgtagctgtacagaccagataatcttattcctaattttaaggttatttgtaattcagaggcttttaagctagaaactatacttttatacaatcagggttaaaaagaaaatcctggtctgcacctgaacattcttgtttcatttaaacctgcataagaaggtaaaacctgtctacaggccttatttgcattgtatatttttcatgcaatgcattgccattgaaacaaaaaatccaactagaaagatattgattatgtgctcatgacttccctctatttgtaccttcttcagtccaccccgtacctgtagtgggttggactgagggagcattttgtggttgtgttttaatagtttatgtgatttgctccaactcttaaaaaaagttttaaattaatttttgagcaattactactttattaacactttctttaggtcttttgactttcctgagaaaagtgagaagtgttccaggaattcaaagaactttatgagttattatcccttgtggaaagaccatatgaacagagctatagctgttgagtccttcataaagttcggtgtctcatttcagtcacattgttctaatgaaagaaaaaaaaagtgccttaatatatcattcaacttttctgtaagtacaaatgttgaaataatgttttccaaagtttctttcaagcagaatatcttaagatatccaaaattaaattatagtgtgcctttgatatttgagtttaatagttggtgaattgccttatcttatgctgctcccaaagaccagtgatgtttagtgatttgtgattgtgcctaggtgtaaatttaaatttgtcacactgtgaggcagatttgtagaaacaagttagcacctggcatcactttctgagttcggttatgttattctttcttcctttactcatctgtagaaactgtgaagaagtaacaaggaaagcaaaaagaaaaatacctcttgggcatagtttgtgaatgaaataaattgtcaaagatcaactctactctcttagtagctaattagagctatccatatctaaatattttctttttatttcctttgtatactgtgactttacaagttgatctcctgaaaaaaaatgtgtttttaatacaggaaaattatgttaaaatagtcatatgcacttgcaaaattatatgttctttaaaagtacagttgtcagatcatgcgtcttctagttttctttcaagtatttattatgcatttctaataaatgatccattaagcatttaggccttattagacactaatatatctttgtattattttaaatcttactaattgaagtgcacactcatctctcctagaaccgccaagacccattgctcctcctcagcttcttggtgttgggcctacatatttgctgatccaactaaatgccaactcgatcattggcgatggtcctatcatcctgaaagaagtagagtaccgaatgacatcaggatcctggacagaaacccatgcagtcaatgctccaacttacaaattatggcatttagatccagataccgaatatgagatccgagttctacttacaagacctggtgaaggtggaacggggctcccaggacctccactaatcaccagaacaaaatgtgcaggtaagactgagtagcagaccttttctaccttgtgaaggaatctagcataagacacattaatacatgcagtgttgaaggttctcattatttgatatatgatatagtcacactattaagagttccaatgaattacataaatcatcaccttgattatgtcataatttgactgatttgaggacatgggagtgcttctctattctcaagccattattattatgaatctagagtccttttttggcatggtagttttggtgagcctgctacatattcagtccaaaaatctctgatagctgtaattgaaagcattattgagagaaaagatcattttagttcaagcaaataccgaatacttttttactacgtggaaattctctccctcagtaattttgttacagtcagtgtaaaggccacatcttataatatggataagaaaagttactctggacaatgcctcgttgagataactattttcttcagaatgtcctgttgttgaggattacctcaggagcttgacacccagctgcagaacacagagagattttccttacactttaagcctttctgttgccttcctcatgactaaaactgagtagtgaaaataatagtgtatggagaaaacacaaaaaaaatgaaaattaaaaaattgtatataaccacacatcctggttctttaccatgttataatgggaggaattgttagctattaattaaaagccaataaaaagtttaaatatctaatttacttgactacatttttagtgtagtgtttattttgtcttttgtttcttgagcatctgtttatcattgacagtattgttgggctacccaccaggagtactgagctaccatccaagcaaaacccattcagttacctgatgtatcgtagaacatattttttagtccagcatcatatttatatatcaaaaactcctgctgaaagatgtttactaataggaaatttaacttctcaactattagcctgagacttagatgatagagagtccaataatttgctgattgctgtatatatttatctggttgttgaaaaggagcttaagctagaagatgttgggtaaatttccatggctcagcctaaatctcacaatttgcttttcaaatattctgtatgtctatgtcctttcaatcgaggtcatgtgacaaattgtttctgtgatagaagataaactttctgagggagaggcaagttgaccccataatctcaactagtcagagaaatcatttaaagaggaagcaatttggaaactaaaaattagttcactctctattccaaaattaatatcccatgctaatgtgaaaaattgaactatggagtccattttactaagaatactgcatacatgttttctaataaaattacacttttctacatatacatacatttataatgtacatataaattttaacaattttgacaatttggtattccagtgatttccctcttgacttcctgtgcccaaactactttcttttaaatatctcacctgctttatttttttattttcgtcaaaataggtctttaaaaaattagcattaccacacagtgtattgttaatataatgtaatttttgtttaacttaggaattatttgaaattggttccagatgtgaaagccatggagattgcatgtaaataatattgtgttttgaagccagttatactgtgttaagtggataaaaacatgttactgaatattgatttatccccatacttatgttctgagtggactttggactgtttaagtaaaaatattactataaagtgctttgaagtgttttattctgagaatagccctatctatgtgagagggaatgaggatagttaacttacactcatagctgcttttttgtcttgctctattgtccaggctagagtgcagtggcgtgatcttggctcactgcaacctctgcctcctgcgttcaagcaattctcctgtctcaacttcccgagtagctgggattacaggcatgcgctaccatgcccagctaatttttgtatttttgtagagatgggtttcaccatgttgcccaggctggtcttgaactcctgacctcaagtgatctgcccgcctcggcctaccaaagtgcttgaattacagctgtgagctaccgtgcctggcccatagctgctttctaacttataaatgtcttgatattttggaattatactgtctttttatctgattcttttttctgagaaacatttaatttgtgtattctttgtggcataaaatgctttcaggctcaatcacttgtagttttactcccaacagtattaagtttatttgtttttaaaactatctttcacatgtagtgaatttttatcacatgtttattatagctaattaatgtcctcataaggtatgtctgcaagatttttggggagggaagtacttatagactagattttcaggtagactgcaaatttgagagaaaccatggttactatttcatcaggaatgtctactaatcttgctctgttattagaaaataaagagaagcttatggaagtatatattgtattaatttttaaacagtctataaaaagaaatggaacataattgatatatagtataattaaatacagagtgttagttaggattatgatgtatgttcatccacttcccttctttaagatccatttacctttccccaaatttcaggtcccccagacttgaaattaccaataccactactggcctcagcccagaagttcatatcaacaaaatagaacacagtttatgttaactatgatattaactgaattttagtacagattgcaaaaacttataaatgcttcataatcttgggaaatacctttgagactccaaaaataacctttggaggaagttaccatctaattttgttaaattctgcatgcctaaatactggttctataagaggaactgaatactagatttataaaccattcttttttaattaggactgggactattccatgttacagttgtagaatttgccattaatataatctgattgaataaatgttgataattttaaagtagctattttaatagtccctgcatgttagactatgtggctgtaaaaataagtaccaatcaaaaagtaaattacttacaatttactgtttttaaaattccattttaaggtatttgaggcattgaccttttatttctgataatagtaaatgtttatttgatggaaatctgtcaataaataattttccagcaagtcaatacaaaggttttccttatttataataaaaaataaattttacattttcaaatgtaaatgtaggtttttttgtggccaagtatggattaatgctagtgtagaatcaacatatgaagtgaatgtatcatgatattttattttcacaccaatcctgtgaaatatattattttctcactttttagttggtaaatttaagactcaggaaacaaaaacaaaacagtaacttgtccaatatcagacagatgggcctcaactccttttctcagacttttaacggccttaatacttattcctcttattcctatcataggtgatttttctccctcttataatagtatagcatgagtaaataaaagcacaacaagtaaagtctggaagagatgtacattttaaaaaatagagtctgcatggctaacttattctctgagaaaatataggttaatatttgcaacttcacatttattgaaagcccaattgattagtgcttaactctccaatatatgctgtgttttaaatactttaaacagttaaagtgtaaaagtactttatccttttctgaaaatatcctgtctggttgccaaagctttttgtttgtttgttttccttccaaagtgcattataatcatttggtaactgcaattagttgcttcagggtctctgacttaggagaggtggtaattacagcctccagtggctgaagccactgaagcctacctcatgcttctctaggaacctgaggggtatgattatttcgctgttactttatactctgacccatgctattgttcacataatgtttcttcaggcacttcataaatttttaatttgtcttaaaagggaagtaattcagaaactccagtgaacaatcagagaaagtatgcttgctttttttttttctgtgtgtctatttcctctgggtataccatctggtatagaagctaggcaaatacagtttctctttctcttattaaatggaaataaaatatgccatcatcagaaattgtctgtgttgcatgctttggcaattgcatgttaaaattgctcttttaaattgccttctgcttctgggtaacccattgtggaactgctttatgattaactgacattttagcagcatctctctcatagggaaggtcaatagttcagagtgtccagaacataatacatttatgcagttgggaaaactactctctactcttatattgaagttcaatgctcttggcaattttcagtgaaacagttagatctatgaagcagtgaaaaggagagtgtcttattttaaaagtaagcatttactaaaaatgcattttttttcttgtcccaaatccaaaatggaaggaaaaacaaaacaaaataatactcaggcatataccagaaaccacaaagtgagaagttaaattttagcctttagtctatagcatcatcagcaaaatggtaccatatattgatttttgctatggtttaagatagttatcaatcacaaagactagtaaccgctaacactcagcctagaggttgaaacaaaataaacaactcttctaagagttggttcggtttcacaatgtaaggatgacttactatttgatttaaattgttggcttatatcaatgcttgctttaaatttttttgaaatgtatgagcttcttatatatgatctttatatggctttgtattgtttttgagcaagaaatttaaaaggcaatgctattattattattgaaataaaaaacaaactaaaggtaaaaagccacaggaaaagtaatggaagcagttcttcaattttcttgggaatgtaagaataaaatttcattttagatttcctttttgtgagtaataacctaatttttggtttttagattctgtagagaatacttctgtttgaaaaatatttattcagaaaaaaacttctgttggcttctttctttgttaacagtaccgtgttaattaataggtcttcaaagttatacaaccaatgcctcacacttaagctcctagaagtcactagggaccagacctataaacagaataaatgcaaagtgaaatgaataaaatgagagcaaactgcatgtttttacctcctcgtaaacattaatgatatttttgggtttctgaaaatagatgggttcaggtggatcactggctaactctaggcttgtggtagaactgaggctggcaggtgagctgcagctaagtctaacatgatctacctctaatggataatgtataggtagtcaacacctatacattctgctaattttcaggtagactgcaaatttgagagaaaccatggttactatttcatcaggaatgtctactaatcttgctctgttattagaaaagaaagagaatatattatggataataacataatctaacatgattacctagttgtttgtatgatacagactgacattactagatttgtttgtaaaaggatcatcccatctctggaagctaaggaaggactagaagcagagagatcatgaaaacatgcatatagatagatagatagatagatagatagatagatagatagatagatgtcttctctacagcatctttctcatttcaaatcagaaacaggaaatccataaattcctggaaaatattatcattcataataatcaggaaggttacttttataaggggattttaaagatatgttataagtgaataactttattgtttgaattacttttcttattcaaatatgtgaattgtccaatattaatacacatgaaaaaaatggtataatacattatattagaggggaaaatcatgagagattggagataaattcaagagctactgtgtatttgatgagatgtttaattatttcacaaattttagtgagggcccaagttgtacacatcgccacacgcaggactgcagaagataaaacattgagaagacaacattcctgctcttaaggaattgacaggctagtgttataaccataataaaaatataataaatgatacaataaaaatataacatacttcagtaatccaaagaagagagggataatatctgaccaaaaataatttttcccaaacactattaatttttctaaacagagttggtttaatgcttccgttgaacaaagccatggccttatccataattccttacttgtgaaataatgcataaaacaatgtctagccagtagtcaccataaggatggtttgccttccctctttcctttctactcagatataggaaatctatatggacagatggaggtattaaaatgaaagatatagttcatattctaatatatatcatcaaagttgtttgtgtttttttaaacctctggggttcatgggaatatagaaatgttattctaaatttctatggaaatggagagacagagacagactgacttataaggtaatcaacacctatacattctgctaatggtctattatgctaggagttcccagcataagagtcatgaaagttgaacaaatatgaaatagccttgcccagtaccttttgggtttcacctcaggagcaggttgtacagttagtcatacatcccaattcaaggcacatttccttataggtggtatcatcagtagcagtgtaattaactttactaatagagttgggttgttttcaccttaaaattgtgtcatctgactgactagttggtgaaagacatttggtaaccagtgttaatgacactgtatttatttattcatagtactttaccacatgctgagtctgttaactgtatcattaagtactctttttattggctttgtttgtttttattgaattttgcataactacaataaatcttcaggtagaaatgatttgaataacagcatcagtctcatgaaatgttctttcccctcaagtcctaggttttttatttgatatcaggaagtagaaatggctttaaaagtaaaatggtatatttataatgtcttaaatgatgataacaccaggagtatatgatgaagaaaatgacctagatagaattttaaagatatagatctaggcatcaaactctaagggatgtgttagtcacaaagacaggttcaagagatctagcctgtgagtttgagacttttctttgatggtgctattggggtcactatgaggtatagacttgctcttgattttctttctctttacctagagaatttacttctgtcttcaattctcacaccctattcatatcttttgttgaattgtgatttcctttctttgttttgaaatatgaaagaaatctctaaatcaggttctgacagatgggtatggataaccatacccatcctaggtattattagcattttgggggagtgttggtcattctgtgcaatttcttgattgaaaaaaatgatatatggatgaatctcattattttcatcatttaatttgactcattactacatggaatcatcagcttaggatctcactttctggtcttcattgtcttcctgcaagatatggccttatcatggctaataattgctggaggataactcttcaatcttctttcctctccaccaacctgaatgtaaactgcagaggggaaaaaaagcatgttcaaaggaaaaagcaaatgagtgaattctaatcccaagtcttcttatttatagtaaactttgtgaactcagtaaaaaatgaacttcaaagggcagaaattcatgccttttatgtcaccctaagcaagatctgtgcaaattcagctgtcactacatatgatatggcctagaaatcattgagtgatgttcattttaattgtctcagccaaatcatctcagtgaagttgagtttaaagaactcatctttcattctttggctatgttattatttcccacttctacatagtccctcaccacaacaaaataataataagcaatcataaaacagtttattattacctgttaattaaattattttaagcagttgctatattctgtcctgttattcaacctacccaaaatttactaaaaaccatatttttgttacatatgaacctataataccttttgctaatacaaggaatatacacacacatatgcatatatatatgtacacactctccttttaagaggaattaattttaaaaatttagataccaccttaaaaattatattagtgaagaatattaaagcagagtcattgttccagagtcctctttcctgcttctccatctctctcctccagctaattttgcatttcatgcatgtgtgtgcattgtgcatgtttggatgttgtgcttttatttggggtggggggcagatactgatttagagttttctttctacaacagccaaatcctttctgtttaggtggataaaatgtgacatgggtgaactagctatccttaagcttgatttctttggagggcccttgctggaagtcccatattctgtaaagactgcatagagcttacgtacccaaattatttttttaaattatgtatatattaaaataatacatcaaatgttgcaactagaatttagaaaaaaactcattattttagaatgtttacaaaactattgtcatttttgtcaatgcactattatttttctctgttcctgggagtattttagttgtaaagtacaaagtatatacagttctatattccgcttattgtaattgccatcatgccaacccatttcctttgtttctacagaacattatcaccatcactttaaatgactgcttaatattctgttggatatatatatatatctgaatgtatgtaaccattcttatgttactgaaagtttggactaactcccgctattggccattgtaaaagccgcggtgaagatcatgaatgtaccttttttccacataactgaaaagttcttgacaaatactattcaactactttttgaaagtattatatcaatgcgctttactgacaccatcaaggccaatcatatggttttagtgcaagtaagtgctttataattaatcaagtccaactcctttattaatcatcattctgggcatttagtctcaatagggaagtgatttgatcaatatcaaacagctattgtaggagaaaaaccaagactatcatttgtattgcatttttaagcttttcttttacatgagtatctcctgtattctagactctgtctaaattactggatattctaagataaaaactctgttctctagctactcaaagtctagagaattatgattacagtagctcacaagtactgagtaattgctgtgtgtcaggcactagtgtaaactcataaatgcaaactgaggctgcctgaatgcatttctgtgttgagctgcccagaatggttagaaggtagacatgcaggttaataattaaaccaataagctgtataatagatgtgcacaaaacatctctaaaatatgagtataatttcatcaagcagtcaatcagtaaaataggtggttatcttaaggtttgagagccagtaaagtctaggttcaaatcttgctgtaatccttactgatgtgcaagtaatttaatgtaatgtttcacttcttcatctataaaataaaaatcaataactgaacctgcccaatttgatacttttgagctatttgggcatgtactaaagctaacaatcaatttattaaatttgcaggaattttgccagctggttgtgaaatgattattttgaaataaatttatatatatttacaagtatattttaaacaaaggaacatgcacttaaacctcctagttattttaatatattataccattatttctattcttgaggttatttatgtttattttatctgtatgttggaaacactatataatgatcctctgatgctcacttattcctaatttttacgctagtggcaacgttagagcactgaaattttaagtgctacaaatgagggtttcttttccctccccactccttcttctttctggatagccacaaacatgtttacaatattaaacatttttccttcacatcaatggagatgactcctgcagagtgcttacttagcacaatgtatgagacataagaagaccatagtaaatattagccattgctacattaaaagtcatttcattaaagatatttttcctctaatattttaaaaactacaaacatgcagaaatctgaaggaattatacagtgaacactcatatgtccaccactataatttacctttgctgtatttgctatactaaatgttgatctacctttacatctttttattcatccatcagttcatcttaattcttaattaatacattaaaatattttatgtaagggaatacattttttaaagaatgaattatttgaatttttattagaatgcttagaataatttgtgttttctaaagatttctctaatgatagtttaagaaaaggactgaaaggagatttcagaaagattagaaggctgctacttcagtctaagcaaaaattgatcagtacttgaaccgaagcagaggagataagaattccaatgaggagacaggtgttgaaagagatttgataggtagaatcagtagaacttggtgacacattggaagtgaattctggcttggaacattaaggtatagggacaggttttaacttgaagggctcaaacattggggaaagttttagaaggcaaatctctgtgcttatttttagaaatgaggcattgggtcaggcagttattttcctgggtttatggttcatagagagggcagacagcaggatatacagatttaagtgtcatcaccatttaattcctcttgcgagattcatgagtatactataatttccttgaattggaaattgaagtaagtttctttcaaccacatttttagaaattatgctcttgtaggaaaaatttcactgtatatgttagtatcttattgcatgaactattctgattactcaagcctccctgctcaagggcagaaactggtaattattttacatagagataacttaaaaatatgtagcagattgttttgtgttcacaagtatttaaatttgttcaatatgtgatttatgaactgtgatcagtttgttgaattgtgatttctgtagctgcattttaattgttccccagaatgggtagctcagagcattatgctaagggcagaatcaaatgtagtttactgttggtttttatcatccaatcccaggcatacttgcaagtaagctaatgtgtgttgagcatatttctatattcgtccctttattgctctcttacttctcattgtccctcaccctagtggttcctggtgctcatatgctgtatatgcacccttcagatgcctccacaggatgacaggagaaggacctgagcatatggccccatgattagcagtgctggtgtgcccattctttggaatatattgatatacctatagttcgtgtgtgtgagagaatatatatgtatatatgctagatatagaatatatgtcatatacacacgtatgtacacacatatgtacatgttacacacttatatgtacgtgtgtatatgtatgtgcatatcatatacatacatatatatctagtatatatacattgatatgcatatatctatagtgggtgtgtatatatatacacattatatatatacacacacactatatatatatatctacatatcagtattactttgatatcttactacaacatccaattagaacaacttatttttaaaattttttatcaagttctacacttgagtgctttggtaatgagcgaaaataattaccctgattttttaaacccttgagtcagaagcctctgtaggacaaacttaaatatttagactttccaaggattttcagtagcacaggggagataaagcacctatctctctttcagtgaagagaagaaaataaatgtttctaccctttcagattttactggaatgttattataaactaaaaagtaggtcagcaagactgagttgttttattaagaacagcagtacaaatatcatctgaagaagatgactgtacaattgcctattattaaaacaaaggtagggaaaattgttagtgattcattccctaagctgttccagtccttaagtatgatgctaattatcctgggtattaatttgatttctacttttttagctgatctcctttatctcagtgataacatttttataattataattttgtaaataaccagtaagcccatttttaaagctctgcttagtcaaatcagttattagttgtgtagtgaaaagattttcaaaacattctccagagttggttgatcaatcccttattttttaagaagacgagttagaagtgcctcaattatgaaattggctctaagagagtcaaatttggaaatctaagcttttagaaacatatttttgactgaaacatgtatacatatacttgtaataataaagttaaaatggggtaaatgttacctttatcttaaatttaacatcaagaattgatctaatgaagaaattcatccagaatttaaaatattcttctataaaacaatagggcatacttacagccctttaatatacaaatcatcagaagtctctaaataatagagaaatcaatgtctacttcatgcagcacaacagcaaaacagagctgctcccttattacaaacagtacataatagtttaattttcatgggactagtaacgcatttgttatatcgtggtttttagtgaggaatattgtatatgtcttcagttaaaaatatattctcagcttggacaggtggtacttaaagagtctggagtgagaaatggtttggcaggataacaaggcatattacaagtgcctgccttgaaaggtaagaaagagagttagacattttccattactacctactgttaaggtgctcgcattatcccctaaacaacctcatgcttgtggcaataatcatgcactgtcggttttttgtactaatatgaaagtgcggttcaatctttttgacaaatactgcatcatttctggcttggtgaatttttgtcactcaaacctagttgatgtgtaagtaggttgtgacatgctggctgaaatgactttggatccactgtattgaagaaagtaaaattttacttgaagtgtttcttctttccatttctcactcttctctctactccacctagacctcactccttccctgagtttagattcatcctacttcctttgtaaggtacatcattatacattatatgggagaattatcttatagtgaaactgaaggaagcttttcatggaaatgtgtaattcgtttattattttctaaactgtgtatttgcacgtgtatccatatgcatcactgcacaatctaagtgttaacagtttttttttttttgctttcttactagggcttatgtctaaaaatgctagtttgcaatatctataacactagcattttaaagtcattcataatctgtcaattgatatgaaatataaacattctgcctttttactttcattattttagtgataaattttgtactgcttaaatgttctctgcaagtctgtgtggtttggaaggaattgtcgttttaatttcttcttctttagtgacaacatgtgcatctattatggaaaaaaatgaaaggtaacaacagttgttaatttaagagatgaccatgaattctcagtgctagctcccaaggtggcactcctaagaaagaggtcatttctcaagtaaataatatgccaggtaagatctgtttgcattttaaataaagtgattgatttaggaaatattacctttagaaagtgcaagttcaaatgaatagttttctttaaccccccaaataagattataaaggaattacccatgtcatgagttttttgttgttcttgttgttttaatcattgtctcctagtaaagtaggctttgctgagtaaaaacatagaaatagacttatctattgatggataagtataatggataggtataaattaagcgtagatgtagagacaaagatgtagctatcttccctgtcacttatttgtggcctgcaggggagttttaactcatccccaacactcgggctcccacaggcagtattcaggatctgccttggtctgttttgtggtgtttgtttcatgaagtttcttattaggctttgtgttattcaaaattaaaattttacatacgatagtccaactaataatttaggaaatcatattgccattattaaaacttgctcacagtctaatttaaataaaatctgagtaaaaacaaaaggaagatgcctactataatttgaagatattcattcactaacgtttcaacatttattttgtcaccattaatttattttgtttttcaaataaaaagtaaactgtattatcccatatagttctggaaagtgcctggtgtttatcataaaattatatatattatttgtctccattgtaatagtggccttaaaataatacacacacacacacacacacacacacacacacacacattaaaaaaataacatatttaagtgggaattggaaagaaatgcttaacaataacaagatggttttataaattatgttatgtctatgtattaagcattttttagccattaaagttatttgtgtaacgtcttaatccaataatgaacataatacaatgttaaatgagagaatcaaggtatgatgaaataacaataaaaaataccctatgtgatacttgtggagatcaggaaataattgtatgggtaattttctcatctattaactttatttcaagtcatttcattggtaaaaataaatacttttaaaagagaaaatttaccagaaagaaaataaagagattgatctatagcaataagcatgaatttaactaacacatggcttacttaagcttctttgttttttttcttttaaaaataggtttttctaacttaggcttgggtctgtttattttttattgtatatgttaaaatatacaatgtgttttgacatacatgtagatgctgaaataattactatagttaaacaaatttacatatagctcaccttccatagttatccttttgtagggtgtcagagcacctgaaatctactctttttgcagtgctttcagtttacaataggatattattaactatagtcttcatgctgtacatttttgtctgtctacttaatgttcctaacctgactgcaaatgtatagcctgtaaccgattctccagatattctccccctccctgctctctgtttctcatttgacttcaagaaaaaaagattccacatttaagtgaggtcacagtattttctgcctgtgtctggcttatttcacttagcatagtgtcctccaggtttacccacgatgtcacaaatgtcaggattgccttttttagggaagaattatgtagatatatgtcacaatttctttatccatttatccactgatgggcatttagcttgttttcatatcttggctattgtgaataatgctgtagtgcagcggtccccaaccttattggcaccagggaccagtttcatggaagacagtatttccatggactgaggaggtggcaggggatggtttcagggtgcaacgctgctacctcagatcatcaggcattagttagattctcataaggagcacacaacctatttaaaacattatgcacagttcacaatagggtttacgctcccatgagaatctaatgccgccacttatatggcaggaggtggtgctcgggtggtgattctcccttgccttccgctcacctcctgctgtgcaacccagtttctaacaggctgtggaccagtaccagtgtgtcactaggggtttggggacctctgctgtagtgaacatgggagtacagatatctccacaaggtgccaattgctgagtcatatgatagttatccttttcattttttgtagcacctcaatgctgtttttataatggttgttcaactttcatttccacctgcaaaagagaacaagggttccttttctctaccacctcaccaacacttagggctgtttatattttgagcaaagtcctttttcactttcatttcaatcaaaatgcaagaaagaattaaattgagctgccgcttatttgggagatgtcacaagatttacttcctaagagtttgtgagaagaacacattttctggcatttgctgttgatccagaagcattttcattgcagtgactttgtttggagattttaacttctaagtactactcttattttgctctgcttttaggataatgttttaaataagatttttaaagtttctcaaaactgaaaacattttacctcagagtagaactcagttaaatttttatttaaaagtaggtttttggtaacagtaaatgttttgacaagtttttacttaatggttaataaaatgctactaggtcaggtgcaggaagtaaaattagtcctaaattgaatttgaggaaggcatgtaagtagaagtaatattaagaaggtgaatcatcagttgtatgatagaactgttactaataaatacaacatgtggtaattgcaagaattaagttcatgaaatgtctattcaactttacaatcttgccctactagagtatttagtcatagggaaccttactgtggttggactctgcctggcaatgcagtttaacttaaaattatctaggaattatttttataggaaattttgctaaaatccacctagttatatgaagtatattactcttgagtagcaaccaagtaactcaaactgtaatttaaccctgttaatggagggaagtaatatggaaatactaaaattgacattttacaaagttgatcccagtatatctcagatgaaaaaaactagaataatatataagaaaacaattttatacattccttttgttcaatttagaaataagtcattacagatatcttgcatggcaaatattaatgcaattaacttttttaacttctgagattatttttaatttaaacttgtatgtttaagatttattttgtttgtttagagtgcttgccagcaaacgctgtgttaatgtaatcttaactattaaaattggattttttttctggctgtgtacatatttctgtcattttgctttctcatcaaccagttaaaatatttttttttctgttcatgtgagtttttcatttatatttatgtataaggcacagcacaggctgtgtttcaagtaaaatattggactgattttgagggagttttttttgtttctatcatttttagtctttttgaggaagttgaatatttttccagaagtgctatactttattcctagtactttccagatgatattgataactccaggaacactaggaaacagaaaacgtaatatcaatgttaattttatagaatataaaatgttattcaactggcctttattttatttacatatttacatagggatatatgtgtaatttacatcattcctaatttcaagaataattctaagttatttactaaagcacaaaaagatttaacagaagaatactaagttgataagtaattttgggaaaaatagtgatactaaaggtaaaataaatgaacttgggggataatgagagtaaacaaaaatttatgtttatagagttttgttactagaggagagtcttatgttattagaagacaccatagatttgatgctaaatgtactagtaataaaagcaaaatctgtatcaattactacagtatttattatttataatatagcagctaatgcttaccagccactcataacattctaaaaactttgtccagcatttgatacgattatcttatttaattattgcaatgaccctgaggagtcctgatgttgttatattttacatttgcagaaacagaatctcaaagaagttaagtgcctttcctgagatcacacagctattagctggttgagctgggaagtctgagtccaaaatctatgctcttattcacagaataaacatttttaaggggataaaatattaataaatcagaaaagcataccttgtcttaattctaaagataagaaaaaaaaattttctgttgggattatgcttggttcaaggataaagtggagcctatctaggggaatgtccgtaatgcataaccttcaggcaatccttgtgaatatctctttgctctttgttgttaccaaattattttgtcttaaggctatgagaaaattgactttctaaaagctgtgtctccgatgaacagttaatactaaagccaaggggaagacgtactggtcagaattatagtaactttatccttacatatatctagaagaaatactcttgtaactgagagctaaatctagaaattcttctgtcatgcagaattttgataaatgtccaatgctatttttagttttaaatgttttttacgtatatgttttatttttgtatcatctttcacttaactattgaactacagttgttctgtgatataaactcttacaaacaatatagatttggctttagtttcattaatttttcataaatgcttgagtattcatagtaccttatgaatttatgataaatttattacagatttattcaggcagagacatatttgaaaatttgtaatgaggaaaaaaaatcatcttatgaacagctccataattttactttcctaattgtgtgtaccttttgggtctattttatatttatttaagtttatattggtatttatatattcatataaatacttattacatatttatataggaataatgcgaagccatggttaacttcataatccagggatgcaggcttaccaaaagactgagacctcatcataggatagaatgattttccttctcacaatataaaaagtaaagaaaaataaattaaccaaaacctctctcatgcaaaaagaaaacattattaacttttggtgaaattcagacatctcttcctgtgtgcatactgtatgtaaagaggaaaaaggggaagaattaatggttggataaaataaatgtacacaatatactttatatgtattacttcctaataaaaattatttcttttttatataacaaaattggaaactaaggtaaaactgaaataattactgttgattagggaaaactttcccatcacatgtgtttctgtcatttcttttgtttctcccttgatttaggttttttttaatgcggtaggccaaagtcttaggtgatttgatattagttttagcataatttgcacacatagaattcacagaagatataatttcatgcaaacatgtaaactttcaactgtaaaatttgtatgaaggactgttatgtttgctatgatatggggagaccatttagtcaatgaggtctttgtacttccattgtgataatttagatagcttttattttctgaaatgtgtttgaaaatgtggaaaatattttaatatttccctggtttttttggctttcatgctaatatatacatacattctaatgtatattatattccatataatgtatattttctgccatttttcaagtgttcttttcccctggcctttcttctaccctccaataatttattaaatgtttttaatctccccccccagcctgtaatttagttttgtgcattttaaagcagtattggttatatgcacttcagcaaaccagtttatgccagctaaagattgaaaaggagaaattaatttaagatttagttctgtgttttttaaaacctttttaaagatgaagatattgatcttgtattactagtattgaagcaaactcatattgtttagttccttatcataagttagaggcgttggagggttaaagttttaccaaagtaaatcataatagaactggacaatttaatagtgatgtcatatacaaaagctcaattaataatcctatacaaccagtaggtgaagattttattttattaataaagcatctgaaaatgagcctagggtcataacttttaagaactaggattatagggtcatgctttattcatgaatagtagacatgctttctctatagtgagctaagctatacttctgaacttgaatgattgtctcagtgttacctttatctcagattcatcattcatattccttttgaaatatctttatcttggtatagatatttatgtgtaaacacaatagttgctatgtaatagtttctgtttagccattaattggagatacgtaattagagttggtgctggggtatcttctagaagaaaatgagaaggagtgagggatttgggtgtgtcaaaggaagataatggagaggacttgaaagaattcttctaaaatgagaattcttactatgcatgtccatgaattgtatttaggccataggagaacttgtacaagaaaataaaatatgtcccacttcactactctctaatttagcatttcctttaattgcaaatagtccacaaactacaatagtgttagtagcaacaatgacttcatctccaacaaacattgcagatattcttatatcacattacagatgtttcagatagcttggaatatgatttattgttcactactttgaaattacaatatttattagacttccctctattaaatgcgttggtaaagtaatatagttatgtattatagtttctgttggaattctctgcattttattttaagcattttttaaccttattctcacaaacggactaagcttcagtagactgccaaagggatccatagcataaaaaatataaaaccctagctctaagaagtaagctaattcagctttttattaacctttattctattccaaatgtgataacatttctccattttatctgccaccatgcataaagttataagggaaattgcaaaatatttttctaccaagctacctattttatattcagattattttagtattaagttcatcttgtaacatgttttaggctttggaagattagccttaatgtttttatttgtcaatataaatttatattaaaatacatattattaatacttatttctaacatattatttattattttcagtgcactgtgctaaggattcacctccattattgcattcaattcagcaacctcatgagcttaggtttaatcatgcatttgtatttttatagaataaatctacccaagagaatggggaaaatgaaaaattgttaactaatttaagcccatcccagtccaaaaccagtcgaaacatctcaatgaagtaaaggtagaatgataactgcatttacaaatatttcttggtaggaaaaaagtattttattctaataaatagaaacatgttaagcataatgttattcatattaataatgaatattaaacattaacattaagtattatatataaaacattaacatattaaacataaataagtagaaagttaggtttcattttgatcttaataatttaagagtaacaactggcacagtgttcaaataagtagcacctagaattgtgctaatcacatagaaaaacagaaaacccgaaggcacaaaagcctatcagtgttgatgtccacattgctgttttccaagtatttgactaccgtctctgagcaagattctctacagatcttatcaatatttgtagcttcctgcaatttgttttactactcaaagtttacgattaatggacctctccctaatagatttaactaagtatgtctgctctttctttcattaattgagcacatgaagtatgtgactcattcttaagttgaaatactgccttcagcaaggatttgacaatcaattcaatcaattatttctaaatatatttggatttattgctttcatctcaggctctttctgtatatatgaaaagtgttaagacagttttaaggagtgcatgagctatacccacattctggctttcccaacacatgcagacatgggaaggcccaaaaagaggtcagtgtcctctcattttctctttcatgcacaaatgtataaacacacgcaaagacacagaggacaaaacaagataaaatggagtaaatttagattttaaaaaatgtaagattcagttcactggtagctgtattatatatcatacatttttagcaacacatgtaagatttatgtcttgaataatataaaaaaaggttcatctgcttgtaaaatgtaagtcttatagttcaacataatagataaacatcaaaactagtatcctcattaggttgtataatggtatattgccacttactgttatttaaatgtcatccccatttcctttttgtagtgctgatgttaaccttgtaagctctaaattgtctggaagttaatggtctgttatatgagtttcatagttcttagtgaaagaatattagattatattatgcagtttgaaatgtaacttgatctctacctcataatcataagtaatgacatagtcttggttgaaattagggacgtttgctttttctgctgatgctgtccatagtataaatgataatttttatttttttgttttaaattgacaaatatgtttatttgtccattcattacacccaagtttatgagggttagaaaagagaacaaatataagcatataagagtacagtgtacttcttgaaaatcaaactttgaaatttatcttattaaagttggtaaattcagaagcattatattctgtcagcacccacatatacccttgtctggctttgagagagttttatttttttaattttataagagttaaatttgaattggagctaatgtaactgacaagagggaaatagaagcaattggcttgcactaaacaagtttgaatggttgttaatgtgaatgactttcaggcagtgaatgtcagagaacagtagattactttctttacctcgggcattttaaaccatctcctgtggtaggattaacataatttctctctctctttcttgaatctaggaagcaaagtaattggagtctggtaattttggcctgtgggtgatgaagataaatcataacaagctatggaatacacattgacaattcacatagggctactagaacatgaactttcagtaatgcattaaacaaatattgtttctttctgatttatattcaagaaagccacagaactgttaattatgaatgcagttatcgtttgttatttttgactaaattcacatgcaaaacaaattgtttcaaaatataagctattgtgttcttaaacatgggctaagaagttgtatcttttatatgattttgagtgatcatatttgtttaaccgaaattatttgagattttaaaagaatagaggtggaagagaatacaagaccatctggtctagcccctctccttaaggcttataaatgtatacatcatcttgagcagatggaggtgtactcacctaaaattttatacaaatataggttctacagttccattcaatatcttattcttgaatttggtcactaaagcattaaaggatcctattttatattcagattattttagtattaagttcatcttgtaacatgttttaggctttggaagattagccttaatgtttttatttgtcaatataaatttatattaaaatacatattattaatacttatttctaacatattatttattatttgcagtgcactgtgctaaggattcacctccattattacattcaatttagcaacctcatgagcttaggttttgttgtctccattacagatttaggaaagcaagagtaaggaaagttaagtaatgtggccaagcacatggctaatgaaaagagttgctataacttaaatttctggactaaactttttcctactgatctacctcctcagtgttaagagtgcaaactccttctctcttagggcaaaatttctgtcactttgttgttcatccactttgtatcatcttatagtcctcttttctcagctaatgggagtatatctcgtgtttttgaaacttttgttcattatcatccataccagccattttagaatttgtttcctaatgtcttctgatgaaatttttaataccacaaatatgctgtgtatctgtttatgtatgtgtataaaaagagtagtattttttgtcccctctaagaatcagtttcccccttggtactgatattgctcccttttagaatgaatgtagttatcactattactgtacatttttgattgcataagtacataattatttttacttaatatgaaatgttaatttgttagagtatgaaaatattaaaatatcaacagtaattgtcctctttttaagttacgtgagctttccaatgccctgaaatgagaataattttgaagaagaatatagatatcaagatataaatgaagtttaattcttttataacaatatgtaatttgtgctactaaagaaacctcaggatgtaagtaaacataatcctgcccattttacctgtttttagaccttttgctaaattttttgtttatccaaatatatgccatcttaccataaatctgtattcctctctgttttgacatcacaatctattgccatggaagtgattgatagcttacatttatcttcatgtcttcagagcaggttcataaggagactgtctggaagaaatagactttattggtaccagcacaagcagacttttagaggtcctgtacaagtttacgtccatctgtattttttttttaaatacaagagttgcaaattggtactttagaaagtgtgaagactttgcttttcattctgtaatttccattcaaaaaccatatttgattatgattctttctaaaatattcaaataatgggttttccacaactttcatactttaaatataaaatgagcttacaacccgtgagtaggaaactgtggtaatggaacatattcagctttatcatgttatgcagaaatacagcagttaggaatgaaacctcattgataggttcttttactgggaaataaaccagaaggtgatgaaaatcacttggcatttttatatgtagtttgtagaaagttcctagtctggggctttgatctacttcattggatcaaaaacataataaattgaatcttgaaacttgctatatccttttggaattacacctaatattgaattattcatgtagatgaaactgatcatttaggtttcagaatttctttttttctgtaatggttccagttcttttttgcatgaagttttttgttgttgttgttttatactgaattttacaacccttcagatataaaagaggcatttctgtactgtctcttgtcactcaaaactaattttgatttcattgactaccccatatatgttcagaaactaaaataatttcaatatagtcaattaattaagtgaaggatttttgacccctacaatgattttgatctgtattagtcttgaggaggtaagaacttcaaaaattattacctgtgagggagcccatgacaaccatcacattttcatgtacatacagaaaagaatgatactgtatataggagtaaagtagaggaattaaacaagcttcctattcaaatgaagattttttaaaaagctataactattaactgtttgatgaaggttttgaaaggaaacgtgaagtggccactgtgcagatatggtttgagtgacttaacgggtcaagtatttgacaacagtaatgcttcctgtggtttttatatgaaggaaaaaatgaaaaataggaaacagaaaccagaagtttatgtaaacctacataaattaactcttaaatgatttattttattttgaagtgtctgtgtattgtggatgaaccaaacgttcagactttcttccagtgctcttggccctcctctattaaatgtgtgtcttgttccctttccagcgtacatacagctcagtcagtaggaactagacagagaagctgttcacttaaaaagttgtcatttccttatagatactttcttttctttattattatactttaagttctagggtacatgtgcacaacgcgcaggtttgttacatatgtatacatgtgccatgttggtgttctgcacccattaactcatcatttacattaggtatttctcctaatgccttcactcccccctgcccccaccccacgacaggccccagtgtgtgatgttcctctccctgtgtccaagtgttctcattgttcgattcccacctatgagtgagaacttgcagcgtttggttttctgtccttgtgatgtagaaagctgaaactggatcccttccttacaccttatacaaaaattaattcaagatggattaaagacttaaatgttagacctaaaaccataaaaaccctaggagaaaacctaggcaataccattcaggacataggcatgggcaaggacttcatgtctaaaacaccaaaagcaatggcaacaaaagccaaaattgacaaatgggatctaattaaactaaagagcttctgcacagctaaagaaactaccatcaaagtgaacaggcaacccacagaatgggagaaaatttttgcaatctacccatctgacaaagggctaatatccagaatctacaaagaacttaaacagatttacaagaaaaaatcaaccccatcaaaaagtgggtgaaggatatgaacagacgcttctcaaaagaagacatttatgcagccagtagacacatgaaaaaatgttcatcatcactggccatcagagaaatgcaaatcaaaaccaaaatgagataccatctcacaccagttagaatggcaatccttatagatactttaaatattatttttcttgagtatttatatttaatgcaactggaaaagaaataaacttagaaatttaaatgactgtggaatgtttttaaccattcacaagctgtataataatccataataatccaaaacaaatatcaagtcactttagttttagagaaatgttattctttataggtttgtggtttatttagtcaactgtgatgtgcttcataatactgatataaatatatgtttaaaaagatagttaaaaataatctcatgtatatgttttaagaaatgagataatcctgagagtcttaaagtatctttcccatttaagaaaaaagtagaagcaagtattaaaaggatgcagtagtgttgaaagacagtttatgaaaaatcaatagcctatgctcagacatgaaagcttattaattctctagtggagtctggaacaacttcctgtgatcagacacattagtctccctgaagcaaaagcaagagggattattaaatactataaactgcctcatcatagttcagaatttgaataaacttttggttttcagagcttttattcctgatgttggacaaatcatgatggatctgtagtaattcatttgcattcttacgataagttattattatacccattttaaaggcatagaaaccgaaagaaaaaggagttgggtaacttcttttgggtcacacagttattaaaaggactcaggcagtctgactttacaaatcgtgttcttaaacatgatgctatactgccagtgtgacagacatgcatgtatatatacatacagacacatgtataaataagcatttagaactatttagaagtggatcccaaaacttctatacatttatataattgctttaaataaaggttattttcttaaataacgattgtatattcctctcatctttttgttgccagtatgatatggtttggctctgtgtcctcactgaaatctcattgtgaattgtaatcccctcatgtaggaggaagggcctggtgggagttgattgaatcatgggggtggacttccccattgctgttcttgtgatagtaagttcttacaagatctggttgcttgtaagcacatggcacttccaccttcactgtctctctctctctcttgctccaccatggttaaatgtgcttacttccccttcaccttctgccatgattataagtttcctgaggcctccaagccatgcttcctgttaagcctatgcaactgtgagtccattaaacctctttccttgattaaattactgagtctcaggtagttctttatagcaatgtgagaatggacaaatacctagtatgtattatgctttttattctccagattattatcaaagcttgtatttaggtggatatttaagaaattccatattttttgtttttatttcaggtctaatttataaaatattagcttatattgggaatttcaactttatgacatatagtttaaagaatacatagatgaccaaacacaaacactcatggtaaatcatgagaaaaaaatgtagtcaaaactataaaatttaagttgtaagaaacttgcaataattgctacatcagcacagaacttacgtttcttaaacttggtgtttgtaccctggaatggataggtggacagcagaattatgtttactggtgttcaccacataagttaggaatgcttcccaatatttttattactgatcttgcactttttaatttatccaaacttttgtgactctttggagcaatgactgataccacatttgaaccaggtatatactagagcttgaaacatctcataacactagaaaataaggaaggtatcaaagcttactaaagttctgtcacaagaattgaggagccagcttgaaatcactaccactagccagtctgaggtaaaataaaaagattgaaacaaaggaagtaactgtaatggactgaatcacataaaatatattttaaaattcttaatattaggttggtgcaaaagtaattgcaggttttgccattaatttcaatggcaaaacctgcagttacttttacaccaatctatagattataaaattgatatcgctgataatctttggatgatagtaggaaaccaacatattctgaaacctatagggaaagaaatatttaacacgcctttcctaaattaaccgtaactcaagataactaaatagctgaagagtgaagcctccctgtatttattccaactaatgaataaagacaaaatggtagaattataatatttccactgtgcaaaacttaataaaatggatttaggtgatgattttaatggctgttaatattccaaaaaatggagcactgaatattctgagcctcctaatagaagtatacgacacctacgaaatatttttgccaaaaatattcaagtctgaatcttatcaaacttctagtataactaccagtttacaggatattctgggcactgagagatgtgtgaataatactaagcaaagaaatctagaatgtaggactttctattatataatgtataaatattgctaggatgtactaatactctagtactaatattcaggtttctttaatcacccaagtgctgtgtgagaatgggagaggagagaaaggacttacagattaaagagacttaaaaggcttatcaaccaaaacacaatgtgtggacattattcagatccaaatttgaacaaatcaactaatatagttaatgaatctaggtacatgtgggtttgttacattcttctatctacttttctgtatgtttaatattttccaaagtaaacataaaaatggaatataggtttgtacctctacctgtattttcatctttcatcactatgtaagtaacaaattatgagaatttataaaagctggaaattgggttatcattttcattatttttgaaattatctgtaattgcattttatttcctctttgatgaagtaattccttaggcgagccattaaaaaaaatctcccattggttttgactgttgtattacatgtgatcaaaaatgaggtagtgtaatttgtgcgtttttgaaaatttttagtcctcactatccaggttaatgttgatttttttgttgttgtttacaaagatatatagactattaaagaagaaatttttatctaaaatatggtagtttaccatcattaaaccttctttgtcattatattgctaaagtcagcgagatcattttaggtcgcagtgatttttttacagatactaatggctgacaccaataaaactgaattttgctcaatttttttcctaatttttttgctattgccattctgatgctatatgcttcagtagagattcatatttgttatgccttcattatgaattggattttctcttttgtcaatatacaaattctcaattttaattattaatatatatcaattatttattaacagataagatgtgacatgcaactgagatcactacattattcataacaattatgactcttaatgttaagtcttaggaaataaacctgtcttagctttttctatccttcttctttaatttttctgtcacaatcatggcctgctctaatcagaaatcaattcttagctaaagaatacatgcttctgaattcctaagcttccatcattattattgacagtatttgtggagttttacttttttcttgggaccatggagagtgaagcacattttgataaatggaggtctgaactatacctttatactggatagtataaaagcctttttagctattttaatatttcaggggaaaagaccattttgtcttgggaaaattgaatgaacgaattttccataaaatgaaatgattaacaaaatcttgctgaatttcatgtttttatttagcaggtattgtatctaaaacgttgtcattgtctgtcagaacagtgttataatgcctttatcttaaattctttataaactagctgattcttgaaggggagggcagtatatttgcttacattcattgttaatttgaaagatggatttcaaactgtagagctgccgtgaaaaatataatgctaattgtagtttgaaaagcccagacaccttctgatagtacagttttacacccaagtaatttaaatcaaaatctggaaaacacttttttttcttttgatagcatatatgtaatatgccttaattaataggaaaatccacatgctggagaatggtgaacatgattaaatagattaaattacttttcttatactatgcattaatagctttctcaaccatgtcccagcggctgcagcacattgtgctataccttactgaggaaatcgcctgatttttttttttaatcagtcttcactatcttgccattttttaccattatcattctaacttagtgaaatcctggttttctcaagtgtctagtctttctttgattttgatttcacatatcatacacatcagttatttatattttatcttgttaatcaactaatttcttcacatattttatttttcttcccaaacacatttttgttcaacttgaaggcaaaaagtatccttggttctggatcattttcctcatggttctcagttgtagagaggtggaagacacatgacaaattctagtttaactggattctgtaatttaaaaaaagaggtgttacagagtcagtcctgcagatgtttgagttccagacccttccaggcaggtcaccaggtactgcctctagacttagatgatgtcccctgataattctgtcactcttcttccgcaagttgctccccctttgtgagtcacatcatataaatgatattattttaatactttctctgtcacgatctgtccactctaagcagaccttatttatttttaatcacccttttgccacgtgggtctgctttttctcattccttttcactttatcaccgtcttaggggacttaactagccaaatggataacccatttccttgtttttctgtttccatgagcacccacacactgctcagaccctttgatttctagcattaaacttatcaattcaacctcttcctcctcactacattgattttttttttttcctacccagcctcattgcaaaacccaattcctcagtctctctaagtttttctcctttccctaccctgtcaggatctgttcttggactatttcaccagtgtactcactccagctagggtgcctctcccctgatatccctcgttttgtcagacttcattgaataaatcccacaatcaatgtgacctgaagtcctgtcactgtgctcattggttctagtagacatctagtttaccatcagtactttggattcatctctttccacttcttatttctgagagcagctggtggctctgacgacgtcccattctttaaaacatctaaccattctcttaactctcagctacaaatcttccctttgattttagtgagaaaaatcaacggcatttaatgttaactccacgattactgtttctttcctcaacaaaacattttttagaatgtcctcccttctaccttcttcctgaccttgtggcacttacatcctatgccttttcagagataatagccccttcctaggtctccttaatctttggtgctctggtctctgcagggaccttttccatcaaacaattcatcttgaaatttttatcttcattaaagcagccacaaatattcatattcttaaatctcatcaagaaaaaaaaaccctttaatttgaccccagtttccctgattatactctattttattttttcttcattagtgaaagtttcaaagaattgcctttttatcattcttgcctctatagtatttactcattaatcatctgttattctgtttccttgatcactccattcaaacttcttttttagaagtttgtaataaccttctagtagttaaatctaattttcctaagataccacgttctctacagtggaagcctttgtgtaacgtaaaagaagcatagatttatagaatctttatttgaatgttacttatatttatgctaccttctgacaaataggtgtgtatatgtgtgtgtgcacacttttttttttaaataactatctgatctgcagttttcatctatgaagaatttatggtctttcctactacttcttacagttgtatgtttaactatgtatgggatctcttaccatttttagtgcctcatatttagtaataatctactaaagagatgtttaaagctatatagataaagattaaggactgtctttaagaatgccttaatttttctccccctttctctcctacccttgacttaattttttgtggcaatatacattcataaagtaaaatctgatagagcaatcatatgggattttaaaaatatagttccaagtacattactaatggacaaaaggaaagctgaaatccataaaatggggtaaaaaaaactcctcctcccttttttgaatttttaaattttttatttatcttgaaattctggtttaatttgcaacagatctagaaattcaagtcaatttaacaaacatttgttgaattcagtaaggcttcacagcctgaaatatcaatcaaaattacttttttttaccttatattcctttaatattttgttttagtcctacaatccccttgtaacatgatatgctatatttgagttattgtcagtaataataactgacattttaaaccataattgtctttgccaaatactatgcatgctaatcaccttacatactttgactaatcttttataaaaacatgaaacccaaaaaagaacattttcatcctcctataatgatgagtaacacagaatgtgtaaataaatttccccaggtctgtagatagagccaggatttgacattaaatctgtctttttcatagcgttgcccttcccttcttcagtagttttatacttagacacttgggacacctcaaggaaaatgcgatatccaggaggaaagggataaacagatgtttatataatattataacagggcacattttcaaagcatgaatagcagtcagctgtttgaaagtgtcaaggaagcagagaagtcttgacagaaggcgtaacatttggaatgcctctaaaaagatgagcagggaaggccggggagggaaatgatggcatattcccgagtgagggaacagtgagttcaaagtgtgggcccttcagggtctgctgaggctagaatgtaggacatataccaatttattaggttttacttgtttgtttcataaacaatggtagagttatatacctcctctcttgaatccagttttgttggaactgttcatttatttagcctattgaccactatgtatttgtgtgagtcaaaaggaataaaatcagaaatgattttatgtgatattaaaagctttaaaaagcaatactaagcccagtgcagtaattatagatctgtgaccccacccccactcttacccctggagttttgagtctggtttactgctatattgattgtagctaaaatcacaaccagatccgctaaacttcttggcattccttttaacccaaattgatactaatgaatgtcttaagactacattgtgcctccagctcatgagcaaacattatgtctgtttcatcatccagtagaatgataagattcatttagggttattgaggaagattctgtaattgtaatgaaatcctggcatgttgtaactctcagaacactgttccccatagtgaacatctacaattagttggaagtaatctcagttctaaaggccttcagcagtgactacctcttctcttacctatcatttgcatgcacataaatccaatgctgatttagtttggcaggaacaaggaggaagagaggagtgatgagagcaatatgaatgggcttccatatatcaaaatagaaagttatattacaaacattatatacagcttccatttattgagaccttaccaagtgctaggttctttaccaagtactctgcatgcagaccttatctattttaattctcacaactaccctgtgatgtatgtattattaagcccattgaaaataaatcaagaaataaccttagcaagattaggtgtcacacagtgactactagattagaactggactatatgcctatctaattccaaagctgtctaatgcatgttagcaacattacattgtgactgcaatataacaactattcaaaagttaaaatatttttaagtcagacaaatctaaaacaccattttagtacatttcaggtttaatatatttattctgttttagaattatcaatattattattatttcattaaccatgatatgccatattttctttattattattattattatactttaagttctagggtacatgtgcacaatgtgcaggtttgttacatatgtatacatgtgccatgttggtgtgctgtacctgttaactggtcatttacattagggctatccctcccccctccccccaccccacgacaggcccccgtgtgtgatgttccccaccctgtgtccaagtatttccgtaaagattttcttattcaatggcagtctacaccattatatcaagcagactgatttggttcatggttctctttgattaaaatgtatcagtcatttatgtaagatatcgtcaatgaattccccttgaaatcatggaaacaggtaattaaattctgtcattttcccaaactttggctttgttcttttcctggaaaggcataatatgatcctagaataaaccaagtctcattcccccaaggctaattaacatgcaaataaattttctatacactagtgtttttactaagtaaatcattgtagctggacatatcatttttaagcagaaattttttttatttttgtattttgataactctaaaatgttttaaaagtttgcaaaggtaagaaatgaaaggctaatgtattctttttgtgcaatcagccagtccttggtttctgctcggattggtatattgaagaaatgctaatagtatatctgtaacctgttaaggaatatcaagtctcttcaggaaaggaataataaaatgctaatgatcagcattaactgtctgaattggaagggattatagaggaacatttctgtccttttcctgtcaaaagaggatcaccttctacaataatcccaacccagccattacttataccttccaaattcatgctgtagtagacattctttgagggaagaagtatatattattattattactatctggaatttcataatgctttgcatagcattttacataatatatgctaagtacatttttcaatgaatattttaaaattccaataatcaggaattctctacctcacaaagcaaccctttttatttttaggcagcatctacctacttaagtaaaatgtattctcctcatccttctggtaccaaatagcaaaactctgattcttctaccatgatggccagcacatactcatcattcaaataagttcatcagtgcccctcttaatatatgacatagacaagtgaacttcacatgctgtggttcaaccaaatatgggctgtgattgtttttcacctccctttttctggtcactaagattatattcttggcagccttatcttagctcaagtttagcagtcaactcaaattcttctgtggtttttttttctccatcacattactatcatacaaatttaccttttaaccttctccacaataagaaagaatctgtacattttaagattactgaaacaggggagaaaatagagcaggcagaaaagcctttgctttattggttggagagaaggaaaggagacacttgtaaacttatattaatcatttttggtccatcagatactttattttgcagagcacttcctcacttctcagtttttattgttttgttttatcctgtgttgttttcgtatgatctattgttgagccagggtatcctcatatgtacttgtgtgatagagttttaaaaacatttgcagcaatctgtggccaaccctcacatcaatgacatgctgctgataggaagaagtctctgtatgagtattgaaaacactgagatttacttattggatgcattttatttatatggtttgattcttatttttaatgattttttttctattttacaattttaagggtaaaaaatgtataaatatttggaaatagctacatccatggaagagagacactgatgaatgagtttgaatatgaaaatctgatggtctatcctgaaagaagaattaaagttttgctatttagtaccaaaggatgattaatagtttttctgaaaccataaaatgctcctggtatcttctaattccaagttaaaaaaactctgtaaaatgttattgtagctatttagctttaagcagattattattttaccagaatatttaaacatttctaaatattgtcatctttattcataaatgtttccaatatctgttcatataatctctgtataaatttcacatactatacagcatgcatttatatatggtaactaataatatttactacttagaacacagttagaaatgaatgcaatattcattttgtacaaagacaatatctcagaagataacaggagagcaaactgaggtagaagaatgagctaattagattggaataagagaaatgttcccactttagttctccagtgtctgttttacagactattcatttatattaaaacatgtttctaagtgaagcaattatatgatacttacagattttgcaaacaagatgtgaaattgttgagtattatacactgctccacagaatgattttaaagtattaattttgtaccttgacatggtgtcttatgtgatatttgcagattagaatgcaaataataaagttttgccaaattggtatgtatatatatataaacagttttaaaacagtatcgtaggctgggcacggtggctcatgcctgtaatcccagcactttgggaggttgaggtgggcggatcacgaggtcaggaaatcaaacatggtgaaaccccatgtctactaaaactacaaaaattagctgggcgtggtggtgtgtgcctgaaatcccagctactcggaaggctgaggcaggagaatcgcttgaacccaggaggcagaggttgcagtgaaccaagatcatgccacagcactccagcctggtgacagagcgagactccatcacaaaacacacacacacacacacacacacacacacacacataaacacacacacacataaacacacacacaaacagtatggtaaaatacaataccaacaagcaacaaattaggtaaagaagtacattggagttttgaattttaaaatcaggtttattgaaatatataaagtaaaattgatcatgttagtataaatgagttttcataaatacagaacatttttattaccccaaaaaatattccttcatgcccctttgtagtcaaatatcaatgtcactagcctttttctctcccatcctgcagtgccactgccagaaagggattgaaccactaaccctggatctgctggaaggccctgatttggcttatctagggaaagggctgcttctagacccttcaaccccacttagctgtctagggtactacacctgacccagatgtaagtgagattgcatttgtacagagaaagatggagctgccatcaaaccaaatggaggaagaagcattttccagaatatagctgctgttccctaagcagagacttggagtcctgggaacatgaagtaatgggtgcccacattatagtaatttgataaaaatcagttaataactttcagtgagatagttaaaaatcattttttaagatagaaatgacttcttaatatgctaactgtaagatacgtatgttgtaagataatagaatacacattatacctaatgtaatagaaaatattcaaggcataaatataatctgaaaaagcttatggttaatttttttagtaagtaatcttttttgatcatttttaactcctcaaaacaatacacttggcactgttgtttttaaatctcaagaataaggactcaattatttcttcaatttgttttcttcatattctgaatttcacctatatatatttattttttcatgggggagtacacaataattcagttttgaaataaattaaaataaactcagatccctttgtaaatgaaggagcattaatgtctttattaaaccacattattgaagcaagattgacatgtaaaagctgtacattttaatatacacaactttatgagtttggacataagaatatactcatgtacccatcaccacaatctataccataaatctctccatcagctccacaagttttctctcaccatctacattattattattattattacgtgtgtgtctgtgtgtgtgtgcgtgtgataggaacacaagaactaccctcttaacaaatttttaaggaacagtagtattacaaattcacctctagctttcttgaaaggcagtgccttttaattgtttatgccttcatttcattaggagtttcttctgtctaaaagcttattctgattgattttcccctaagcagcctaaaacaattgaaaaatcttgttattgtgtagctgttggaaagtcaactttgttttaaacaccacatctgacagttaaaatttactgtcaccacagtattgcccttcctgagagagatttgttgttgatttcctccctaattttgggtcacatggtagagaagcattgaacatatgttattgtgacaaaatccacacatggatatttatgaaactatagaaaccttttgcagttctccagaaacctgtgatgataacattctagttatctttggttatatttttggtgcaatatatgcatttattcagtactattaaatacctactttgtggcaagtataatttaaatactgagaactcagtagtaaacaaagtccttgtcttcacagaattgtatattggagaacaagcactacacaataattatataagaatgccatgtgaattttaagtgctattgaaaaaaacagtgctaggtgagggaatggaaaatgatggcaagatcttgttttgagaaagaagataaagtggtcagaaacatcagtcctctctgaggtgattactgaagtgaaaaagataagaaagaagccatgtgactctctgggggaggaatgttccagcagagtaaacaacatgcattagacctgccatgggcaatatttgatgcagtagggcaaggcaactcgaagtgtgctcaccatgttgatcatttattacaaatatacaacaagatttaaagcaatgtaatgtaatatttgaatacattgaactggcaattgatatgagttgcatgtcttttttatttcattatttggtaagttatttttattgtattttacaaaagtttaggctcacactcaattcagggaaggggcttgtccttcactatagataatctgagaagcatcatgtttgaggaagggaagagggccacctgggtgagttaggaaagagaagaccttggttcacttagctgtggtgggacaatgaggatattctcttctgaatgcaaaaagaatcaagctgggctgctaaaagtgagaatgggatgaaaagtaattaagagaggagatataaaatagagtaaatagttcaaggaagtagagtttcctgactgtggggagcacacacctcaggtttgtagtcaaaaattgaatgtgaactagtcattatagttatacgtttgtcattgttgttaaatccagccactttcagctgttttattacaagtgcagagtaggcagaggataaaatttaactcagatttgggtttctccagcaaaatattaagaggggaaaaaatagctgagagtttataaaaggatgagattagaatgattcacttggaatctaagctggataaagagtgaagtgaggacaggggatggccaatgaaaggccagcagactagaagtgccaatgaggccagtgaatccctgaatgggagcactagagcccatgagctgaaaggtaagggcaataactctgtgaaagggatgcccaaattggtgtttggaaatggtgcaattattggtaatgactggggtggaaaagaagtcatctcattgtggtaatattctaaaacactaatagaaagcctcattttcagacttaatgcaggtcacagtagtattattatagtaccatgttttagatgaaattagttaccaccagaaataaaacattcatgtattatgatatttagcatttcaaatcggataattacaaaggttttcaagtgtttttcttaagtgaatgtatagttcccttccttttctatatatggtgagaggtgaacttctttggagaggaatatgtgggatgagtcaaagtactgggagaatggaaagggtggggagttgctgagttattatattagtgtctgctatcttgtagttcaatgtcaatcttttgctgttgcctttagcctctcttctgcctggaaggtgaaaagaaggcatttatggagagatctacattatagaagagaaaggggagaagtgttataagtttcaggaccaatcaattttagacaaactgttgaatatttcaattcctttaacatggatgaattttgaagagtatttgagaaataagtcaatattttagatcaaaggccataaatatcttagttatattacaataatttgtaattatgtgaagaaacaatgtaccaaattgtctctacttggttttggtttaaaatatagcatgccctatatatgatagtaccaaagctttcttttgtgtgtagaaatgcattttatatgcatgacaccaggatacttagatgataaggcattgcatgaatagaaggacagtcactccttattaaaattaatctttatttttgttgaaatgtaagacttactggtatttttttctttacacattctaattttcttgagtccacttctttatttaaaaaacttcacatttttgctttaaatttttatctgtaagaaatatgtttgcatttggaggagacatgtctgtgaaaaccacacgtgtgtgtgtgtatatatatattatgtatatattttatatatacccatatattttacacacacacacacacatgggagaatttgttttcttaacttccaatggaatgctatacggtgcttccaatgtttgacttgtctagctgaaagctatgatggatttcttcatcctagatgatatgtattccctttacttcattacacttaatctatctgtgcaagatcttatggcctgtggtagactttatactctaccagacagcttatcagtttctttgcaggcctctcaatttgaattttaagtaaaaatgaataaatttgtgttgcttgttgagactttgttctgaaaggcttctgctctctgattctagggtgataactagagaaaggaaggtcatagattgtcatttacaatagctgtattgtatctatgtggtctatgtatatatacacatacatatgcatatacttgacatatgcatatatgtatgtatatgcacatagtgaatatataactaaatgcacatatacattaatgtataatatgtgtttaaggagtaagagaggagagctggttgttgattatcagaaataatttgatatttggaaggaagaaagatttatcttaatttagatggggcaatatattgtaccatctgctgtttaaaaacgaacagtcttataaaattgaaagcaaaaccagaaaataatttaaatattcttctggcttctatatgatgtgaggattgaacacattgctaaattcatcccagtgggtcaaaaagggcagtttgagaaacccaagcccaagaggaaatggaacaattttataaacaaagtaaataaatataaaatgctcttgctatcaaaattgagttaatacatctctagctgctcaaaacagttgctttaacacataatgaagctgtttaaaagatagtcaaaatgctatacctcaggtttgcactcagatcattttttttttatattgcttttgctgttggaggactccatactccaaatctcaacaggattttaggtgaggagttttgttttgtttatgcttttgtttttctttccaagttatatgtgaatgactaaagtattctaaaatctcctcacatatttatgtcttttagaagagcttatttcacaatgttctttgtaacttttatgaaggtaaagatataatgattcgttccgtgttaatctataatatatattttttctagtgtttgttaaaatatattattatttgtcaataatttgtactgaaattttatgtttcttggtcaagactgttcccctgacctttaaggaaatttgtattactatagcagaatacatttttagttatacattttcaaggtttcatttacagtacaataattttgaacactatttaataaaatatcaagcaaaataaaataatccagatcttcctttgtactttagttccatcaagaatcaactcttcctgtgcataaatttttctcaccaatgaagaaatcaagttgtgtttaataggtagtcaaaattcattatgtgtaaaggtgcaagttattaggtttactagaagaaaagagggatacagagatagtcttgaagccatagaaataattctcccttatacatggtactgaacaaagtcttctacttttgtgtaaaagcaaaatactgtagtcctccttcatctttggataatgaatcctccacatttaagggatattagatcattcctaccaataaaaaactatttatttaaaatgaaaactaagcctttgtgtgaatttaaaagtattgtctagtgtgaaaactgaggaaaaattaagtctgaaaagtcaactgcttatatctaccttctttattttgatctggccttttcttctgaaaatgtttatctgtaaaatggacatcctgatgacgacaatgatgatgataattctgagcataaatccagtagttcaaataattcactctttcttgaaaaaaaatttttctataaatttttgggaaattacctacgtacagatcagtagtcaatgtattcaaatcaattttgttgcaagaatcagggaactaaagacactataacaattcaagctagggatggacctggtaaagtagaggtgttgtagacaagctcctgacatttattatgagatatttgactactaaaaagcattccttgaggtatttatttgaaaggtaatgcttcagattaaaggaaaaaattaatgtttatatatttttttaattttcaaaggccacttgtacaaattctcttttacccttataggattttaaatacattctccttaatttgttgatctgactgtaagtaatgccttatgcttagggttattcttcagagtaatgtaaaataacatgttcagctgtcataaatgttattcatgtaggttgccaggtatagaatgaattctaaataatgtgagtgctaaggagtctggaagcaatgttgcaacttgtgtatctggatgcaagataggggtgcaatagcattttatacaggagatgggaaaacatctttctccattgcagaggaggagatggaatgacagtgtctgagtagtccaagagtgttcccagcatttgttggcaccctgctttctggtgtctcaattttctttttaattaatcaacaccagtgatttggattaaaaaaaaatgttgctagtgaaataaaagcaaaaccttggcactgttaagtatagaattgaaaccaagttattagtatctgacagcatttagattgggagaagtagaacagagtctattctcatggactcttcagtactgcgtgatttactcagagctcctggatgttgattctgaagtccagatgactcatcagaaactggcaatgaagggcaacctggatttagatatgtttgtacattcagattagtgttagaaagagagaggcagagattgatggagagaaaaggggaaaggagaaaagagatttattgacttcattgactgtaattaaaaggaactctgatcattcaaaagaccttcctcaaagtttcacacttctttgttcatgttaaaacctgtttttgtatctaggttctcagtagggtacctttaagcaaaaagaagagaggagccctttaaactatagtttcatgaaatttcactcattttatattagtgactttgtgtgtgtgacattttattcttaaaatgtctgagatagcttttacctatcgggctctcatcacttcacagatggactattgcagctacttttttaatactgtttttaacattcttgattcctgtactcagaacctgcagaggtttaccactgcttgcaggaagttcaaattcttcatccaatgttctccataatgttgttcgttctccataatgttgttgttctctgtccatctaattttgcctcccactgttttctgaccagatcataaactcctgctagacatattctctttcattcctcgctgtcctctgacttcatgctatttttctctaggctgctttagctcacattattctcccctactctgaactttcactgatagattccactgtgtgtattccttaattgcctatacaccatacttcattttattcacccctcttgggggtgcatagaccttgtcattttcctttgtatgtcccatgtgacttgtttgatgatgagtagtgctgtctgcagagagagcactcaagtgattatagaacatgtccattaagtttcccaaatagaagactctttatctcctattctgccactctgaaaactaaacagaggctgtgaaaggctcagtattgctgatgctgtaaagacaggacacctagttgcttgaagtcccagatgattgatagaaatagtttttgtataaaaaagtgaaattgattagcaaattaaataggaataaagacaagtgagggtgatttaacttaattgaagaagagattagaaaaatcagagctgtttttaaaaaataagaataaaaaaatcagtgtggtgaacacaccaaggagactttcagaggaaggtttagataagtccataggacaataatctttaaggtatagcagaaacattggaccttcttgaataaggaatgaaattgtcacatacataaatcagagttcaagaggattaccccatccttgttgatcagtgctcagtaagccaggttgcacatctattttttcccgttgtgagacaggaaataattaaaaagggaaataatcagatttgtaacttaataatatggtttgtaaaactattttatattcatctggggctggccagaaagccatctctactaggcatgatgaaattattctgaccattctccagtatttatagtgaaaatacatgttcagtatctcttttgtttcataatatctaaacaagaacacgtggattatttccatctttaatttcgggaccaggtatatattagctcttttaaggaagtgtcatgtggcacaggtccaaatacacatccttccttgataataataagtctttatttttataaagctgtatattttgtaagtcaaatatctgtgtctttctaaatatgtgccggatgtttacatttcaaatgggcaagaaaaatacctgatgtgggatataccagttttgtggggtgagcttcatttatttatttatttgtattattacttgccattatttgaaataattcataagagctatataagctcttcctttactgcctggaatgtttcatatgacctactaaattttgcattactgtattattttagctagtgggaacatttagtataattactttggctattctttattagattatgagcctcccattacttctaaaagactatcttggatgctgtttgggttcagtaaataactatgtattactgcaaaggtatactgagatttctattttaagtggtgtctggctagcagccctggacacaaccttccaaaaatttccagtaaattgactatgaagacacacaaagagatatctgttcgtagtatggataatatagactgattgtcgcttactgccagaatttgagaggaattctggaattgttttcctacatttagttacataaaatttcaaaactatagcagttaagataattttctaatggacacttgcgtacccacctcctgtatgttactattaccattttatcctacatgcttatcccccactccattgatggaactagattttcaagtgcaattggtggcttacctatgtacacttttggaaatagagctaagtttgccctaaggcaataagtaaaaagctgcatggctcaaaataaaaggtttctttaaactgggaactggaagctactcatatattgtataaattttgcttttcaaacaaagcaaaccccttctgcaagtacctatctgttttagtatgtattcagaaagtaattaaatgagaaatagggaggaggggacatggttatattttgtcccctgcagagtatagctctcacaagtggaaccctacaagcaaaacagataggaagaggctagggtagtggtttatgcagcagtgtctagttttgtacacattccagcagttctgaacttagtgcactgggctattggagaacaataaggtccacttcagaactgtggaagatccctagaggatagattctggggtttggatagaaaccatgtacgtggactagccatccagctctgagcaatggattcggccattacagaagggcatatgaagtgggccaaagagtgaagaatgcattttctttgttggctatcacccaagttaagtatagctccacccttgtccacaaatacaaaaacagaaagaaataagatagtggttttaaaacaataaaaatacttcagaattatgctacaacagtaaaatcctaatgaaaatacaactgcatctacagtgttttgcagacaggtacctagccaagaattttataccagattaagtaagtcttcacatgagaaggcaacaaaaaggcattttttaaaaagctaaagttgaagaaatatacccttatacaacttcataaaaaaatatttgaatcaaaagtaagagcctaaggatgccattttattaaatgaattatgcatcttcccttacacattccgatcctagatcacgaaaatttagatgggatgtgtgtttgatcagtaaatagcgcagctcagggaagcaccttaatccctatatgtaatgcttttctcagatgttttatttcttcattttttgataccatatgtatttgtctgcctaggatgccataacaaattagtacaaactgggtggcttaaacaccatggttctggaggctgcaagtctgaaatcaaagtgtcaggaggtttggttcctcttaggcctctctccttggcttgcagatggccactttatcactgtgtcctcacagtgttctttcctaagtgtgttcacatcccagatatctctttctcttcttatgggacaccagagatactggaataggaccccaccctaaaaacctcatttaactttaatatctccaaatgaagtcacattcagaggtattaggagttaggttacggcttcaacgtacgaattttggggagacacagttcagctcataacatcttattcattggtatatctgacgacttcttaaaactctaccagatgctattcttttcttgtttttttttattatttttatttttatttttttttattttttgagtacttgatcacaatggccaacctctaaatgtaaacgtgattgtggcattcagggtaaacccagtgcacatctcatagacttagcttcactgttataaatcaacagcatatggaattagcagcattttgaggctcagagggcatagggatatcctagtgcaggatttagctaagaaggccttgtttctaaaacagagtgaatggagcaaagtgcatgagaatgcagtggagcaggctggccatacacctttcaggctcactccctaggctgaatctcaaccacattgaaaaacagttctgggaatccccaagtttcatatacatgtgataacaaggcaaaagtgaacagacatttctgttgtacaggcagcataaagttgcttagacacaacaactccttatatctaagggagccaaagtgaaaggtggaccatggcacagtggctttaccaaaccaccagggaagagcaccactgctcttgggtccagccctctccttcaaccagtcctccagctggtcaagaaacatagttcaacagtagttcaaggaatagtgagagtggaaaaaaggaaaccccacatattttttgtgagcacacatcaatcatggttagaccttgccttatctaagactaaatagagaagaaaacaaaatgtggtgatatattagggtcctccagagaaatagaactaaattattaggagagtgtgtgtgtgtgtgtgtgtgtgtgtgtgtgtgtgtgattgaatgattaattttaaattggttcacaagattgtgaaagctgataagtctgaaatctgcagggcgtgccggaaattcttgcaatagtggatgttgcaatcttgagtctgaaggcagtctagagtcagatttcttcctctactagggacctttgtctttttctcttaaggccttcaacttattggatgaggttcacccacgttatggagggaaatctgttaactcaaagtctactgattaagtgattgatttgtttatttgttggttggttttaagatagggtcttactctgtcacccaggctggagtgcagtggtacaatcactgcagcctcgacctcttgggctcaagcactccacccacttcagcctctcgaatagctgggactataggtgtgcaccaccatgcctggctaatgttggtattttttgtagagatgggattttgtcacatcgcccaggctggtcttgaacccctgagctcaagtggtcagcctgcctcggcctccctaagtgctgggattacagacatggtgagccactgtgcctggctctgcttaagtgttaatcacatctgcaaaatgccttcactgcacacccagtctaatatttgaccaaaccctgggcaccatagcctagccaagctgacgcataaaactatcacaggtgactataaaatgttctgaaatttaagttttgaaaaatacagttatcacaaggcagagtagaacaagatgtttaacaaatctctctagaaaagatcatttttatatcatcagtagaattcaaaaaatacgggctctgagacaagagataagacagaccaaggagcagttcaaactcaggaataatttttaaatatgcgcatgtcctaagaaaagctataaatacataagtatgtttgttttgtattatatagttgcatttgactatggaaatggaaatatatccttcctcacaaatatagtttattgctaattattggtaaatatatttatttgatattgcaataatagtattattagacccacttagggccaataaaagctcataggttgtcaaaactgttttgtcactttggttgcaaggggcagaatttgattcttaaaatattggaattttatattcttattataaatttgggggaaataaaagataaggagttgccataaatatgtgagggcccacaacatcagtgtatttcttgttgtttaaaatctttctttaggctaggtgtagtggctgatgcctgtaatcctagcacgttggaaggcaagacgagaagatcacttgagcccaagagttcgagaacagcctgagcaacatagcgagaccctgtctcaggggaaaaaaaaaaaaaagcctttctttagttattatttcattcagatagctatgaaagtatttttggtttttgcttgcttgtagcttttctgttttctaccacacaaaaaatccaattttaattttgggtttgtgaaatatgttttatcaaaatataagcctgatgtttcttatcttccaaaaaatttaaaaatattagctcagatgtaattttgatcataaatgattaacatgtaaacttaaattgaatgtaaccacttcatatggatatttcaaggtaaaaaatgaaatctaaaatatctgcacactacttttaaaattttgtccataaaaatgagaaataccgattccttatattctcaaatttatttcatcatttatatatgtcatatatgaaaatgtgttctttttgatatttactttagatatcaaaataatacaaattttaaacctgaaataaaccgtagatatccgttgtcaggattatatcttataagtcacatcattctattcatcttgtctaaactaatattgttatatagtatcacacaagaaaaaatcaaactataaattaaatgtcaaatttctgtttgtttttcaacatacagttttaaatagatgttattattctctttctgtataaataccctgagcagaaattgtcagcatgcacgtatcttttttatggtggaatttttgactaatgagtttttgttagaaatgtatcagttctacttcattttatagttgaggtgttcatatgagtcagtctcagtaatttttgagtgactttctgtagaaagttgttctctaactagaatggaagatgctgacacctagatgttcaaatggggctgatggaaaaaaatcaggacaattttgtatcttatatgggcaacaaagcattataaaaggacatgaaggatggtttgtcatatccattagtttttgccgttttatctattagacttgcagtagcatatgtagaacacaggttgtgtatggtgggaataattttgtggaggatattatgagtatgatattcacatgctaaatgaaagtcaagtatgccataaatttaactaatgtcacttatgttttgttcacatagtagtggtgtcatcagcgtaatacaggaaagatttacagtacagcccaacatgactgctgttctctagtgtgggccccggtggggaaagggagaatcagaggaagagactattactgatggcactagttttcatttttaaaacacacagcctgggctgggcgctgtggcttacgcctataagcccagcactttgggaggccgaggcgggcggatcacgaggtcaggagatcaaggccatcctggctaatggtgaaaccccatctctactaaaaatacaaaaaattagccgggcgaggtggcgggtgcctgtagtcccagctactcaggaggctgaggcaggagaatggcatgaacccggcaggcggagtttgcagtgagccaagatcgcgccactgcactccagcctgggtgacagtgagactccatctcaaaaaataaaaattaaaattaaaaaataaaacacacagcctgtaactatttgaccttttgtcttttatagtattttagtgtgcttttatttcattttatttcattttactgagcattttatttcatagctttaggtacaaatgtggaaattttaggagcaaagcagtttgtaattatttgtctcaaaaaattgatttgacctttaaagacatagtttttgtgcatcaatgggactaatttgtttaaatagtttataaacaaactattaaccagtatgatatttttcttaaagagatcagagccaagaacaataacaaaaaagtgatgactcatttttcaactttcaatttatgttacaagacattatcacagcattcattggctctaatttgacattaaataaacacagtgaaaaaacaatctttgaaaagttattcatgctttcgtataaacagagagatggtggtttggagataccccttttaaaactgagcctcgttaatttaaaacaagcacaatgatacaactgtacttgacttgaaggagggcatattgttctgcaggcgtcctaattttacttctggtcagagggacactggaagattttcagccagaactgcagtgagagatgaatttttattatatgctgagatgctcagatgcctggaaacagaaaagagctaattttactgttgaaaagtagttaataggctacctgtttccaaatatgcacctgccatcccccaccactaccatcccaagtagatgcagactagagcattcatagtggtcgttcatccgatgtggctccgcatagatttttattaagtcaggcatggtttgtgtagccctccccgctcctggaactgatcacccatgttttttgctaccagagaagtagtttttcaagcaacacacagcttgtatgtggaagatttccaaagtcacaattgcttctttatcttccagtgactttgaaagaaagccatggcatgaatagaatgctcaaagctctgtccctgcacaatctgtagtcctttatttcagctatgctttttactgcttcttgggaattgatttttctcttcaatgtaccacacccctttcaattctctctccttaaaatggaaaagagaaagaaaatggtgcacaaggtgtctgagaagtagagcaaaaagtagacatgtgtaaatccataaggatatgaaatggatggaaaatataagacacaagacaaacaatactcattcatgcaacaataaattatgtaattctggagtggaggagctagcccagaactttgcaacattcagaccaaatttcttagactataattcagttattcaatttttttttatatcggtacttccttattccttaatgtgtctgttttcagagccttgggtatctaaatcagaggtgaaatctctccgtttctatgccaaaaccattccattttctggtcaaatagtccctgagtgtttaatgtaattgccaaatgaattttcaaaatatgccttggagagttacaataaaacattttcaaggctcacaagtcttacggtgatcaggattagtttgtttaaccagcatttcctaaatgaaaccctttcactcgataatgactatttttatctcactaccttggattaatgtgtagatagtggactgtacagattcaaaagataaaggaaaaaaattttaggacttagtaagagaggaatatagggttaggtgagcaaggcttctagatttctagctcgtaactcagtgggaccattcactgaatgagacactggagtatttttttagggctttcatatatgcccgggcaacaaagtatgtctcgtattcttgatttgaagaaaggcaggctttctgttcattgcaagagttattattgagagcctatcctttgagaaaatataatgtttgcagaaatagatttgatattctagctatgtaaagaaatgaaactttaaaatgtgagatagaaaaattataaccagaataattagaacaaattacattccacatcaaggcaccttactgtttagacttaagcaattatttaatgtctgcagtattgtcatctgaaaacattctatgacttagagaaaatataccatatcataactctaactgtattattctatctttttgccaagcaatacaagcagagtagtacattcagaactggcaagatgattgtctgaatgtgacattatctgatgacactcagaaagcctttaaacataaaagatatagagaaatgcttcattgctttccttggatggcattttttcctttcagcctaagcaagattaatgttctcaactgacatgatgacacatctagctgtgaaatgacaataaagtatatacaaaatgggagtagggacatgcctaataaaatgcaataccttaattttttttctaaatactattagtttgagattgttctgaaggtaatgatgttcaacttgtaaatgtgttgcatatgccattatgtttatacattcgtctgtacacactgtttttattaggagtgatatatcacctcacttttgcttgactcctgtatctcagaaaagtgatggcatttcttattctcttcagttctatttagcagacatttactgagtattctgttgttgttgttgaaggtagtgtgcaatatgtttctaatatgaatgtaacaaaaagaacctgagaatatcaatgaaatttaggtgaatacttaattcctggtgatcaaagctaatgggtgttctaatgaaaaaaagtctagcactatcatggaataacagcagaatctggagcaataaggcaagaaataattttatttttcagacaagccacattattaatgaaaacatgcaccacacatgaataacattggaatattacctctttcttgaatagcagtgatgagatggcctactctgagaggtactgaaaaatcagttgaggagattattgagcttaagtgtgtaataatcagaatgaaaagaaatacatgtagtcagaattacaagccaacttaaacagataattgataaggcaaattgtataatattcaaagcaagaaagaagacctagaatacatcaagatctctatctgtacaaatcgtggttcacataagcagtatgtgcaattagtggaaatatgtcctgatgaaatcaataggcctgtttaggccttacttttcaaaatgggcactagtaacatctttgatagaaagaattcttgttgcagtacattgaagtattggttcatgtcatttctgtgcagcactcatttatcatctgtttcaaatgaatctttttggtacttcatattagcttgtgaacgtacaaaagtatccttcctatcaagtaactctagcattagaaaagaatgactgcctcttgagagttgagtgtatagcttgatttattcatctgcaacagaaaaattccttcaaaagtttttactgtatcttaaaattttgttggaattctgtattctttcttctggcatgttattgtgatttctaccttaactctttagaatccagaggaggttcaccagagttttcttgtggtttctcctttttcctgtgaatacacaagtactctcttttgagaagcacagtattgtgcagattttgctctcaatgaattggtcatgatgtgccaaaatgatgttcactcaaagtgttctgggaatcaagggaagagaattgacggctgtacctgtgtccatttgaagggcaatttggataggagtggttttggtaaaccaatgaggaaaaagaagagggtcttccaagctgaagcacagtgcctatgcttgtataagcagtgaggctgggagggtggggtgagattctaaagaagatggaaagatgactcgagatcaccttgtctgacttgctatgcaaactacagattttgatcctcatgtattacatgtattactgattctttaacattgaaagctactttaaaaaatgaaattagtgtgaaagttcaataaatactttataaagatataattatcttaaaactttataaaatttccttataagccagtaagtgaaagagtattttgataaaagcaaaaactaaacttcattggttttagatgatagcagccatcatatattggccttaacttctcattaatttctacattttgttttggtttcatggtgtctggaaaatccttattagtataaataatacacatcattttaaaagggtatattaatagtttattttgaaatcacaggacagtctcttagtaagctgatccacaggcttgaaagaggaataattggaaattattttaatgctgagtcattaagaaaatttaactgctgcttaccatgcttaccaggcaaagagtttagtttagatggagtacaccaatcattattgaaagataatattttgaagtaatctcagatatgtcaatattctgcttagtcagacattgagtttgtaaatagccatttttcctttagtttgcatgctgcgtctaaaaggcaagttctagtttcatcaaagacactctccctacaggtaacattgtgaccttgcatcaagaaagtgagcttgttcagctacataaaatcctaggtcataagcaggacaagacattgcatcgctgttgtaattgtttaggtataaagctaatacagtgcatatagggtctgtattgggaaaactataaaacactgatgaaagaaataaaaacacaataaatgaagaagagatattctgtgttcatggaatagaagattcaatattgttaagatgtcagttcttcctaacttgatcttaagattcaacaaaatctcaatctaagtcccagtgtctattttgtagataatcaataaaccaattctaaagtttatgtagaaaggcaaaagacctataatagcaaacatagtcgtactgaagaaggaaaacaaaaagttggagtactacagttaaccaatttcaggaataactgttaagctacagtagtcaagataatgtggtattggagaaatactagacatatagatcaatgaaatatatcagaaaacccagaatagacatatacaaatatagtttactgctctgtaacaaagacacaaagatgatccaatgaagaaagtagtgtcttttcaacactgcaaattagcaaaacatcatacccctctaaacctattagaatgactaatatccaccaaaaaaaaaaaatgaaagtaccagttgctaacatggatgtgacacaaacaggaattttcatttattgctagtggcaatgcaagttggtacagttactttgacatttcatacaaaattaagcatagtcttaagatactatccagcaatcacattcttacctaattgattcaaaatcttatttctgggctgagtgccatgggtcacccctataacctcagcactttgggaggccaagatgggagcgttgcttgagcccagaagtttgagaccagcttgggcaatataatgagacactgactctccagatttttttatttaattatccaagtgtggagctgcacacatatggttccagctacctgggaggctgaggtgggaagatcgcttgcacccgggcagttgaggctgcagtgagccatgatcatgccactgcactctagcctaggccacagagggagactccatatcaagaaaaacaaaaacaaaaacacttatttctgcagaaaagcctgcatacaaatatgtataagcagctttatataaaatcaccaaaaactggaagcaacccaaatgccctttggtaggcaaacgaataaagaaatggtggtatatgcacacagtggaatactattcaataataaaaaggaataaaaagaaatgagctgttgcttgtctcactcataaatgaacaatgaaaacacatggacacagggaggggaacatcacacgctggggcctgtcagagagttgggggcaagggaggggagagcattaggacaaatacctaatgcatgcggggcttaaaacctagatgacgggttgataggtgcagccaaccaccatggtacatgtatacctatgtaacaaacctgcatgttctgcacatgtatcccagaactttaaaaaaaaaaagccttaaaatagcaaaaaaagaaattagctatcactttatacataaacatgcttgagtcttaaatatatattgctcagtgaaaggagtcagtctgaaaacgctaaatattgtatgattcaaataatataactattttttaaaaccccaaaggcgactgggcacagtggctcaggcctgtaatcccagcactttggaaggccgaactgggtggatcatgaggtcaggggttcgagaccagcctggccagcatggtgaaaccctgtctctactaaaaatacaaaaattagccaggtatggtggtgcatccctgtaatcacagctactcaggaggccgaggcagaagaattgcttgaacctgggaggcgggggttgcagtgagccaagattgagctactgcactccagcctaagggacacagcaagacttcatcgaaaaaaaaaaaaaaaaaaaaaaaaaagaaaagcccaaaggcaagtgtattagtctgttcttgcattgctataaagaaacactcaagactgggtaatttataacaaaagaaaggtttaattggctcccagttccacaggctgtactggaagtatagtggcttctgcttttggggaggcctcagaaagtttccaatcatggcagaaggcaaaagggaggcaggtgtcttacatggcaggagcaggagcaggatgggggaagatgctgtacacttttaaacaaccagatctcatgagaactcactatcatgaggacagtatcacagggtatggtgctaaactattcctgagaaaccaccaccatgatccaatcccctcccaccaggtcccacctcctacattggggattaccatttaacatgagatttgggtggggacacagattcaagctatatcaccaagtctgaagaattacatgacattttttaaaaggcaaaactatagagacaatgtatgagttaggattgtacagaaaatttgaaacaatagaatgtgtctatttgtagaaagggattaattatagaaagcagctcatgaaattatgtctgctggtaaatccaaaatctgcagtttagcaggtttgagaacaggagagtcaatggtagttctagttagaaggctggcagcctggagactcaggagagctgatggtgcagtttcagttcaaagggcagcaggctcatgactcatggaggagccagtgttgcaaatgaatttttaagggcaaatgttgcagataaaatctgaaggcagtctgctggagaatttcttttttcctcccggaggctggtctttttgtctattcaggtctccagctgattggataaggcctacccacattatggagggcaaaatgattaagcatatattaaatgttaatatcatccacaaacaacttttaagttgacagaaaaaaaaaataataaccatcccagaagataaagggatcagtggttgcctgaggtttgtggaggagaagaggtttgaataggtgaggcactgagagttttttaagggccatgaaacaatgatactgtaattgtggtgtagtggattgactgatgaccccccaaaaggatgtgtccacatcctaattcctagataatgtgattacattacatggcagaaatgtgaatatcaccttatgtaatatctaatgtgttaaacagatatgtttatatgattaaggactaaggacaggtgtgattaagaattaatgaatagggcctctcatggtggctcacgcctgtaatcccagcactttgggaggccgtggtgggtgggtcacctgaggtagatcaggtgtttgagaccagcctggtcaacatggcgaaaccctgtctctactaaaaatacaaaaattagcttgttgtggtggtgcatgcctgtaatcccagctactggggaagctgacacaggagcattgcttgaacctgggaggcggaggttgcagtgagctgagatgttgccactgaacttcagcctgggtgacagactgagactctgtctcaaggaaaaaaaaaaaaaaacaagttttaatgaagggattatttggaactatctaggtgggctctaaaagactacttcagccaggtagtgaaggtcggcatccacagtgataagtcatgttgttagtatacgctcttgctgtggtatgatgtaaatggcactttacctctctggtttccctccccaaaactcatagactcagtttataatcatgaaaaaaaattcagacaaattccaatggagggacattctgcagaatacctaatgactatttcgtattaaaactgttaaggtcctataaacatgggaagtctggtaaactcacagaacttagaagatgaaggagatatgatgtaattaattttcttggttgggaacctggaacagaaagaggacattaagtaaaaactaagtaaatctaaataagtctgaataaaatgagtttagttagtaataatgtaccaatattggttcattaattttgacaaacataccatgttaatgtaaaatgctagtaagaggaaatgctatatggatatatgggaactttgtactatctttggaaatttcctgtaaatgcataactattctaaaaatttatttttacaagagcctgtgtacatgcaggcctgacctttaaaagaaaaaaaaagtacaaatttcctcctaagttgtgtattagtttcctacaactgtttatcaaagaaccacaaactgggtgaattgaaacaacctaagcttgttctatcaaagttctggagaccagaagctcaaaaatcaatgtgtctgcagtgccatgctctctctgaagtttctagggacaatgctcccttgcctttttcagcctctggtgactcctggctttccttagcatttttgggcttccagatgcatcactccaatctctgctttcatcttctcatgttcatctttcctatgtttctgttttctccttttcagattcttaaaaggatattcatcattgaatttagggcccacccaaatctaatatgatcttaagatccttaattacctctgcaaagagccttattccaaataaagttccattctgaagttccaggtgttgacatctgtttcgggacccactattccacccacttacaccatgccatatccataaagtgttcaaccatctgcatgaactgggcaaaagaagccttcagaaaaataatctacagtacaattgagtatattattagtctgccaagtgttagaattttcttaatgattataataataggtaataattattgaactcttactgtatggtattcactgataagcatgctctacatatattctcttttaattttcatactgcggttatccttcatttgtaggtgataaaaccaaagcactgagtagtgaagaaacttgcctaaagtcatacagctggtaaatttcctcccagtgttaacagcatttattgctattaaaactgctaataaaatgtgtatcaaacatttgcagaaattctgaatccttctatggaacctgaggattctactttaaggtttaaagtcatgagagagagaggtttacattgaaagagttttcagctccttggtaagaagttttatcagtctcttttgctgaggggttcttgtgatagaactcaatagtgctttttcaatttataggatttcaggtaagattccacctccgttatccagctatcttctaatatactcttatcttctctattaaatgtttctctctgaaaatgatttaccttcttattcaggcttcctcctcagtagaataaccccaaactcctccccacccctatacatgcacacatgtgctattttatccatttaacttgtgtcttcccccaaagacttaaaaattccttcttaataatgtaaaaacttataaactctgctacaagcatacgtaacatttctcgaggctattaaaaatatctagatgtcaggtaagtgtatatgatgaagtaagtgattcaaatagaacaattaacagatggcagcaacaattatatattcatattcctggccaacagcatttggtagatataattaccttacaggtgttaactgccctttatggaatgagacatctctgaacactagagaaacatggttaacgatggtcacaaatcagtaaaaattctatattgactcatttttttagacaagaatcagaaagctaaattcagtttttggagtatagtgctaagttcagaaaaagtgaaacttaaacaggagagcaggtgtggtgtaatcttcaagttgattgctgggatggggaaaaaaaaaccccgcacattaaaagacatttaaaattcactcaacatttggaaggtacagagtccaaaaaggcaatcatttagggagaaggaagcagctgttttgacttattcctttgagtttctttaaattaccttagtttcatatgcaaaatagtattaacatgcttttttcaaacaaaacttttctgtgcagataagtttgtacttatgtttctttatagcctttagattattatactagaatgaggataaaatataattttaatgttactgtttataatgtttcaatcatttgaccagaaatatttgaaaacctggatagcctcacacacacacacacaaattacatcattcaagtgttgtcattttacttttattttctcctgtgaacagtaaatatttgtcacttccatttaacatttgtatcacttgcagctatctgtccagggaaatattaaatgactatcagtccctactgggagtgatattgtctgattaaaactaaatttcctcccttctgttctacattggagtcatctctaaatctctgaatttaagctgtactcagcactataatttaaggctaatttattttacctttattttttaagttatgttttcaaagtttttgattttgtagttttacatagtaatagttttacaactattttgtaaagctcttgaagttcagcatgcctcttctcaactcttatttattgctgaataatagttattactcaataaatattttgattgattaataaaaacctatttcaaataactattttctaaaattatttttttctcttccaattctgaaggaaaaaaaggtaatatacagaagtgggttgttatggggaaacatgtttattgtgctatagtcctcttttcccctgtaatgaaaagttaggtttttagtagtagaaatgtcattttagtgaaatatgccataattttactttagcgttatattccctataacaattgaaattaagtacatgttgaaatacttccttaaaaaaatttaaactggagtttaagttttgacttctttgtctaagatattctccaacacacctgatgtttcattttcttctttttcttgtgcagttaagaatattatacttttctgcctttatcatgattaatattcaataagtaaagaaatttttccataagcaatacatacataaaatacaaccataaggaaacacttttaatcttccctggtttctggcttatgagtttggtaattccttagcatttaacctttgtcacaaattgccatgtggcagtgtgtatgctgtctttttgatagatttccagtagtgggattactatattcaaaataaagagcctcaaatagagataaacatttatgtttcatgatactctcgttttagattggaaacattcagaagtttctgaggtgagaattgttaaaagaagaaagctgtcctacatagaatacctttaagaatacaatttttacatattatttgaaacaccaaaattattagtagtaatataatatcaattctaatcatgtctataagaatagatttgcataggaaaaactagaattgacatgcaaaaaattaatattagtcgtgcttgaaagtaggattaagtttaaaattatataatgataacaaaatattatcaaattgaaaagttacagggaaattagttaacaacatttctttcagttaactttttttcagatttcattggattacaatggaatactgaagaatcagacttcttcctgaaacactgagactggaaaaaacatttaaccttatttttaatacaaagagaaggataggaactattttgtgtggttgttgtaggaaccaaagaaaatgacacataaagcacctaaataattgcctggtatatagctattgctgaatacatccaaactttccttaatttttaaaatatgtccatcggttcatttgaaaatagagaatatctagcataaatatttttgaagctattctcctaagcattgcagttactggttttccattatacttaaccttatcatgatatcctggagttaatgtgaaaggagaagtaaccatgattgagaaacctgtatacaacagaagtctttctcttttgagacaaagccaatttggtccttgagtaaatttatttttttagctattattttatcagagacaactgtagcttattcctggaaataactggcaaagtcagcagcactattagaaataaatcctttgagaaaatattttcaaacttctattatataattttgaatttttcattacacctaaagaagtttgtgaaatatgttttagcaagaatgtcaatattcaaaaccttttatattttaggagatgtttgcattcttcattggagagtaaaattgggacttaagtaacaatatctaatacaattcattttgatctttgaaatttaatgtaaagaaacaggaatcaaaggaatgtaaatttaaaaaaaaaaccaaaaaacacatccatggcttgtgttgtttgttatttgtttagttatgtttaagtttttttaacttatgtttttaggtatgtttttattactggagagaatcaagaccctgtaaatatactttactagcttagattccatttaattactagattatatgttatttagccaataggtgaaatttaaatttacgcatgtcacttagtatcttcacctggcttttcagaaacagctgatttatgctattagagcatttaaataatgtttctcactgttcttttcaagactaaatggaagctcacctgagagaaatgcagtaaatgaagtcaactggcagatgttctatgggaaagaaagtgctattgcagtttagacttccagtgttcagaacttccgaaaaagttttttacaagataaacctaaggaaagtgaatgaccaaggattaagaggaaaattttcttctcagattaaaaccatagaataaataggaagcagctgagaaatgtgtggcagatttctcaagtggaaaaaggttaatgttggggttgccctcaggatcaattttaatactggtagcatgaaatctattaatgagtcagaaggcaagctggagatattttgctgatgtcatcattttgtctcataccagtaacaagaatagattaagaacatagctaaaagaaaaaccacatttttaaaaaaattcagaggtcattataaacaccaaactcaaaacagtcctttccaaacatgtggctttcctgtgttcatggttcaaaggaaattgttaagggaaaacttctttagttttattgttaatgtaaaaagtggtgtgtaaaattcagcattcttcctgcttttctgaattctacgtcctgtatttgtcagcagaagtggccatattagagaaaaaatatgtgcatgcatagtttcttccaaaattgggattggatggctaaggcaggtgccagggtatttgtgcaacacagacacgccaccatgtaagtccacggtgacctagctttgttcccattaggtgcaaatcatgctatagatcccttcaccaaaaactctgatggatagaagagcaaatgaagttatttgagtcataggtcactatgactattatgtattggtattattgttgtttgcctatgagcatttcataatcaaagaatctttgcatgatgagtgggtttcttgtgttttccataatgaggacgacttcttgttgagtttgtgcatttattggttcttggatcatgtttatcctgtcacaaaaaaatgaattataaaatacaagcatttttaacataacatggtccaggcacagtggctgaagcctgtaaccccaacactttggccgacgtgggtggattgcctgaggtcaggagttcgagaccagtctggccaacatggtaaaaccccatctctactaaaaattcaaaacttagctgggcatggtggtgggcgcctgtaatcctagctacttgggaggctgaggcaggagaatcacttgaacccagaaggcagaggttgcagtgagctgagatcatgccactgtactccagcctgggcgacagagtaagactccatctcataaatacataaataatatgaatatttatatcctgaaaactaggttgcataaaagaaaagctgtgcaaatcttaattgataaaaatgaattaagctggagactaaaaaatacagaaaactgcagcatttaaatacagcagattataaaatgttatattaggggaacaactatttttgttgccaatggattcaaacttactaatttcagattcttctaaagtttatgtcgtgcgattgtaaatgttatactccttgcggaagcattacctaatcaatttgatttgccccattgttattgaagatatattgcttagcactccaaattacaatctctctaacactaacataggaaaatgcttttcaaactgggttttacagaacttatttcttcctagaggagctttagggggtattgaacgctgtaatccataaatctggaattgacatatccttgttcatcaacatagatttgctattcccattaattagtttattttttatttttattttttattttttatttttttgacagagtcttgttctgtctcccaggctggagtgcagtggtatgatctcggctcactgcaacctccgcctcccgggttcatgccattctcctgcctccgcctcccgagcagctgggactacaggcacccgccaccatgccctgctaattttttgtatttttagtagagacagggtttcaccatattagccaggatggtcttgatctcctgacctcgtgatccacacgcctcggcctcccaaagtgctgggattacaggcgtgagccaccatgcccagcctattagtttatatattaatgggaatattttgaaattaggtttcagtaatgacaattttgtctcttcataaatgattgctcaacacaagatcttttctctacctgcattttacagatgaatgaattgaggcttagaaagattacataccttgccaatgttcacctggttattcgtggatccagattggaatataacaaattccacaactctcctctaatccactgcaccatattgttgattgctgatataggtatagggatgtggatttcctttgcagtcttagaaagaatagattatttttacccaagctttggattcttgtctctttggttgcaccatgtcttatctgccaaatcttatctgtccctctttggttgtgacacatcttattgttgaaaaaattttgtgaagacatctgatttttccagagatatatagttatcaatatattcacatgtatctgtagcacgatgttttcataatccaagaataaatcaaatggcctgatatttcaaataagggtcagattatatctgtactacatttcaaatattaagtatagataaaactaattaattctaaattaaataaagataagaagcatagaaaattcatttctaagaggttgtaggtcctaaatctaaatttagataatactgtgtccctgttaaccttaatccatccctgaccagtaactgacattgtaaataaaaggcagattagaccatcaagtatagaagatataattaggagtatcaagtgtaacagaagtagaagaaatcttgtaaaatgtaacaaatgattgagataagctgtgattttcacatataagcaatagtctgtgagtagttttggggaggaatgttaaggagggctttagtgaggattcagggtgaagtggagagggtgtttacttgtgaatgtataccgctctgtgtgttgattttgcagataaaaaacacattttcaagttagtgactagtatgcattaaatatgggagagtaaaagaaggatgtatttaataggaaattcacttattttccatctgtatctgattatcttaaaataagacttgttcactgtaataccatgtgaacattaacattcaggttttaattataagttataaactaataataaaatgtatatcatatattactttttgaaatcccttttatatctgttattctaagtcatttaaaccttgaaagcttgtaatatagggattagcattcccattttaatgatggaaaaaagcatctataaaactttagtgtgaaatttatctcttcactcccttaattactcttatatggcttttattatataccacttgcttcctaattttatttttatgatcagctttttataataaaatcattactcttgtggctgtatacctgtctatatgtttttgacattctgtacatttttacataagtgtctgtttcagttgtaccaaggagacatgtgtgggaaagtggagaaagggtgagcacttccaattttatatgtggctatagaaggtacatttcctagaacacttgctacagaagtgggacattgcttctgaatgtcctacatgtatgagccagaggatcctaggggacatatgtgtttgacttagaaaccaagagtaaatgactgtgtccagtcaggtatgctgagctgttcaggctggctggagacctgtatgattttggggtatggtgctgggtgcagtccagtagctggaagttggccagaatgccaagtgcttgatatatgtcctgggatgattggcattaccttgaatgtgacagagagtagaggagtgacataatgggattgcattttaggaatatcaccctgggggactgtgttttggtttaattttttttttaatcgcagaataagacacatgtataaacaaaagaatggctgaagaaaaacaaagtctgtgatacttacatatatagcacaagttgacataaatgccacttatacctgcctttctttttgctcctggcatgcctttatttcagtggcccctctgggtctgctctgtctctgggtctttactctgagctgtatacctgtaatatgttttgctctgtgtccccacccaaatctcatcttgaatcataatccacataagttgaggcagggacctggtgggaggtgattagttcttgggggtcgtttcctccaggctgttcttgtgatagtgagttcttgctagagctttttttttttttttttgagactgagtcttactctgtcacccaggctggagtgcagtggcgcgaccttggctcattgcaacctccacctcctccctggttcaagcaattctcttgcctcattcttccaagtagctgggattacaagtgcatgccaacatgtttggctaattgttttgtatttttactagatacaggatttcaccatgttggctaggctggttttgaactcctgaccttaggtgatccgcccacctccgcctctgaaagtgctgagattacaggcatgagccaccacgcctggccaagctgatgcttttaaagtgtggcacttccccgctcacttgctctctctctcctgccgtcatgtaatacatgccttgcctcctcttcaccttctgccataattgtaagtttcctgaggcattcccacccatgcagcactgtgagtcagttaaaccttttttcttcataaactacctagtctaaggtagttctttacagctgtgtgaaaaagcactaatacaatctggaatacaccccacaaacctctaagtaatcaactcctgcctcttagccttcaaaatgcaactcaaatggtctttcttcaaggaagccttacttgatgccttattatcaatcaaggctttcttgttatatgttgtcatagttctttacagttttcttttataacattaatcacagttttactcaaacactgttggataccataaagatacattctgtaattaaggatagtatatatatgtgtgtgcacttatgtatacatgtgtccgtgtgtgtatactttgtatgtatttagaggactgtgacttcttccttgtgaggtgttttttaagtacacagaagcatttgtttactgggatttgaaaatgatcttgccaaggcaggagaattggtgtttatatttacaactgtctttcaatatacacaaggaattggttctgggacccccatggatcacaaaatctgcagatgctcaagtcccttacacaaaatggtgtaatattttcatgtaacctgagcatatcctcctatatactttaaattttctccacattatttataatacttataaaatgtaaatggtatgtaaatagttgttatactgtatttttatttgtattttttaatttttttccaaatattttcaacccatggttggttgaatctgtagatgcagaacctgcaggtattgagaactgactatatatatgttattttatatatataatttcttatatatatttatgtaatttataatacatgcttatattagaaattatgtatgtgcacaaagcaacaactaactgttaacactggtataattctttcaagtttttttcttctgtctgtgtacatatgtatattctatctgtatacagttacttggctcaataccatagatacattttgtgtctgtctttgtataactaatatactgagaattttctggtgtaattagaaacaaagggaaggctgatagaactggaggcgaagagattagttaggaggctatgtcattcctcttgatgaggtctcagaatcgtgaggatggataatttcagagtaacaaatggcaagatttggagttttatttgatgtaagtgtatggaagagaggaacaactatcatatgcaggatgactctcaggtttgagtaagtgagtagatgactgtagaaggaagaatcctttggaaaaagagataggaaagatgaattcagttaccgacatgagtttgagttgcctgtaagaaatcaaactgcatttacccagttaaccaggctattctaattcaccaacaaagtgaaagcaaaagaatatggcctctgaactctatgtgctaaactatatttagcttccatgttcggaaagcttagtgaattattaagggggattatgactcctcttcccctagagatattttgtaagtacacacaagcatttgtctgttgtgttttgaaaatgaacttgccaaggcagggcaattgccagcccagacaacctgtcaagagctcttccagagctctgaaactgtgatacacttagatttatgtttcctctgtcacatgcttttattgtaccacagttttcctaagtgttttccctttgctgagcaaataagaattcattgtaatttactaaattgtgttctctccatcctaaaatcaaatgctgagatctcatattaacataaaaagtactgatgattcaataccttatttttctttttaatgtctttccatccaagaaagttataatattcacttaaagaaactgtatcatatgtactagccatgcatgcagtttttacatatttttacctatattttccattctctttactaaatttctctgcagtgtgattcaaactaagtactgaagtaaatgctagtgtcattaaaataaaatacacattaagaatgctatagtaaaaagtttggatactaagtaaaagtcagtttctaaaattaacatatttgttgagcaaatctgtaactagccctcacaaccagctctctgtcttatcaagatttagtttgctattcatgctcagacatggatagtaagagtggtaataacattagaagaataaattcatgaaagctgtaaaacctttttcagcaccctcccctccatcttcacaggtaaaattaagcattcattcaatcataagtcattcacagatacacctgttatgtgttagatatcatgttaggttctggaaatataaaaatagaaaagaaatgagaagtgccctcactccagtagtagagacaagcatataaactgatcatctaaaaatgcgagatccatacccatatcacaaagcattataaaggcatctaactgagcatggagaagatatggaatcaaataaagaatcctggagagcacctgagctgagtgatatcaaaggataattaagaagagttagccagatggggtggttgggtgagagagagtgactctcatggagggaggtgtgttcctataacttagaaaacccagttataggtacattttaagtaagcataaaactacatttccagataaaaatgatatttgtttcatatcagaaaaatgatgtaaaatagcaatttttactgtcatttgtatgcagatttaagaggaatattctgagatacagtttaagttctacagctagtctgttttttctcttattctttatttcctctaacttagtaaatacttccataattacaggtcaacaagaatgatctctagcagatatttagttactggcagttctggatgtttggatctagggttaaaccagaaatagtgaagagatgttttactggaaagtacttttggcaaactgtcagcgtctaagttggcaagcatgtctgactgaaaagctagaaggttaaatgtattaacttaggatataatgataaatagatttttacatggtctttggttgcattcaggagttgaaatttgttttcatatttggttatagcagtggatgcatttttaaatatgcctaccgataggacatcacttgctttctcaaaaatatagaaaactattgtgatgttgttgtagattagagttaagcttgcaacaattgtgtcatttgaactgccgatcctcaccatcagacgtggtgatatgtaggtcctgacagtcagtaaattgaaaagattgctgaattggactatttgggcacaccacctgaaataattcaaatggtcttaaatagcatttgtgtcagcaaggaatgtgttaatctcaaccttcattttgaaaacccatgtgagcttgtttccccttgagagtcaacatacttcagtttggcaaggcagtcttgcattcattcctcattttttcactcaatacactgaaaatatatggttatattcactgtttttgatcattttcttcaacactgaatcaagctcagacagtactgtgcttgactcttggctcttctcaaatgaatgaaatatctatattgacattttttttttttacttctatcttcaaagtgccaactttcccttctgcataaatatctgtgctcctctagtgttgaatccacctgcatatgtagtcctagctctatggggtgactggtaccaaaagatatggagccttttgccctgaagctgattctgcacatctatcaagagcatatcctctgcacattaatggcttgttcagctgttaaatgaaacgtcggctactacttccaaaagacagggattgataacttttccacattgtatggctcctctaccttgacattagacaatgtctagcattgttcattgatgtagacattttgtaaatagggtgtcctgattctttgagtgcataatatttatcattaattttatcaggggccaactcaaaagtagtgttgataggttgggcatggtggctcacacctgtaatcctagcatttttggagaccaagatgggaggactgctcgaggccagaagtttaagaccagtctggacaagatagtgagaccctgtctccacaaaaataaaaataagtagccccaaaaaataaaacaaatcaacatggtggtgcatacctgtagtattagacactcaggagactgaggcaggaggattgcttaagcccagtatttccagattaaggtgagctatgattgagccattgatttccagctagggcaacagagcaagagcctgtctctcctcctccccccccaaaaaagtagtgtgtatacacttgctttacttatgagagaatcaattgaagtctctgttttttcatcctttctcattttgggggaataaaattatcaattatatcatggaaaatgttttgttcttgttctataaacagttgtttgctttactacagaggttactgggcttgttttgaaaatggtgaaaaagtcaatagatttagcccactatttcaaaatattttattaccaacagttcactgagctctaggtatgaatggatcaccagtataagaaaatccaagttttcaagtatttaagttgtgcttcctttcttgtctttctatcactgcttgttctagcacaaagagattcacattatattttgacactggactctgtcgttatggtaaggagctagcttatgttcattaccatttttagtcttgatgaaccaattctgagacattgatacctttttaaattgttgtcatatagcaagaaaagagtattaagtttaaaaacacatttaacatatgtaaataatgaatacaacttaaaaataaggtagataagacaactgtatcagaacaatccttgtgcaggtgtgagccattaataatgtaacaattattaataatgtatgtgggttacattgaaaatcataattaattttacatttcaaacttttgaaacttgtaaaagggcaagtatgacaagcataggactcatttagaaggctgatgaggctgttcatttgcattttgctactctaatattgttttacaagctattgttttaacagtataaattaaatataatcattgacacatggtagttttttttaaatgttcttggaaattatcattctgttctgtgtattatgagctaaatgtttgtgttcccccaaaatccatatgttgaagccctctactccattgagatggcatttggaggtcagagtttggggaaacaattaggtttaaatgtagtataaggatgcaacacctgttatattagtgtccttatcagagaaagagatgtgaactagctcattctctgtcgtgtaaggacaaaaatagaaggcagctatctgtaatctggaagaggtacctcatcagaacctgcccttgctatcaccccaatctcagattcccagcctccagaactgtgagaaatatatttctgctctggaaaccacccagactatgatagtttatggaagcccaagcagaccacaacactgggaaattctttgtatatcattacttacaatttccagatttttaaatgtaaactctgtgcagtgttaaagagaatattgtttttgcatctgtcaaaactgaatttgaattctggccaggtgaagacaggttatggcaaggtacctcaccagaggtactatcaatacattattcaatcccctatcagtaagttagtcaatttcctcttttgtaaaatttagcaagggaaatctgccatttagagttcttatgggtactaaatgaaataatatatataaagctttttccatggcacatagtacgtaccttgttgcctctactctctttttctgcactaggtacaatcaacagtcaaattttttcttcttttgttattttattgcatttttattgataatgtcttagctattttttattcactaaaatgactgtattagcttgttattttagcgtcatatgagggaaacactaaacttagtacgatttttaaaaagtcaatacaaacactaaaacaatgttggcacttaaagaatgtgctttaggaataactaattctgagtgaaatttgtgtgtgtgtgtgtgtgtgtgtgtgtgtgtgtgtgtgtgtgtgtgtgttttgctatttagggatttggtttgtttttggcatggcctgggacataatcaaatggttgagagatcactttctgatccatgtaaaattaaaagcaaattgcaatgatgagatggttgacaaatgaaaagaaatatgattatgtcaaggagaaaatagaggcctctcgtgacacagtccttggcatgtgcccatgtaggggactgctgtcttgctcatcaggaggtgccatctcaattatacctctccatgtgaatccttgtccaatgatgcagatccactctgagagagtcaagttttctattagagacacttgaaaatcttcatctctcaaattgttacaagtattatgatttaatacagatatttttgttacatttttaaaagaagtttgatgacatagtatgtatgtaacttaaggcaaattgatatacaaacactttttctttattttaactttgatgaaataactgatcattcttttacttaaaattatatgttttttactcaaatacaaataattttaaagaccttgaagaaatacaatttatttctccatcactttttacattatacagctttgggctagaggaattaatacattattctgctttaggggaagtgtttcaaaatatttttaaaatatgtattcctggtatacattatgccttggtgcatcagagaattgaattatagttttccttagaaaatgtatacaaacaatgtgttctcaaagcatgtaaaagaagaaaaggaaaaggtgaaactgtcatactgtaattgctgagtaccacattttcatgattttcttaaggccttccatttatgctataaatttcttctaaaaacaaacaatttatatacttatatattatataatactatatgagataaacatgtactagcaagttatgagtagcatcagttgttgaagtataattacatggattgcttaattttggttatttatcagaatgtattagtaaatgtctagctatgttgtcttgtatttaagacaaatcattctaatttcagaacaatccaaaaattagccaagtggatatttctttaaacccagttttgaagaatttatagtaaagtacctctgttaggccctcagatcatttatacttaccaaattcttttttatttacctttacaaaaaaatactaaaatattccaagaaagaattaaagtatattggaatgttataaatagctacagtttgatcatgacatttgggtgctagaaatgtgcttgagctctcatttatattgaagataaataaacgactaaactttttaaacaattctccccatagttttacattcaaaagaattattgaaatattcagtactaatgttaaatgatatattgagaatttcacttgtagataaaaagacagtttgcattcatgtatgaaaatgagtgggtaggcccaagggatttggtttagaggaaaagctttgtgtttagcagcattgtctattcttttgtgtagttttctatatgtcacacttctattagattttagtgcttttttttttcaagttagttgtttttcctagcgctttacacacacattttttcaagcacctgaaaatgggcaaagtaatccagaaatcatgcttttttcccaaaattatttagcttgacattttgaaaatcaaaactcaatgcttttattttctacagagggagtagaagatggataaacagccaaacacttaattgggtttggggaaagaaaaagaaacaacaacaaaactaaacgattcttcccaaaactctcaagggttttatttttataagtgataatgctagtggaccactaatatacaactacaataaagttaataactacattttattcataaagtttgccaggtaattttctatgtactttctattatcgcatcttattttatccttaattcaactctataaggtagatactagttttttgtttttctcatttcatagatttgggaaggatgtctgtggatgttaagtaacttgcactaagttacctgtagtctgattccacagcctgttcactaaggcatttcatatacatgtatgaccttttcagcaatggagaaaaacacatagaagccaggaaatactcttgtgaaacttgttctaggctattatcataatcggagtggtaaaattaaaagcagtgtacaatgagacttgatctccagaatcatagaacataagtggcattaaactcaaggtaaatggtaatgacgcaggctgtaaaaactaactccttaggtctccatgtgaatgaaaaagatgtttaatgtgcattaaatggcagcatctgttctagagtgtaacctgaaaaaaatcagttgtttatgaattaaacttagttagtgcagggcatctgatttttaaatgggaatatcaagtaacctaagacaccaaagatctgttcttcctatgctatgaaagtaacatccattgatttcagtaattttctttctgtcttcatgagttttattttgatattttatgctcaaagcctttagatttcgtaacacctcctttagggtaaaattgtttaaagttaatatattcatcgctttcttactctacacttagcactgaataagaaataagtgaggtaaggccgggtgcggtggctcacgcctgtaatcccagcactttgggaggctgaggtgggcggatcacaaggtcaggagatcaagaccatcctggctaacacggtgaaaccccgtctctactaaaaatacaaaaaaatagcagggcgtggtggcgggcgcctgtagtcccagctactccggaggctgaggcagcagaatggcgcgaacccgggaggcggagcttgcggtgagccgagatcgtgccactgcactccagcctgggcgacagagcaagactccgtctcaaaagaaaaaaaaaaaaaaaagaaataagtgaggtaatacgtttcttgccctagagaaacttgctctctagttgagaaaacaagagaagtatttgaaagatcaagaaacaataaaaggcaattaaaaatgaatatcattaaactagtttgatattcatgatagataaaatgttttaagtactcttcagattttcatctttatgtttacactttcttctgtccaagacttttcacctttggaacatttcaaagtttcacaatgaccttttcctctcctctcagttgatttcaccaagtaatttgacatttttgttattctaattaatatttttactttgcttctttagcattaaaccatgttaagggtttttctagagcattaccctggtcagttgtttaaatctcattttataaagacattcagacataagctttcgttgatggcttttctgttaccgaagagtaaccttcaatcagtaaaaatgtgtaggtcacttatatgccaggaacttactgactaaagaatacacaatgatccattctatttattcagtcagttatttatcagctcaaatatgtattgagcaatgattacgtaccaagtattttagtatggaaagacagaatataggccgggcgtggtggcttatgcctataatcccagaactttgggaggccgaggcaggcggatcacgaggttaggagttcgagaccgtcctggctaacacagtgaaaccctgtctctactaaaaatacaaaaagcccggcgtagtggccagtgcctgtagtcccagcaactcgggaggctgaggcaggagaatggcgagaacctgggaggtggagcttgcagtgagccgagatcgcaccactgtactccagcctgggtgacagagtgagactccgtctcaaaaaaagaaaaggaaagacagaatgtaatgaagttaagtaaaatataaatgattttagatggcaataattgcttgggagaaaaatgaagaagtaaatggatatcaaggaaagcttcattaagaaggtgacatttgaataaagccttacaggaggcgaggaaaggagacacatgaatatctggtagaataacattctaggcagagagaaaagcaggtacaaaggccctgcttgggacaagaagcgtagctggcatgtttgaacggagcaagcaaggctgagtagtaggtgctgaggtcagtgcaggtgagatggtgtggggagacaccatctgcaggacctggccttccactcctactgtgattcagatgggaagtcactgggggctttttcaggatccctgtaacaaactgtgggaagacaggtcaaagaggaagcagggttcatttgatatggtatggagagtttcactgattgcagccccaggtgataatggctaaaatgaaataaatagcattggtggaagtcatggtcaagtggacagattctaatctaaacatcatgcagggggaaaaaaagaattgtctgatgaaaaggatgtgatgtgtcagattgaagtgggagagttctgtgacccctatcgcaggatgttcaacaggggtgtggctcacctgttcagctgaaaccccttacaggagggggaacatgcagatgggcaggtgcaggaaccagggtgagcacttttgggctctagccccacagtagcaactaggggtgggtgcctgtgactcctgaagccccagtgggtatgttacagtgctccttatctctgccatctgcagatggcttaagtgttaatcagctcagtgccttcttggtacccgggtctttgtctggtgtccaggaagaatcaggtcacacaaagacttgaaggatggtgaatgagggggttttattgagtggtagtggctctcagcgggatgtatggggacccggaaagggggtggagtgggaagatgatcttcccctggagtttggctgtttcacggctgatctcctctccagccttccccagccaagctcctcaacatttagacactccttgtcttctctccttctctgccgctccactcttctgttcctctgttcttctgctcatctgctcaaggaacctggggtttggtgttaatatgggaagaggatagggcagcatggcaggccaaaaggcaacatttgggtgcaaaaacaggaatacctgtttccatttagggccacgtgtttccaggcttgagggtggggcctttgctggggaactgccctcttctacccagcatttccctgcctcttgtctatatcaagatgaaggaaggcctttggatgattctcaggtttttgaactgaactggagtgactttactgagataggaaagcttggccagggaacatgctatggaatcacattagctcggatttggagattttgtttgagatactcattagaaaattaagttgaaatatttggtaggtaattgaatacatgagtctggagttcaggaagaggtttagctggagattaacattcaaaagtattttccttccccatgcacactttcttccacctgggatgaatggatatagtagtagataaatacggcaatttgaatagaagttctttcctgtctaaaatggcagggaagattttctgcaaccctattatttctgaaggtccttcataccccctcactttacaatgaaagcatgtagtcatgttttggaaaagaccacatttgtaactcctgtggggacacgccctatttttcctgtcttaagacttttaaaattttatttacctcttttttccaacagtgctttgactttattacattaaaataaatttacctgcctgtgggccttcacttttatcacacagtgagttatataagaaaaggagtcatgtcttattcacctttgaattctaagcaagtgatctggcctctgtaatttcttgctaattatttgataaagatacttgttcttgacatttaaatggctactaggcaactgatcttggagtttattctatatttttaaaatctgctatatattgcaaacatattagttgcttgttttaacatttattgagctccatttcttcaagactcagtttacataaaccatttatctctagagagggcatacgtgttaatataggaggcccaaacacccaaatgaatggaagacatgatgcattaaatgctttaataaaggtacagattaaaacattatttatcacattgttactttgtcagacttcctgaccaagctgtcactgaaagaatagtatattccaactctacattgaagtgtttcaatagggagatcaatagtggggaatgtattctgattagatggaatgaaatagataatggtacatatgttggacagtgctacattagttttggtagcagatgaatacattggcaggagtatagggcattgggagaatacatgagataaagtggcactatgtgttagaagatctttgggctctagggcaaaggcattttactgtattttgttcatcctaggaaatctctaacaattatttggatgtgaacaggttatgtaattagaactgtactttcaaaggtctagatgaaaaatacactatgaatattaatggtagcaagatttcctaatagttcaggtgagagaaagttaggacctgaatgaaagaaaaagacatagaattgctagctattatattaaatgatgtattaagtagatgtggtaacagatgaggtactatgtgggaaacagaagagccaatgatgtctttaaggttttagtctggaaactaacatccttaatagaagcaggaaggttagaatgaggtgcttgtggaaaatgatgatgaatcttgttttaaacattatattagcatccagatggaaatccacaggcagtttgaaattcagagccagaattcaagagctaggttggaactggtaatttagatttggatgtagaaaaaaatgtgaatactaagttagtatattcacagaacaaacatgaaataatctcccagttcttttacacttttacacacttctttgtttactattcttctgtgaatatttatacagattagaaccttctacataatacttcaaaatgtagccctaccaggacatatttatggaaacaaaggaaaccagtcttctaggttgtcgtttctatgtgttgttaacattttgtgatttcctgtggaatggaaccctttgaaaatagtagtagattttaatagaaaatatcttaattaaataccttgcataaagtatttgagacataaattacttttttacttatacaatttaaggagattttattttcttctaaggccactataaaacacactggaacatttgactaaccctgtagactggctcgagccagttcatgctctaacacttacttttgaataccttttcaaaagtaaagaaatgaattatttaggtatatatcaagaggaatttccttttatttatttatattctatgtgtcttcatatataggagttattcagctctgagatataatcaattagaatattgaaagagatttcataggaaacaaagatcaactaatgttcaaaaaattacaaacatgaaaagagaaaggtgagattttgacactggaaaatattaggctcccctaatgtttcagtgtatggatgtttattaaaatttttctggacaacctcagtccttaaaattactggacataaaatatatagcagcactatgaaagcttttaaagtgagaatattcataaggctgagtttgctatgattttaatagtccctaagttatttcctaactttcaaatgaccatatttattctagtaatttaaaaaaatttgtcttcattccattatctcaaaaaagatcatgactcttccattttaatatgttctcagattttccaggtagaagtgaaggagttcattattcttatctttgtcaatttcctaatttacaaatgagctgaagcaattaatccttgcaagtcgcctgtattaattatagtctaaggcaggtttatttgcagttttgtaattctttttgtcacattttcactgtgtttactatctcagcttgatgcttgttgacatgctgattcatgttttggtgcactagataggttttattcatctagaggaatgagtataaagaggtcacaccttataatcacactagcatttctagtatgtgcaggccatatatctccttttaatttaatctctgaaaaatgtacagggatttctgcagctaagctgtacaaatcaataaaatttataatcaaggctgtctaatctctaaacctaatataagacttcacaactattgattatatgtgaaggatctgcaagctgttaatcatgcatgaaggcataaaataaatggtggcttcagaaaaggaaatggacaaataatcatcaaccctgcagtccttatctgtctctctattccctgaagcaagcatgttaccagacacttacattttataaaatcaaatgaggtgttaaagtgtgtatcaatagtcatgctgacttttgtatattatatcctgtttctattataatgtagaattgttctctttatcttccagatgtgtgatgaaaagcaaattagtctctctaataagtttctagaaggaaagaaggacctaagttgatgtgttaaaatcataatctttctaaggaacaaaatgagaagaacatacttggaatatcattataatgtaattgtaatgatttatttgggggaggggagaagagctccatgtcacgagatagtctcacttaaaactgggccctcttagcattttattaactagtatacttcatgatgattttactagactgaattgactgaccaattcaaggggagatataaaatatttacaagggagttatgtagttgagaaaaacatgtactatttatgcacctaagcagtattagagggatttggataaaaaagaaaaaatatatatatatatatataaatgtattattttctgtcctattcagtcaagagtaaagaaattccaactaacagattctcttatatatacctacaaaatcatattgacataaaaaagttaaatttaatcaatgttatattgcagtgctggaggggtaagttactggtaacctactacagtttgtaataaagtattgatatgtcttattatttatagaattattattccaatatttagtttattattctctgtgggagtgtagtgaagaaattaacccctcctcaaagagcatacagcaagcgaagacaaaaatatatccattaaaagtcgttttaaggcatataccatactaccgtggtatctgggacatttaagcacttaataagtgttttctattattaaaaacaggatgctatttaagttcagcacaacagattagtatagaaatgcaattcttaaattactgtactattttagtgtagatatcactgatagaatcttcacataaatattaaggtaatttaccgaatgaagatattagaaataatgcctgtttcaaaatgctgagtaacaactaaccacaaactctcatcagtggcacagagcaggcacgtattaattatacttgtgggatggttgactagtagcctctgatgatcttggctgacttacatatccactgatggactggctataggttggcttctgctggtacgactcgggtaacttggctctgttccacatgtatctcatattctagaagaggtatgagcaagcaggagaacagaggactttttgagatataggctgacaactagcacacccacacttttgccttattctgctgaccaaaacaagtcacacagcaaggccaaaatcaaagcatggggaagcagaccccatttggtgtgagcagttgcaaagtcacatggcaaacagtgtgacaacaagaagaaatgaataattggaattatttcaactgccacagagaactgggtttttaggtttcattttcattagcttttaagcttgaaacatattgaaactacctgctttattgttcagaaaataaaaatttccaaccatatactatggatcaaccactgtacttggcatgcaaaatattacctcatttttcagaacaacataagaggtaggtaatttatcttcttttagggataaaggaggcattgaaaatcccccttagaattttgtctttgctatgtacagctcctctaaagtcaccttactttttacactgtatattatgaagcagtgttttccatattacatttttttagggttgtacacaaatcactctacctttttgtgtctatgatttatactgttgctaaaaaattttatgaaaaataaagcttgatcctacagaagtagattattctcttcttattttcttctataaattaagaaaatatatttttccaagtatagacagttacctatttttaagttttatttaaataacatgtgaatgtgatgtgcaatatcagagatgaatcgaagtggattcattgattgtagttacatatttttcaacagtctaataacattaccaaaaaatgttaagtgaaagacattaaagggtctccaaattttcagtcaccgtcattttgggaattaggtctgatgataagacatttagtgggctttatctatctattggtaaaagaattatctttgcctttttttccatgtcacttgggtagtactgtcctttaaaatcaaacaatttccttggcattaatgcagagaggatccaagtgttaattttattaaaattatctgataaacttcagtaagagtgttgagagcagtggtgatgacttgttttgtttttaattgatgatgtgcttagtgtggttctgatggcactgggtaaatattactgtgattctgcaggagagctgagtgagccatccaccctctgtcactttatatccctcgagtccaagcatgtcatttcagcaacacagccagaaagcctaaagagctgacagttggcttgtgattattcctggacctgaggctccctcacgttacagtactaatcaagtcatctcaccgacttatcattaactcaatttgacccatgggagcagagatgaaatctttttggcaagactaatgatgctgtaacattgaaaagaagtgaaatgtaaaaccttgattatcctcaaccctttccatgaggaaaagaataaaaattacaaagcacctaaaggtaagagtaaaagacaatgtctttcaaagaccttaagttttccttccccaaggtgcagcactgttttctttgcttttatttttatttttttatttcacctttgtccagaaatttcatctcaattcttttttatttacactaacaaatattttctctggcagtcagaaaattcacttttcttgtatttgttttgataaatggaatgaaagttctgttttgcagtcagcttctaagatttctgatgaaaaggcagccaggagcacgaagctcctgtcatgcttcagcgttcttagtttgtgtacatctttgacaagaactttcttttttttatttttccttggcacgagctttgggacatcttctatttttctctgactgacagctgcataataagttttatcattaaaaactgattctagggaaatatgatccctgccttccattctcttatagatgctaaagcttttgttttcacaactctttcagaataactagaaattatcgctacaaaaagacagggatattgacctgtcatgtcctgagttgtttagcaagtgccaaaaacaaaattaaattcccttttatctgttatctagaaccacgtgttaaatcatcttgctcttgagaggtgactcaaagtcaacaggttctttttgttcatgttgtctttacttttattaacctttagagaattattaagtacttcttcattttagcctatcaagttgggttaaacatttaacacataagttattacaggcataaataccatacttgatctatttagaatttaagtgggggcagtgatatgttacttctttatttacctgctaattatgtaatactgaagatttaatatataaattttctgacatttctttatatttcatcctgatttcatgtagcctttctcactgtaacaattaagaattaggtgcacaataaaaggcaaaaaagaagtaggaaaagttagtaaaacttgctgatcaacatttgacagggaagataaagaaaaccaggtaatgttaacagttcctattgaatatatgtatttttaatttaacagttaactgttttccttggacttactggaaatgaaataatggaagagagctttatgcctttgtttgtagataagagcgtataataaaataagtcaagattcatcagctaaagagtagaatggaagagcactggattttacttctggttccagtccttttaccagcttcttaatgttctatctgcactccccctagcccctgactttgttcttcaagtatatgaaaacacacaggaccttcagccttcttaattcctctgcttagtcctatgtcatagctttttcccagtctgaactccctgattgatggggtgtccaagggaaataaacagtcatgtcatgggttcttagtttctgtttctggttgggccaatgaaccccttcctcatccctcttttccacttatcactagaaacagaaactaaaaaccatggcttcaggctgctaaaagcctaaagcaaaacaacagaacaacaacaaaatggggtaggttggacaagcttgagtacactaaacacaaatttcaaaaaagaaaagtagaatgacctgagaaagtgacatcatggtgtttctaaagttataagttgacaatttataaatgtataaatgtatgggatacaaagtgtgttataatttatgaatacaacagggaatagtgaagtgaagctacttatccatcacctcaaacacttaatattttgtgttttgagatctggtttctggtactgacctctgcttttgacttagtgggtctttttagaaaagtcagctttctttcattcaattctttttttttttatctgaaaaatggggcagacactagattttatgcaattctctttggcctctcttgtgaatgaatttgtaacatatgtgcttaacaccaccttcccttcaaactcacctgccccctgtcatgctcactaacacatgctcatctctgtttctgttccgtttccctctttctccctctctctcagagcatcctcttctctccatttctcttttgccctctcctttttcttcttctctcttttctcttaccctatccttatctattaccttctctctttttctttctcttatctctgaaaggatgggagtaccccaactcctgacttaggtagactgatgcctccacttagacctctttctcttcttaatgctctccaagttatctaaaacacagaaatcagttcaagtattgctcgtatgccttgcttcccagctagggacattgtcaaattgatctttgcctccttagtttctagtatactttttggccaacagaaagcaataaataagcagtaagaaattattggatcattttaccccccaatctgtgtctcttcttgaactttctctgttcatttaagagcaccttaattttctttgtcatttggtattaacacattagctatattgtatccattcacataactcaaatccaagtaaccaccaagtttttcagttttccttccacatcagtagcccctatcctgcgtgttcctgctgtccccctccttacttagccctaatctctctgctaacacatcacattcttttgatttctctacattcaatgtctccacaattgacacagcctccaaattaatcttattaatgttattttactatgttaacttcctgctcagaaaccctcaatgacttctcatggcctatcaggtaagttcagcctcttaccatgacatctaaagtttgcctcatcttttcccaaccaacctttcctgtattatctcctatatgatacttgtacagcaaccaagtgggattgcaaattttctccaactgtgttctacgtttttattcaactcgtttcttccattttttgtattatttatctaaatgaggtctaaagatcttgcttctatccattgagacctaacacaaatgtctactccatttgaaaggtggaagttatttctccctcttgaattcctatagcatttttttctacttatataccacttgtaaatatattgtttattttttttcttagcttaacatctttgataaacaaatggaagctccttgaggtctaagattatgctttattcactttagtaccttctggaatacttaggatagtacactgtatatagtaataaaatttctttatgtttcattatagatggatgacttgatctaaacattgaaatataaccactcattgcatgaagatcactcgattactgtgtttcttttttccttttttgttttttgttttgttttgtttttttgttttttcgtttttttttttttttttttttttttttgagagagagtctcttgctctgtcacccaggctggagtgcagtggtgcgatctcggctcactgcaaactctgcctccagggttcaagtgattcttctgccccagcctccccagtaaccaggactacaggcatccaccactacacctggctaattttttgtatttttagtagagatggggtttcaccatgttgctcatgctggtctcgagctcctgagctcaggccatctgcccaccatggcctcccaaactgctaggattatgggggtgagccaccatgcccagcatcactttgtttccttccaagtttctgataaaatttttgactacagccttttccaattctttctttttactagaaatgcaaaaaacaacaaaaaaagaaatgttatataaaattacaatatatggaatacccaataaagatttgaaaaaagaaaatcggaaattgaggaggagcaagaacatatatcatattccaaaacgattgacagataatgaattcatgaatgtgttctccattgtttcaccaccattatggttttttatttgttataaatacgatttactatcatacctctgagtcactgaccctgtaggttatatcttgaagttatttaatacttatagtagctcttatggccagctcataaatatcagtggtttccaaacaatatctttttgctttcggttattctatggcaattcaagtaattattttgattttaaatgttaaatttttatttatgtatttatacctcagaaatacaatgcagttgttggttaggtatgagaaataatggattaaggtcaataatttaggcaactttattgttggaatctttgagaaaaatttctttgaatggattttatagtagtagaaccatctcaaatcactgctgtttataaatattctaatataaaaatgcatgtgcatatagttatcagcccatgtctaagtgaatagtattcagagaagtttgtatgctatagcacctttcacatgtatgtgtatatacacacatatagatgtacatgtatgtactgcatatgtgtatatgtatatgtgtgtatctatacacacaaccctgagaagttcccacctcagtaaaaactgaaaaaatttaaggtgcatgccaattaagaaaaaaatacagttatacagtaactccctctgagttattaattccacgcagctcaaaacaatcaagttttgatttttagtctgtgtgtgtgtgtttactttggttgttcatatgtttctgagtactatcctaaagtgagtgcaaaattatgtctaagtcactattttatcaacatcagggccctttaaagcatacattcaaactgtggaaaaaaatgtcaatttcaaataacatattgactttgtcaattcttagaaagctatttctttccacaactctttgtttttccatatcagttaataaagtattggtcactgaaattatgattgtgctttatatacattgtgtaggactaataaagctactctatcccaattttaaatgagtttttaatacaatgagtgccaaagtaagcagcatttaaagacaccaaaacaaaattatcacttaaagtaaatcctatccattttctgcataacagataataaataaatcatttgcccactcttagatatgtaagaattgaggatgcagagctactctgtcttctttacagtgtgtaagatgtctaggtatgctttcaaaatagtgttaaaatgcagagtaagtgcggactaaatagacaaaatgaaaagaactggcgtgagagagtgatgacttagaaatagagaaatttatacaaggggaaaatgtcagatttaaaatgaggggtgtgttaaaacaagtgtataagtgctagacctaaaaaaaataaaaaattaaagaattagcgggttaaatatttgtggtgtttctctcattgctgtataggcattgtttgctcatatactctaggtattttcatgggaaatcttactttctcattctgtataattttagaacaagatatggctgaatcttgccatggctaccaaacagtatccagttgctacctaggaggcagcaaaatcacagtttatctgggaatttttaggatgatcctagttctcattgcctggttagctggtgggcagtcatagcaaagactgtgttttcggtctaactggactaaattgaaagtatcatcactttactcttgtgtctggtggggaaaatcttagcatagagctaaacatataaaacgatttttaaaataattagaaagcctcgtctttcttccaacctgtggacttcaggtaacgtctgaaatgaaagtggtgaagttgggagtctggatgctgtgaatagtcataagactggcaaataacatttaaaacctaagcattagattctaccgaagataaatttgcacatatgtagatttttgtaatctaagattttaaattaaatggccaccagagttcatttcagattgcacattaaatatattgaactagaatcccagtttgggcttgccatctgtttagcatgctgattgtttttacagaactgtgattttaatctcaaaaacaaaaatttatgaaagcccccaagtcagactttttgtattattttccctactgatttccatttagcaagaatttgactatctttaatgagttaagagaggcatcggaaatcccttgacttttttctttttatcaaatcaatgaattaaagtttttgttgtgtgttagtttttttactctgtagatgttgccatggccatgagtttcatagagtagttacgttgattaagttagatgattcaagttagtcttgaatgaggaaagaatacacttgggaagcagtgaaggatggattctagtctttggagtctttagttctgccagtattttccagttgaatggaaaattcacctcccagtttggtttgggtgacaatgaaaggattgttagacctgaatgttttctagaaaaagacagagatcaataaggaaagaagacaatgtgaatatctacatatgttcttgtaatttttctccattgttttttgctttgatgaacaacatcattatagaaataattaatgttaattaatatctgtgtcatttcttgtaaatggtagtatattattgttacaattagaataattcgtatacagcatagcttagtgacatgataaatgacagagtagaatatgttgagtcttatccattttgatatattagctgattcacttgctcaataaagacaaaagaaaggcagagaattgggcagtaacaacagcaacaactataaatgcatggcggctacattttcaggtttttatttttctgccaagttcctgagtaccgtgggttgttgacattttatatttcttttcttttcctgttgttaaatcttagtccctgattgaaaccttcaagaataggatcatgaataaataaagcaaaggaaaataaaacatgacttccacattttctagatttgcatatgctatattatacttggtgttttatttttccaggattattcatgatataatagacagctgtctacaactctgatttatttttcagaacctatgagaaccccaaagacattaaagattgctgaaatacaggcaagacggattgctgtggactgggaatccttgggttacaacattacgcgttgccacacttttaatgtcactatctgctaccattacttccgtggtcacaacgagagcaaggcagactgtttggacatggaccccaaagcccctcagcatgttgtgaaccatctgccaccttatacaaatgtcagcctcaagatgatcctaaccaatccagagggaaggaaggagagtgaagagacaattattcaaactgatgaagatggtatgctcatactttgctgtttaaaaggggggaattctctaacaagaaaaatgtgattactttaagattttcctaagattgtccaatactgaattggattctgaaatcatctaaatgttattaatgagattaactttggaaaaaaattgccttttacaaaacctaatattcttcagacaagcatccaaatactaaatgaaatgtgcttctgttgtcctctcttcttacacagaagtggcaactacactaaaaacttaaatgaaggggttttttaaatcaaatgttcaaaaataatttttactctccatggcactatatcaattgcctattggtaaaatgcacttgataaaaaacttagggtttttgtattttataaaccaatagtagctgtttttatttttctcacatttgaaaacaacactgttgggccgggtgtagtggttcatgcctgtaatcccagcactttgggaggccgaggcaggtggatcacctgaggtcaagagttcaagaccagcctggccaacgtgatgaaaccctgtctctattaaaaattccaaaaattaactgggtgtggtggcgggtgcctgccaatctcagctattcgggaggtcaaggcaggagaatcacttgaacccagggacagaggttacagagagctgagatcgcaccattgcactccagcctgggcaacaagagcaaaactccgtctcaaggaaaaaaggaaacaacactgtttatactgcttaccctttctattcattttagatggttttatgtgagtctaaatataaaagcaagcaacagttcatatctgtaagtctaatataatggcctttattagacattagcaagctgttctttatgtatcttgttgccatccaagtaactaaactgtactttgtctaatttctgtgtgttacttcttgataaataatatgaacaaatatttatattagtattttaatgttcacatacctgttatagcactacagtatattataatttgattgataatatatttcctaatttagcaaaaacatataaaaatatctgcaaatgataatctaataacaataagtcactctttggatgtaagatatttcctttcaaaatttccttttatgaattaaggcatgtagaaaaaaagtgtgccatatggtgaactgaggcaaagctaaattaggagtcagttcttatctttcaatgaagggcttaaattaagtgatctctgaggttccacccccttctaaacttcttcttaagtagcttgacagtagggctacattttttttcttttcttttcttttttttttttgaaacagtcttactctgtcatacaggctggagtgcagtggctcgactcggctcactgcagcctccacctcccaggttcaagcgattctcctgcctcagcctcccaagtagctgggattacaggcacctgccaccatgccctgctaacttttgtatttttaatagagatggggtttccccatcttagccaggctgctcttgaactcctgacatcgagtgatccacccgcctccgcctcccaaagtgctagggttacaggcgtgagccactgtgcccagcggggctacatttttatttgagtttcataaaacagaatgttttttataaccacgtattcccaagttcccttaagttctgaattttagatcaggtgtgtcttttggtgcctaccttctattagcttgccataaaagaggttattatgccatagtttttacaaatacttataatttcaaactctcccactctgaaagtggaaatgaccatcatttcatgtgccttgctgtttttgttgtaataagagaagtgagagccctttaaccacatttagctcaaaatttgaaggaagcaatatagttcggaaactatacatggagttactcatgttcctaaaatttctgagaataaacctaagacttatttaagacttatttatgatgaatgtgcttttgtcatgtttgaggtaaccaaacatgattactttagctatcatgtttgaactggcacctaattgaagtagcaacaacatttaaacaacaccccctttcctaattaataaacacacaaatatccttatatcttacccctgccacacacacacacaactcaatgcatatttatgcaagaaagaatgattaggggtaattgtttcataggcacataataaaaatgagaagtctaactacagattcaatagctccaaaaaatttctatcttttcttttaaaatgggataaatgttataaggtctgtgtcacactaggcactttgtagcccatgtgttcagttattaaagtatattcacatgttttattgcctacccttaaaaaaaaaatcatgtcctaattggtaatggtagactcagttacatagttttgtgctgctttagccagtcactctctagtaatagaattcattttgatggtatttttggatatggtttgttagtttgcccttctttcccacaaacaaaagaatgcagccaggcttatataatctttttcatattgcattaaatttttaaatgcatttttcagtataaatatgactagactaataatcaaggaatgagttgctttggaattttaaattatgccctacattgatcaaactcatgactgtactatttatcttatctaaaatagttttgtaaaaatacaatgacattaactattttttgaaatattttaaattctaattttaatatcattttcaatcctagttttattttaatctctgttttgaataatttttccagttttaattatattaagtttcgtattattatttcatagtattgtcacaaactaatcccttctactatgagcgtaattttttctttttgtttaatatataatatttaatgattgatacgtaaactcttccatgaagtatttgcaagtaactctgtcttcaaatcagcatgtgagcttcactttgtacatagaatacttgatgtgtcttaatgttcctgagcagggaaagaatatctaaatcataatctgttgttggaaagatcgatggattatgatgatctgattaagtcagtgttactaaattattgctgccctgtatacatagaaaaagaataaattatcagccacctaataaaaggacataattttataaaaagaattctgggacatccataaatcatgagagcaaagctagaaccatttcccgccagaaccctaaggtagaatttctatttaatttattgcatacactttttaatggacgaacagaattttctgtatgaggttttgttttcattttttattccagcattcaaaaaatcaatattataaagttagctcagcagaaaagcctggtttggggacatatttttgagactacaaagctatttttgaaagtacatttattacattttaaaggctataatgcttatctaatataatcttgccccacccatattttatttccactctcttttccattttgagagttatattataaaggactttcaaaaaaagtagctgaaatagctgtcatataagtctcaggcaagggaacaaaagtcagcattctgtttccattaaaagttgttgatgtggaaatgtgaagtgacattccctgcaatcagtagactgccatgataatggttttagtaacttcatatagtatttacacaaatcataggtacagagagacattttctgtctataattgtacacatgatcttccttcaaatgtagaaagttattgaatctactttgtttgtgctcacacctcacctcacctgtttgtgtgtgtcttttagttcatctaagtatagttccttctctcatctatgatcatccaagtacacgacaagtagtatgacactctcttgtccacaactttgccacaaacttttgtcttacaaatgcaatctataggtacttgtagtgaattctattgtcaaaacagaaaaactgtaagagcatagaaatacaaaacttctagggaaggtacttcccaattctactcctttttcaatgtagaattatacaaatattttaaaccatccctattattgaacgatgttcgataaaataaatctatgccattttatggtatttgtaggctaaattgtgttaggtaaacataggcagttattataattacaatgccatcaaatcaacatttattcattaattggatattttgctccctttttcccccattagccaccttctatgagagatacgtaaggatgaagaaatatcttttccttcaatataatcataagtgtatgtcatttgcatataatggaaacaacaggtactcttgcaagacaaaccaatgcccatggcagccttagcaatagacacagatgtgcagaggggctctcactggccctctgtctggatcagctgcacagccttgctggtactgtggagcagggagagagcggatgcattcagttaacttctctcatagtcttcggctgacaatggcttgaacatatcttctaaagtttagtgctggcatattttctgtttattgtgggtttctttcctcaatgtatcaaattatgttgcctgtctcagaggtcatagtatcattcatagtctccttgtagattgaaataaatcctgctctcgtgagatatcattcagaatttcttgatgctcctagccacaatgcaatgtatttcccttgatccagtgatttttaatttatttcaatcctcacaaaattgctatatactttgaaactacatttctggataatgtcatgtgtgaagttcactgaaacgttagattaagggaaaatattaattaaaaactatgcttgcccaatattcagttgatattttcaaaaagaaacacattttttagccaagtaggatagatactatatattttaaaatattatcagaactagaaattggatattcatgtgaataaatagcagctaagtatttaaataaaatatataaaaggaaaatacacgatagcgaaagaattttttatctggtattttgtcaatagaagctggtgcatcattcagtgttgtcattgtgtatgaccagttatatgacatttgcaaataaggactgaagcaaaggctcttcaaatatggtcatagctgaggacacttccaaagtagttgtgcagatcgttgagttctaaacaagtctgacattataaactagtttgattcttacctttgaataagtgaatttcctttaaaaggctgaagcagtgacatttgaacctatccatctgtaataactctttaaatatggtaataatcaacactgcctttttaaaattacagaacatttaatacatatagctataaaagtaaggttggctattaatggacatttcaattcattttgctatgtgattcggctttccagaccaaagagtgttaattattatcgtaatttattatttatcaactttgtttatggagactctttgggggatttgcataatcttcaaaaaaatctttggggaaatacagctctgttcttgaaacaaattacaaataagatcctcacgttattagaggtatacaacagaggaaactagactacataatttatgcatctctctaaggtgatagaatattcttttgaataaaaataactttgcatttctacattttctgcatcagaaccttatagacttgctttaaattctcatatatcgaagtaaaatcagagaactagtcatatagtttattttgtttttaaggacacatttttatttatttttctttatatttatttttaatcctgtttatctagcttatctgatttactttttctgtttctaatgtaagcattttcataacaaaaaattcatgtgttttgtagtgcctggtcccgtaccagtaaaatctcttcaaggaacatcctttgaaaataagatcttcttgaactggaaagaacctttggatccaaatggaatcatcactcaatatgaggtattgggagaacaaggaagttaattgaaatgtggattgaaggactaaaaggaagaagaaaggaaaagttagagggaaatatggaaaagacgtaaatgaggattaggggattaaaatcattctcctttgttttaatttacagattctttgattccaaaattaagcgtcaaaataaatattttgtatggcatctagaattttcaaattcttaaaaaatgcatgttttttgttgctgttttgttgatttagggaagcaggatagtcattatcagatttacgatggttatagtaataatcacatattaaaaaaccctcattttcctttttataaatttaagaaactcctatcatactgtgatttaggagaagccattgaatttcagttgtttcagagtaaggaataatacccaaaaagcaaaatagattataaagctgacttttctagagcttcatttcaactttgaatataaaacattatcttttcaaatatgagaaactaaaaaagaagaaatgaaagaatcatttaagttacacaaatgtgtagttctgttcctacatagcgttgattagatcataaatgcttaaatttctaatggctacagagtgaattatggaaatgagaatcactagtacaatgttatattttgaaactgtgttcacatatttgaatactatttacatgaaatttgttatataacttgaacaaagtacagaatatgttaataataataaaaatttgttgaaacactttctgtgtttcatatgcattaaagtatatggctataagattttttatgtacgcataatttattgtggtttttttgatggaagaaaatagatgtatattgatttggtcagctataactccggtgtatctgtagatagatgattgattgacatatagacagaacttcagaatgacagaaataacaatatcaacatgagaaagaaaagaagaaaaaaattaccattgactccacatggatgcccttgcatactaccttatttatacagagtttatttacagtttcttatgatggatactagatatgtaataaatgtatttcttaaaacagatcagctatagcagtataagatcatttgatcctgcagttccagtggctggacctccccagactgtatcaaatttatggaacagtacacaccatgtctttatgcatctccaccctggaaccacgtaccagtttttcataagagccagcacggtcaaaggctttggtccagccacagccatcaatgtcaccaccaatatctcaggtatgcaaatgaataaattacaaataggattgattatgccattggtttgtaatggcacatcctggagaatcacatataaaccaagtgtagttcatcttgcttgttgaacctttaatatagttatgcataaatgaaagcactttaaataattatttgaatatgaattatatgtccaaaccaaaacacatctgaaatagtcacttttgattgacagtggtcttaaaaaaattatactaaatctttattaaaaatctttcaaaattcattataaatcctaatagatcttatgatacttttgaagagttgataattattatggtgtcagacctttactctaaatgaatgttatcaaaaaaatggtagaagatcctttctctagtattatagtactacataccttgtttctgtttcattttccctgacattatgataattttaaacaaagatgggcttttctttcacacttaaaaatcttatataaatacatataagttttaaaatgggaacgtacagaagaattttaggttgataaagaaattaaactttacattctattgtagtcacagttgcacagtttgtatttgactagattgtttacagagcttatttctccttcagtcagatcatcagttaaacctgattaaattcttgcaaggagttagctttgtagtatgccctaaatctactaaagtttatataatgttttttcttatttaagattactaaaataaatacatattgtatatgtaaatgaagagttaaatttgaaaaataaattatttaaaggtcaaccacacaatgtagtaaagcacaaattttgactttgttaattctttttgttcatttgtgttcatttttattatagttccacatggcaaatattaatgatacatcattaatacccataaaatatgtctttcatttttttaatctataccatttgcattaaaaggaagacatgtactttccaaattattttgagtctaaaatgttacttgcaaacgtgttgagtataatacaaactttaaaaatttgtatcatgaataaaattagctattccattatgagctataattccttggaagagcatttgatttatcttaatattccaataaaaaattaaagtatcatccattatattataaaataacaatgttttaaaattgcagttttctttcctgagaacaattacaaatcatgaatttaaaatatgtattgaatcactttaccagaaaataagacttggtgatgttacgatgcactgagataggttttctaccctctggaattagcagcagtgctataattgagtaagatctttcaatagagacagctacaaaatttatataaactaacaaaactgagaacattgaacaaatgtaaatttttgagagccataaatgtttgtgtgtgtgtgtgtgtatgtctctcaaggctcagatactgtgtttgtgttgaacataaagtttataaaaaagaccagaacatccatctgattttttcttttaattattcaacttcacttttacttgtattaacctaagtgcaatgagtacttgattgtactttaaaaacttggttgcaatcactttatgttaagaacaattattaatcacatctaagattaataaatttatggttagtgtggttctcatcattacttgaacttttcagataatttattgtcaaatttattccctgagtccggtaattacatttctcagcatttaaaaaaataatttaaataacagtgaaatcaagttattgcaggcataactgttgggggaattatttatacatacacatacattcacatacacacatatacacacatacatactacatattgtgcatgtattaaattaatatttgttgtttctgcttcctaaaaaactctcagataataattaatcttctaatgtcactgctccttttcttccatctagacagtattttaaacagattattgaaatatctttctaagtggtatccctaccttcagacttacccatcttcactgcatttctatatctatctttaatccacagatatttccttcttaaatattttcgcaatcttgtatcttataatcagcgggatgaagtctaaagatccacttggtgttggcattcagggtccttctttgcatgactcctcccatcctctacttctccccatgagcccaaagttcccggcacagccaacggcttatagctgttaaaacgtaccatgccctttcatattttgttatcttcagatattctgcttcctttctcagaattttagttcatcctttctcttcctgatgagtttttaccctttttttaatatttggcttaaacatcattagacaccctgagccttctggtttcatccccccactgccaatactaatgaaaaaagtgtgaccccccacccccagaccatcatcaccaacatcacctgagaactgtctagaaataaacattgtcaggtccctccccagaaatactgaatcagaaactctagggtagaggggctataatctgtgtgttagaaagccctccaggtgattctgatcttacaagtttgagaaccactgttttggcaaatggtcttccacttttggccactaacattttgctataattttttgtttgtaagactcttacttttcataaaatgtgaattcctacttttaattctaaatatcagagaccatgctttgtctttatattcatagcatttctcataaaacttggcacatagtatatattcagtaaatgttcaacgaatggatagagataatgcacacatttcattgagtatatactccttaaacagctttctacatgaaagtcatccaaagctatttgaggtaactctttttccccctcaagatcctagtccctaattaagcattatcaaatatttaaaaaaattataaatttattctttttaagaatctggcaactaatgtccctgatgaacaaaagctaagatgtccattatcatttaccacacttcttggtatgtttctcttgtgaccagagttgtgaaaaacacattagcataagagtactgtgtctttctacactataagatcataaacgacactgtttcaccaggtagcccttgacctcagctcttgctgttcatagctcctgatcgccatatgtgactccataagcactactgcccagtcttctcagttactaccttccctccctcccatcattactcacttgaaggtctcaggaaactaaaaggaaagcatcttcacaaaatatttggaatgtgtgtcataaattgccagacgattatttaaatttccacagcaaatcttggttttctagcttttgatattttaagttcccagagttgaaattcatttggagatgttatgctataaaacaaaatacgttgtagataattaggtgaatttttttttcctaacttaagattgtctgttcattctgacctgtgatatattactgtaaattaattgaaccttttttatctcattaatcactcatcagctccaactttacctgactatgaaggagttgatgcctctctcaatgaaactgccaccacaataactgtattgttgagaccagcacaagccaaaggtgctcctatcaggtaagaggagaaaactacagtagttctgccttatccacaggtatgtacatcccaagatgcccaagtatgcctaaaaccagagatgataacaaaccctatacagactgtactatgtttttttctatatatgcaaacctatgataaagtttaatttataaattaggcacagtaagagattcacaacaatcaataactaataataaaatagaacaactatgtattttaataaaaggtgattatgttctctctcaaaataccttattatactgtacttacctatttttggacgagtttgatggtgggtaattgaaacacgggtaactgaaactgagatatgagaaactaggtaggcagggttggggggtagtttttcttttactgtaagagttaaagaaaaaggagccagaaggttgcttagcagctaataaagtggttcatttcaaagatacattcattggagaatttctgtcaggagagttttatttttgtttagtttagtttggtttcctttggtttgttagtttttcatttggacaaagcctgcagatagacttgtagttaagagcaaaattctaagggcatttttgagatattcatgcactgaaccattcacctctctgtgcagtttgacttaagagcattggcctttttcccccctctagtcccatttcatttcacgtcctctcttggtatctatgttataagagctttgaagatatttgtcagaaataggatgagaaaataactcctgtccaatgcagtaaatcagttatgaataatttcatatgaatgattgaaaaataagaagctttgatgaaataaaagcagaatagttagaacacatgaagcctttttgaccttttaattcccgaattgttccttatcaagtattccagagtaaattgaatgttcagtttgccattttctttatcttttcaacagtaaagtctcatattatctaacatccccatctttcagaaaattgtgagccatgtgatttttaggaactaagtcaaattgttacaaccattttaatttctgcacatttgtaatcagatgaatatccaaaacttaaacaagtttccatttgaaacgtgattttgtggacattttgttatcaaacttctaatgagaaataaatgaaggcacagaaatccacgtaggcacttcataattggtttatatcaagtcgtttacatattcagttaaaaataaaactaatgtttgttctttgtgtaaaaggaatacatttgacttcgtgagcacgtattagccatccaaataaccaaaaataatcctagatcactggaaatgaagaaatattttttcttaatttaagaaatgtattgacaaaagaatacaaatcataaagggaactcttgagtcttgtctggctaaaaatcatgagaacactataccagagaaaaagagttggctgagggtgtacttgtaatataaacacttatgaaacactggctacttgaaaattcaaagtacgtatatagtgctgttcatgaatcaatgatctgtgagtgaatctgattgctgatccaaagtagaaagagaaaatgcctgcactcaacatcttttcctattgacaagtaatcagggtcattcacatgttcctacctgtgataaaatttactttttaggtgttcacttctgttactggtgcttaaatcagctaccagctacttgcatttatcttttaagagttagatatttgggtgaattcaactttattttacgtaagttgcaaacacagcatatttttattatttttgcatcactgtactatataatgtaacttacattaactctttattcacttaatcaattttttccacaaacattgattgatcatttattatgccagtcactgtgcaaggtattgtaaatcaaagataaaatgaccacaacaaaacacagaatctttgcccaggtttgtcatagaccatcagagatgcctgcagccttgtaaatcatttgctcatagctggtgttcaggaattttgttaactcagtatgttattgatacacgtttttaaatttaaagtcttttactttattacctttatataatttctaaagaccaattagaaacactcatctttgtatttgttggcaagatttttgaccttttctagaattgagccagaggctgagaacttcaaattatacattgttggagattagtgctcagaaaaataaatttaaatcctggaatattacaagaagaagtaatttaataataatataaacaacagattttttttgaagtgaatgttactaccaggaaaataaaatctgctttctaactgatatgctaatcccaccaagtccatctttagtttttgtaatgacttacccagttcacctacaggtgggtgccaggtggtgggaccagaatggtctagtcaagtaatctggcttcagatgagccctgcctcctttaccctctgaatcctttgtgctgtctttctttcctctgaccacattcctactttcagtctccctaccagcaactgtagccttatcgtgaggcttatctgatccagtgccttaattttttgaaaatgaagattcaatttaatgtaatcatttttccttaccattgaatttatggtctggtatctcaaatctttgattggattcccatcactcacttcaaatgtacttgaagcaattttactttccactcaattttttctttgtttatgtcagtctgtcaaaatctcttctctgctaatgcttgatgctattctactctgtgacccttccccctgccacccctgtcaccttcccaaataaaccagaactacatattatccaactaaatctgagagcatccaggagttagcttgctggctgtcatagaccctaaatactgggttctgtccttccctaattatagcattactagcctctgccattttgcatttcaccatctattcatcccacctccagtggaaatatgtattctttctgcctggtcttcctaatatcaaacaaactccagttctacagtcctctgtcataccaactagaaaatcttgttatatagagttttcgtgtttagttttattaggaaagctaaaatcgccaatggattctataaatttgttgactcaataacattctatatgtgccaagagctgagctgcatacttgaaatagaaatctacttaaggcaattagtatgtgcacccgtgtgagtggtagactcctaaattaatgactggtaacaatgctgtgtgataagtgcaataataacagctagaaaatgtggtactaaagctgaatttgtgaggagaggtagaaatgagcatggccaaaggtcacaatgatgcatttacgaattgcagatagcctaggtcatggagagtgaagggtctgtgggagaattgacagcagctgaagctggagagacaaaacagggagcaaagggagaggttgtttagtgccagccccacaactgaaggtgggcacaagaaggactgtaagcagaagttaccatgggcagttttacgtttttagaaagatcactctgatagaaacatagagaatggactggggataatccagaaggctggagtagtccctgtgagaagtgctaatgggccattttaagaaagtagcaatggaaatgcaggtaagactgtggctcctacataaggttttagatcagtaggatgtgtaaagcttcatgggaagggagtttgagtggagactttaggtgagagaagatggtagcttttatatttgaagtggtagcagagcaaaaagacatctcagaattcaaggttttgttttttgaggttattaagtgataaatattttcagtattgctaccccaaatcaaaaaagtaatgctctctctatgaaaagaggagttattttatatattttgcctaccttaccaatattttcaccaagttttaatctctaagagatcatggtgttgtgcttacataagaagtaatgaccacagtgaaaaatcccattctgcataatgcagcactaagtttcaccaaccacattgtccttctgttacccattactgcttccctatgctaatgtagaacatgtgcgatgcagtgctggcaagtgtggttctttgacgaaattaatttttgattttataatcattctaaaaactgaacattgttgcctgacttaagtagaactttgaatctccttaccaactttttgagatctatccttacaactgtcatcacttgacaatcattactgtgttcaaaatgaatattgtctacatttagaatcaattccctagaatacataattccttttcttttctttctaaaaggtttcttcgtaaatgaattaaaactctaacctgggaaaatataattacaaattataatgcatagaacgtcccatttattaaaagattgacccaatatagctgtgttttcaaagaatgaaaataacagcagcatgttgtaaaaacacaaaatagtttctctgtggtgagactgtttattgtaaagttaataaatgaatatatattttatttcagcattttccaaatagaaactctacccattttgcgctgcaggaagctacccattctaaggttactttgttttgtggagaacatctaatttgcatttcataacattaagcaccacctatttagtttgataattaaaatatagtcatgaaataaagtcaaaaccaccatttcttccacagttaaattaggaaaagaaattgtctgatgttctaagttcactgatagcttaacagacaaatgtatgttagggttgcatagctttaaaatctggggctatcctcatccacctgcagaatagtctgtttcattacataaatttaaagatatcaaatagttctaattttcctaaccactatcctgacctagagcttacttgaattccaaataaaaccatcttgaaatttaactagagatggaaataatctttttgccctcttttatgggcataaaggtcatatggtccaattagatcaaatagatgttactttaattttatgtttattctctagaatcatagtaggtagaatcattataatttttctaatcaaaaataggaggaagtatgcccttcttgttaaatcttctttctggcctctagaatcccagtccacagcttgcttatgaccttgtgagaagccctgagccagacctgtcttagcttagcaactctggaattcctgacccactgaagctgtgagataatgtttgttgctttgagctacagaatttcagggtaatatgttatgcaggaagagattatacatgtacccaagtagtataaatcttctctttcttcagatttctgcccaacggatacttttatcacataaggatttcttgaccaacccatataaaatagcactctgcattcccatcattccctctttcccttagcctgctttatctttctctagagcacttatcccttcttaatatgtgttggttttctgaatttatttttttatttgtgtctccccactagaatgtaaacttcatgagaacagagacttttgctactatcttcattattttaacctcagtacttaaaataattcatgatatgtaacagatactcaataaatatttggtgaacaaatgaactggatctaaaaatataacagccacattctgtagtaagcttatcatctgctaaaggaaagacatatacctaaaaaactatttttaacagtataatatcaaatcatatttgtaatgtaccatgttggtgcatgtaatgtgctacggccacatactgatgtatcatataagcaataaatattagacagcaatgctaggtcttttgttttttccaccctagagtttttgagaataccatttatggttctgataaatggatctttggcattataattgtcagtgggttaggaactagattaaacatgcatccctgtgattgtgacttctacccccatgtcatccttcagtcatcctcatcttaaaaattactccattgcctttagaagacagagtactgaggaatgaagatagttcaagaagccttcatggcagaagtagaaaaactagacaagaaaggcagaaattcttgactgtatgtttagtatatttgggtaacaatggtcataccagcttcgaatggaaaataaatatcaggagataaaacaagaatggagatataaggtaaggaatgtggtaatttatcaaccccagcgtaaaaagtacagagtttgactttgaatttgactgtacttcaaattttaatgttgctattatcctgggctagtgatatgtaatacatgagatattaaacactttattataaaacaggttttgtattagctgattttgccaactataagctaatgtaaatgttctgagcacatttaagttaggctaggctaagctatgctgttcagtgggttagatgtattatattcatttcaatttacaatattttcaacttgtaatgggtttattgggacataaccccatcataagttgagaaacctccatataatgtagtaaaatatgtcattttaattttttaaaaaataaggaagtcacattttgtgtattgaatgattaatgataccaatatattgatttaacctaattacagaaatatttttgaagtttattaaaaggaatggggaatatattaactatgggtagagtgattaaaaatattatgatgactttggaatagttttaattactaaagtactgagctcacctaatatttagatctagctagagtttagttccattaggtaattagacaaccagaagaatgaagaagcacaatcccatttcatgtaattagtcaactcacttctaatgcgatttcttatttcttatttcatcttttaattaatttgtattgataaataagaaaataacaaggacagaaacagatttaaaaattggaaatgtggttagagaacagcctttcagattgaacaatgaaggaaagatagtttcttttaaacatggactagtgtgactttttgttatttttatagctgtttttcactaaatgtaaatacttcttaaagactcaccatgattacaattgatttctgtgtgagttataaaaatgcctcttcaatgggcatgaaaaaaggtagaaatagatgcacaaagtgatgcatccagaaagacactgactaaagactgagcccaactaaggagagtaaaatgccactagagaattttgagggatactggtacaaggaaagatacttttcatattttcagtatcttgaaaaggtagcatgctgcagaggtccagaacagaaagacagcagtacagcagacaggtgtatatcaagattttaaactgaaacgggtatttctgggtgatgttatagaaaagtagtacaatttcagtttcgtttgggtgtaaaagcaaaagggagtatgagagatgactttaaaagactctgaagatctacttctgggtagctgtcccagtcactttaaatgcttaccatggacagtcacaggttcctaagtgaacagagttgaaaagaaagtatacattttagttttgttgtcgttttaaactgtatcaaacttgagaggggcagaaagcattctaaagatggtagaacactagaagtttcagtaaataaaagtgaatataaggtccgtgaaaggcaggtgttttttttttaacctctctatcctcagagcctgcatgatacctgttaaatatataattgttgaatgaaaatgagttaatggatacaatgtcacaggaagaaaggtaaatgagaaaattcttactcttcaaataatgctcgggatttttcaggtgaaaaatgtactttcatggagaaagaaaaagagtatcttagatatgtcctaagcaaaaatatcaacagaaaaggcaaaagcaatgtattcatttcataaacacttaaacgtccattatcctatttgaaaccacatattccagtgtggtttcaaataggataatgggcgtttaagtaagtataatatgtgaaaatgtaatggctattgtatcagcttttggagttaaacatatttgggattaaaaatatctagaaactggggtgaatgttatatcatgaagacatttctcctggtatgagtggtggtagagtgggagggttatagagtgcggtgaccaggttatctccaactagcgttccatctaatgttactcattgcacaaagaatgttttagaaagtatgcttggaagccagttctcagaagtctttttgtatttatgtgtcttagtttgctcaggctgctattacaaaatactaggtggcttaaacaagaaatatttctcacagttctggagactgggaagtccaagatccaggtgctctcggatttggttcttggtgagggcccctcttctaaacctaattattttccaaaggccccctctccaaatactatcactttgagaattagggttttaacatgaattttgggggagggggcacaaatattcagttggtaacactgtagtataaagtagagaatgaacaaagtgaggttcctggtttaagttttaaggggagctctattcttctgcctcagtttcaatagtaacagaaatataatacttcatttctgtaatgaccattcaaagaataaatgaataatattggtagagaaaagatatataagattaaagtgcatggcactgtaatttatatttgtatataaattatgtggaaatcattttcttaattctttatgaaacaagcatgttacttgtattttagaacttataaaattgaaataatttatctttcattttaattgagagtagggccaaatctgaaagttcaacccaaggcattgatttttattttctatgggaccatacttaaggctctttcccaaagagcctattgcaccttttcttcctttactcttctccaacactggcaatttactttgctcctcacagatctagatagacaagctgtcttgcatgaagtatccttaatttgtaatgtagaatctctgtcaatgtaatagaattagttaagattgaatgttcactagattttgtgtttttttttctagaggtatgggataattaatgaagaatctatttttaaggattagattaatgattaacaaggataggtaattattattattctttagggcaagaatataaggttacatttgtttggagagcatgtatgagggagtttatatgcatatgtggatgtatccacaggacatgcaaatgtataatatacaaatatgaattataaatttaaaataaaacatagcatatgtcagctatgatcattctcgtctttctccagggctatgcgtatgtattttctatatcttaaaattgacaaatgcctgctccatggatgcctcagagaccatgcatcttgtcagtagcattcttagaagcttagcaaccaacttggcagaggtatagggaatgatgcagcacatataatttgaaataacatagacttctgccttgcttgctcaaatcacaatttctaacattaatacaagttctgttatctttttagaggaaacaagatggatatgaacctactgatttattagcaatattttaatggaaaatgggagcttaaataactaggaagaaaagaaaatctgtaatttatcaattaaattatgatttaactctttcttttgatgtccttttgtttaatctatgaagatcttttatttgtaggcataagagtttatattaaattagaattttatgccagagtctaaactgttttaattttcatagatgcatgttcagtgtatctctctctctcctctctctctctgtctctctttctccctccccctctcctccccactcccctctacctacccacctctttctttttcatggaagtcttttaaagaatgtattctgttcctcctggagatccattgaatatcaatatgcagccctgcatacaatttatgttcaacttacctaagataccacatatatttttccagaatttttaggaattttaaaacattttaaaatatatttataatgtataaaatatattataataataatgtcaactttcatggtaatattttacctgaaaaaattttaacgtaaagaattttctactaaaaaagaatattgttaatataccagcttcagagttgttaaaaaatattgttagatatccgggggatctttattttaaatttgccttgtttttctttttgtttttttctctcctttgtaaagtaattgcaattatagaaaagttttaagacttaaagatatcagaaggtttaggttagagctttaataggccaaatgccatctgtttctacaatttgtaacattttattattaacaactccagaagaaggaggcggtctatttcggttgtgaggacagatttctgtccatctgtgcccgtattgccgcatgtcacttgtattttagatctacatagctctgagccagtgtagatgccatggcaaggtcaagaggtggagaagcctgtcagtacattctgtctctgaggctgtgacaaccacaaatgggtgcttctagcaccgccctgaggcagtcattctgttagaccttggagctggactttctgtaatatcatttcaagggaaaatgttaactttaaacatttaaaaatatcagacaaagaactgaatctatgatgtgtctttggttaatgtcagaatccttattagggtggctcattcctcaacatttaaaaatgttgaaagtcctacggtgattgttcttctttttatcagtttctttgtaactacagtgatgttagggacagcagcatctatatggatttttcattttattgcgaaatagctgaaaagagtataccaggttaagactaactttaaatactttgaaatgtggtgtgttaatagtcaaccccttaaaaaaaatcttagtatcttaaatctctaaatatgtgtgtatatatatgtgtgttctttttttcttttccccaaagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggtgagcttcctccaggatttgctttttccctgctttgaagaaaagctgaagtcaaattttatgaatactcagtagcatccgtcaagaaaaaaaaaaagaaaaagaaaatttgcatgtagggggttctgttctcaacagtgtgcgcagttttggggctacagtagggctgaggccgcacgccagttccatttcacagggttcctgtttcctagtaactgcttctactcgagccttcctcaggaaagcccacaatagcaattgagagtaaaatgatttgaaaacgtgggtgtgctgctgctgggactccaccctcagtaacgatcaggcattgttctgtcttccttgctcagtggtggcacacttcaagagattaaatttactgcaggataaacagaatgcgtgttccacagcaggctaataaaaccttataaacttttcagggttttcaagccaaatagtaaataacatgtaacaatcctctgattacaaagtaatagggcgcctgtggtatatctgactgaacctaaacaaaaggcagcctggcgatgactggctgctgagccattacagaaggctgctctctgtttccctggttgcccctccttttcccattttggacacagttgtttttgaacactgctgctgatcccaaatgaatattgaagaggaaaacacaacaggacattagaaacgaccggcagttccgtatgtgggaaaacaacctggcctttcatgcctcatgctgttctctttggaagattttctttcctaaaacttatttttatttatttatttatttatttatttatttatttattggcagacagagatagagggaagacaaatgttgaggatagaaattttcacaatttaaaatccaatagaatgatgacattttaatagacttgaagccgtataggaaattgctgggtttatgtaattgagtccctaaggtgagcacctgggagtgatacatgatatacaattacatcagtcatattatatcttaaagagtttaattggaagacataacaatccttttgcatttctgcaggggccgtgagagctttgggtattgattggctgcttttgaatcaaagctttgttgtttgcttgcctgtatgcttggcttgtaggtagcaaagaaaaaggccacagcatcttctaagatgtgctccagagtcagaggctgctcatggttgaagatgctcttctcgtttacctttaaagaactgaggtctttagagagtagtccagtgtccactttctgcctacatatcattccataccactgttacaactgggctactataaaaacagaacacaatggaagttattagtccattctgggtataatatagcattgagtaggaagcatagttttgtgtgagggttttgatctttagagaggttccaaattaactttggttatttggtctattataccagaggagtgttaatgaatgtctgttacttataaaggattttctctgcattctttaaagctttttgatatgaattttctcttccaattgttaatatatctgcactgtggtttaatcaaagtacagaatagcaacaatatatttcacagttatcttggcaaagagttttaaagttgatgtgacttctacaagtagagattggtaatgccattagaaagttaaacagcaattgcttttaagaaatgaaaatcctttggggcctttatgggaatgtgaaataatctcttgcaggttaccatgaaggtctcaggccacaagtaatagaagtgcaacattttatttttaattactaattcccccctcactgctttattttaatttaaaaataaaaaaataaaaaatgcttaagtggaaattgtaaactcttttataaattatcaacatatagaactactcaagatagagttataaatgcatcttgcaaacagatcgcctctggtttgttcactggctttgataccttttctcacctcttgtgtattcagggatgtacgctgactcaattaagtcctagaggaggaagagtggggccaaaagtagctggcagggacatgtgtctcctactgccacctgacagcgttaaaaataatcatattttttcttgtcctttcctactgcttctactttgtatacccgctctgtctagcaagaggaggaaaattatgtatgctgagaaacatttaactcctaatagctaaattaaaagaaagaaagaacagataaattacaccataactatgatgtaatgttttgatgatctttctaactgctatcatttagctttttagtcatgctaggatccagatgaaagtatgtaatgttcagctttggtctcagtctacagttctcagatgaaaattaaatttatatttggaactgtttttattagctttgcaagtacatttttctgatagtttacgaagcactatacatgaaaatagaatgctatactacttgtcacaaactaacctgtttcattgcaaggtaaaaacaaatatttacatctctataaaaactaaaatatttttcaaagttcttactttagatttttaagtatccctaggggggcatattttttaaagttttcttaatattaaaattctgttgtttataatccctttttatgaccccagatggatcttcataataattatagtttatgaaacaggaaacattatctgtacattgactcttttttttttcatttttactctatcaggaaactaaaacccagtgcgtacgcattgctacaaaaggtaagaggtttgctttttttgcttgttttaactactctcaccccctttctaaaatggaaggactttgttccctgcttcagggctaaatatgacatttctgttatagttagttctgtgactcatgtgggtgtctttaacaactaatggggtgctacttcccatcctctagtacttgactgaaggaatcttgttatgataacaggaaagatctagaaaaccttagaagggcttatttctgccatttagtgtctgaaaaatcttgtgctgctgatcaaccaatatcttaggaaagcgtcagcaatagcagatgaaaatagcaagttgcttgtttaaaaacctctattactttccattgtagacaatcaaacataaaaagaaccaagctaattcatgtttacataagattatagggatagagattagtccatatcttcatcagtagtgcagttagcttgaagatcatttactttttttaaaacttattctgagaaaccagatctgtgatggctagctcataaccagggcaattcctgctgacctggcatattatggcttagctgcctagtttctttgacaagagaaaacatttgcatctttgaatgaatatttagagttccaagtgggggaaagtctcctacattctctgtgtttttaattcttcatttaagagttacttgattgtgccaacaaagaataaattgctacttggtgtattctagcaagagaaacatgaaaaagctgtctgcatgcagacgtgggcctcctcaaagggttggttcttggggtggtttgctgccggaattagtagcagacccacatttgtgtccagtagttgattcatttggggtaaaaatcaatggccatattctgtttgtactggcatctttcctttcatcagttttctccatctaatcatcagtctgctcaatcagcatttgtgctttactcctgatttgtaaggcaataaagaaagactttctctttgacgcttgtgaataataaagaagctttatggaagagaaaaaaatatactttttcaattcacttatgaagattccttttggtagtttttatttaaaaaagcaattcttaaagagaaaatatacacagatacatacgatgtataaggattttattttaaaaatttagcttactgatcaggaacgagagttgaaatttttaaaagataatagaagaaagcatttaggtctatatcacctgtgtttttccagatttaaagtagaaccaaaattgtaaaagtgtcccacattgacctctgaagttctttagatatgtcatgctatgtttctgtaactgagaaatggtagctatatattaccctaacataacttttttattcagttatttcattatttgctcttgcctgagatgtttgtgtccttttatcgctctctcgatacaaatttaaaaaaatgacaaatatcacatgatatttaaactataggaggattgagatcctggaaacagtcttaccatgtggcatagaataattgacagaaactttgaagtggtaaaaaatagtccattatttgtctaataatccagctctgctacacttctggatctcaggaatgcagtgtggtgtggtgtagtgagtaagagaaaggactctggccttacactatctgagttcaaatattgactgtgtcccttaggaattttttagtattgagaaacttatgtaaaccctcattccaaaaattaaataatagagtacctacaccttcttattgttgtgaggattaaaataacatatataggccagacacggtggctcctggcactttgcaacgccaaagtgggaggatagcttgaggccaagagtttgatatcagcttgggcaaaatagcaagaccctgtttctactgaaaatttaaaaaaaaaaaaaatgttagccaggcttgatggagctcacctgtggtcccaggtacttgggaggctgaagcgagagcatcgcttaagcccagaagttccagtttacgttgagctatgatcgtgccactgtactcctgggtgacagagtgagaccctgtctctaaaataataaaataaaatatatatgaagtgcttaaatagtgcttaacatattataaacagtacatgtgttaactatcttatcattatgctaataattttgtacttaagagggacataacttatgttagacagttatgaatgaaatatgtataaaaacaaatctaaattttcgtgatcgagattgctaggacaggggagaaactaagggttttttgttcgcttgttttttaatgtttctgccctggtctaatatattttcttctctgaacctttagcatttttccacatatgaaaagctaaccctgtttctacaaaaactaaaaaaaatgagccaggcatggtgacttgtgcctgtagctccagctacttggaagatgggaagattgcttcagcctaggaatttgaggctgcagtgagctatgattgtaccactgcactccagcctgggtgacagagtgagactatgtctcaaaaggaaaaaaaaaagaaaagaaaagaaatgaaaaagaaaaactaccacatttgttaaagtaacatcaacttattgcctgactacattttaaactaacatgcaagtatggtcagctttggtgtgaaatttttcaatatgaaaataaaaagttttctgacagggcgttttgaagaaacatttaatagtcaaaatggcataatcatatgactgggaagaggcatgaaggaaccttctggtgaaggagtggttcagtatttcacaggtgcatatgtaggtaaaaatctgtccaactgtacatttaaaatgtgtgcactttactcttataaatttgtgtgtggatatataggtagataggtaaagtatttcccaatataaaaaaatgaattatacattaaaaattgcatggccagagttagaaacagcactgagaatattatagaggagtctctggagtttgaaaggctcaccttgctagcttcagtgaaggtttccttctatcagacgaggtgcatcttcagtacataagccactttcagtgagaaggacaaccctgcccaggaatccctgggctgaatgaaaagggtctagaaaggacctttcttggtcctggatgactcctatgggcaagtcttgtgtttcagctgccctacagtcagaccctcccctgcctcccaacccccaccccctttccagtgtcagttgtgagtactgaagagctagaaccttgctagaaccttgctttcctaatatcctttgtatttagatcaattttgctgaaaagaacttagttctctggaaaatctggtgtccctccataagacattccagtttgcagtgtgtccttttaccacacaaattttctgttcaggccatatgcaacagtctgttgctttttttctcatttttttgaaaacttaaaacattccaaatgtagtctgggacaaagtaccttgaacaaagtgtgtgtttctctcactcactctctctctggaaattattttcacatcccctttattttagaaaaagttgtattttgtatggagaagccagagttcattgttacatgttagtatcatatttataatagaaaataaaacattttactaaaacaaaaaaaaattatttagccaaatttgaagctctgatttaatagtcttatacatcactatatgccagggacaaatacagagtgagagtcatattagatacaataaatatttgttgagttggtaattgaatttgaacaaaacgtaaggtagatgcttctgctttcacgtttaatcaaacaggttacagtactgtctgcaattatgaaaagtatcagagcaatatgtgagttaagacaaatttattaaataactagagttgtttttatttctttaactgtgcatttatattgtgatatatatttcatattctaatatagaatacttttgccaaagctaagactttattttagtaacaaagcagtcagttaaaaatataatctataaactaatgtgaattaaattaaatttaatcctagtctgtgtctatatcagttttattcaaatgagttttcttcagctgaattctgtgataggaagacagtttagctcaaattgtcttttcattgtaatcactgctattcttatgaccatattctatagcttctttgctttcctggtactcacatttcaatgtgaaggacctattcaaatgaattaaccagaatgaatgagttgatatattagagcacagagtccaaagagaatctagctattattacttcttataataagtcttaaattcgggatacaggacattataatgagagattaaaattctatcaagtgtcttaaggatggacataactaagtagcataagaatgtaccatgttttgctaatgagaaactctgacttcattggtggatgtctttaaattttacagtcaaagtagaaataatagctctgaatatttttatagttctcaagcataagatcagaactagaaattaaaaaggagtaacacatacaattttcaacattcatcttttcccagcattttgaattattcttaaagttggcgacagttcaccattactactgtatatctggaataccctgtgtctaactgatttcatcttaattcacttcacattggaccccggaacctctctctctgctctcattgctagtataagtagactcttctccaccatgttcctagagaaatagccaagtcaccgaaacagaaaagatatgagttgaggaccttcaagggtgcatgatcactgttttcatcccaaccccaagttagatggaagttaaatatttctttgctttaaaagttacaaactattattgtttgcatatggagtattactagtctaataatttttgacagaatgataactgggatgctaggatatagagagaaatggaaaaaaatagaacggacctgaagatgattcaagcattttgcttttatggaaattaaactgttttatgagaagatttctgacctattaccctctctttcctgaggagcctgttgcaggtaccttacatttatggccacgtctacgggagagaagtgatgacattcattcataaactgatcaaactgtcagtgttaactgtggaaaggatagagtttctaacctaatttgtaatgctgtaatcacatacttagaagagactggaaaaacataaattggtacaacctaagggaactaacttataatccatttcagcaaaaaattcaaaaggtaggtggttatatcatcaatattcaaaaatcaatagtgtagcagcaacaaaacagtattttaagatgttgtcatttataatgtatctctaaaaattagtgtaggaatatatctggtgaaagatagattacatctctacactgaacactacaaaatcttattgagagaaattaaacaatacctaaattaatgggatggcacaccatgttcatggattagaagattcaatattggtgaaatgtcagtgctcctacattaatgtgtagatttaaagcaatcaaaatcccaattttgttaaaaaaattaacaatctgattctaaagacaaaatggaaatgcaaaagaataagaatatgcaaggctactcttaaaatacagttcctggatgttatcaaggccaatataaagttagagtaattaagacagtgtggtaatagcacaagaataaaaattatgaccagtgaaagagaaactccagtaatagatgcacacacacgttcaccattttttatgacaaaggtaaaactgtagggaagaggggaaaaggtacccttttcaataaatgacagtttttccatatctatatggaagacattatatcttgacccctaactcacactatataaaaaaatacagctacatataagagttataacagtatagtttttagaagaatatagaacatattttatgatgttacaatagtcaaagattgactccaccatcctccaccagaaaaaaaaaatttaaacaattttttaaaaaaataataggcaaggattttttagacaggagatagaaatatgctaaacaaaaaggaataaatgataaattctacttaagacctctttcctgtcaaaagatgccattatgagagtaaaatagaatttacagaggagaaaagatacttgtaataaatatatctgaaataaggcatatcaaaaacatatttaaaaactattaaaactagtgaggagacaagagacaatccattagaaaatggagaaaacacttgagcacttaagagagaaggaaatacaaaatgatcaattaacctatgaaatggtgctcaacaggaaaatacaaattgaaaccacaatgtgattccactacacctataccaaaattagtaaaatgaaaaagtgtagaaaataccaagtcttaagaaggatgtaaaataactggaaatctcctaccatcctgctggtgggggtataaatttgcacaaccactttggaaaactgtctagcaacatggactgaaagtaaacccatgtcccaacaattccattcctgggatactcaccaaagaaatatgtatgttaatacacccaaaaacatgtagtacaaaatttatagcagcactgtttataaaagcaacaaactggaaataacccagcaacaaccagtagtagattggataagtaagttgggcatattcacataatgccatgctctaaagcaaagaatgcaaactatgactacacaaaataatatacataagtataaccaacattatttgagtaaaaggcagacaacaaagaatatacactttattgtttaatttgtaaaaaagaggtaaaataactaataaaagttaaaaggtatgcagtacctatatagatgtattatgatttaaatattatattatctagatatgtatctgtctcaggggttcccgagactaccctcagattcggtgattcacaaggaggactcagtcatcctgtgagttgtcctgttctcatggctacgacttattacagtgaaaggatacaaagcagaataaggacagggagaagtcacatggacaaagttcagaggaagccaggtgcaagcttccaagagcctcttcctatggaatcacacaggacatgcttaatttctccaggatggaattgggacagcacatgtgaaatgctgtctatcaagaaagcttattagagactcggttcctaaggtttttagtgggaactggtcacatggaccccttcttgctatcatctgccaagattcccttctcccagaaggaaactagacttttagcataaagcacattatttgcacaatttaggcacaatgaaccactcttctcagggaatgatgggaaacctcccaaatccgagttcccggacatcagtccaaggtcaactttgcaagccgccctttccaagaatttcagtcttagtcctgctacgttaactcttttctgtacaatatctatatcaagtgtctcaagggctagttaaaagaatatttgaagaaattagagaaaattccaaaaattatacatacaattaaggaagtagaaaattggatgtagaaaaataattagaaaattaatcattattgacactaagagagaaatctgagggataatttaaggacttcctttagataatgagttatgacataagataaagtcacccatagcctgtatctcccccaaatccttccctaagtagagaatatgggcctactttatttgaaacacttctgaaaagtatttcttgaaaacactctttagaaccttctaagaaatgacagctcatttagtcatttgccattcagattgtataccagcttatataataccttgattcattaattatttgctgaacaatcctaaaaattatgtttatccattacccattcatacttttactatctttctacacccaatatgtatgcagttcaggttttcaaactcttacttgagtaaaaagggagaacaggtatttaaaagcatatttctagccaggcgccgtggctcacacctgtaatcccagcactttgggaggccgaggcaggtgtatcacaaggtcaggacttcgagaccagcctggccaacatagcgaaaccccatctctactaaaaatacaaaaaattagctgggtgtggtggcgggcacctgtaatcccagctacttgggaggctgagacaggagaagagcttgaacccgggaggcggaggttgcagtgggccaagatcacaccactgcactccagcccgggagatagtgagagactccatctcaaaaaaaaaaaaagaaaagcatatttcaggtatgttcaggtatggataaagaaaacaacagaaagattaaggaataaaaatacatgatgacgtgaggtctttgaattgtggtggtaagtagatatagcattgaacagaagtttaagtaagtatagaaatctgaccttaggccccttaaaaacctgaccttaggcccttctcattgactacttcttaaccgttagctatgtgctgaataaaagctggaaaaccagagaaattaaagaggaaagagggaggggaaaacaaagtggaagcttcacagaggcatccacaggtcattccaaaaccatagtattatgctcactattagcaacaatctaaatgaagaaaaggagaagaaaggaaaagaaaggccacattgccggggcttacacaagtctaattccaagatttaaaaaaaaaaaaaaaaagaaaagaaaaagaaaaaaaagcgcttatgttctgaataatggacacttctggtaagggagccagaaaaaatttaaagacactttaagcatggccagacatggtggctcatgcctgtaatcctagtgctttgggaagccaaggcaagagatcccttcaagccaggagtttgagatcaacctgtgcaacacagtgagacccaatctctacaaaataacttttaaaattagctgggcatggtggcacacacttatagtcacaattacttgggaggctgaagcagggtgatcatttgagcccaggagttcgaggcagcagtaagccatgatcactccactgcgctccagcttgggcaacagagcaagaccctgtctgtaaaacaaaacaaaacaaaacaaaaaacaataagcaatggaggaaatgtttaggcaataatcatggcgaatacaaagacattaagaaaatgaagaggagatagaaaaaaaatgtataaatgaaaaaggacactgctaaggaatttagtaaccccaaattcatgaatggttataatccaatagaaaaaatatatccaactctacaccattacttaggtcttaagcatatttaaattataaatatcaaaacaagtatcacagggccagttcatttatatacattggttgtagatcattttcaggttaaactacccctttttaatttttgctattattttagtatgtttttcttattctttgagtcctttagaaagtgctttgagggctgtttactggaaaaagtgaattcaaattgctctttgtcaaaataaactttgtaacttttcagttttctaaagataatgatcaaatttgactttttaatgaaatagtttcttaaaattgaaagtgccaaaaaactttcaaatatatggaaagagaaagatggatgtgataggatttttttaactctcttatgtttaaagttatttatttctttattaaatcaaacaactcaggggtttaatttggatagaaataaaagtcatacagtcaccaccacagccttttagaaacatggaatcctaggatcagggaagttaagggtctatttaaagtgtcatttcatatcctcatgacctgtggcaaagcaggattataagctggtcctcctgacccctagtccgtggttcattcttctctgtgctaagtgttctccatggtcaaggctctctgagggtagggatatgaaattaaacatgaatgaatctgtcttcaaggagtttgtattcttttaagtaatatgtgaaacttaagtaaagtatgatacaaatgtgctatgttcaaaggaaaaaagacaaagtggctggaaaagtgtagtgagcaatgcttgtgtcccactgcaaatagcattagccttggattcagactagattctagattcaaatcccccctctgctatttattggctattaggatttgaacaagtcatctgaactctctgtgctgatgttttcttactgtatataaaatggaattggagttgaaaattattaattttcagaactaacaaaagagcagaaataatagatgtgaaatttctagtaaagtacatgtgagacatttttaatacatacttataattcattgctattattactattactcataattgcttatggtggagaagctaagagaagaattttatggaggaagtaacattaaatcttactttccaagatggacattattttgacagttggaaatgaaagggaagatgatccaattagaagtaattaggtagaacaaaagctataggactggaaaacatgctttacatctaaagaataaaagttttctgtctcattcatatcaatgcagggaaataaaagctggaaagtttatgttggtattggacagcatcttgaattcaaactgcattgtaaaggcaacagcaaatcactgaaagtttttgaagtgaaagcaagttaatcccagctatatgtaacattttgggttaaaaaaaatctcaatagcatatatgttagattgatgcagttaaatagtagaggtgaagaaacaagctgaaagcctggtgtagctcttttttctcagccttttctcttttcttccctttttttccttaaaaattcatctcacaaccattggggtggggcagagcatggtaggacccacaccagtgagagatgaaagcagcagcagtggtcccacagaccttgtcagagcctgagtcggatggaggaggcagtctcacagagtatcagcctcgtgtggcatttcagaagtcagttagattcagaagcttgtcttcatggggacggtgggtggcacaaccccatgtgggaagtcagagcttgagcagggagtagagtgtccacatgtggaggtgaactgttggggttttggagcccaactagggtgagtagaacatcaacacagtaggcaatccaccttgggaaatcagagcccaagtgtggtgaaaaggggacttgtcagggacgcatagcatggtgtgaggtatcagaatccaaacaagatgaagagcttgggggtggggagtcagactctgagggaggttaagagggtgtccacgcaagagggtggcccatacagcatgtcagagccttatcagtctaggtgtgtgaacttccaggcagaggttgatcatgtgccggttgcctgagtctgcatggagtgaggagcacagccgcacagggaaggaggtgacagcagagatggcagagattacgtgtgtggcagggtgtgggggtgcagggagaaagttaaaaaacacaggtgaaactgtgtgtataggggtgtgtgtgtgtgtgtgtgtgtgtgtgtgtgtgttccatacacatagtccactgagacagcctgggagcaacaacatactgatggaaaatatgcctaatatccagatgttggtgtctaaataccattatccaataaaagtacctggggctctttggataaatggctcattccagggctggaacaaggaaagtacaacatgaaactagattattattattatttgccagaaagcgctaaaaaaataatgagggcatagcaagaggacacaattgccaacctcaagggggcccctcattggctgaactagaggcctattacttgagaatcaaaataaagatggtgattgattataacactgaataaaataggaaagcacaagtccttactgatataaatagagaaagatggatgagaaaccaggtatttacatagtttcaaagtagctcccaaaaacttaataattataaaagggtacagattaacctcacattggaagagcctagcagatgctttgaccaaatgatgaaggtgaacagtatccatgttgggaaagacattatggtttcccactaggatgcaagaaaagcacagcatcacttttgtgatattccaaccaaagatgtatatccttaatctaaacatttaaaatatcagacaaatccaaattgaggatattctacaacataactgagctataattttcaaaaacgtaaggccttgaaagtgaagggaaggctggactgcgcaggctgaaggggaccaaagagatatagcaactaaatataactaattagatcatttagatacaaagaacatcattaggacaattgggaattttgaatgggatctgaagtttagacagtagttaattttcttaagtttgaacgtcattttgtgatctataggaaaatgtccttgtttatgggaaatactaaagtattctggataatggaggcatcagggcagtcacttactcttcatgcttagtaaagtgaaaacaagggagtagtgtatttgcaaattttctgtaactttgtgtgtttttccaacatataagtgaattttaaagctgttatactaaaatatggggagcagatgagtgattacattaaagaataagaaataaggatatggaggatatgatggtggagtacaagttaacatgtcttggtgtgtatctgctgtgaacaaggaagctgaagacttaaatatgatgctgaacttctgtcctgagccaaccacactaggaagatgtgatgtcagtcacagagacagaaaacactagaaacaaaggctgagattaaaaaaaaaatgatttatgccattttggaaaagccaagtgtagggtaccaaaaaatagctaacataaatgtaattggaaaaactagaaataaaagtgtggagaatgtctggaactagagaacttagaacttgggagtggtaaaaacatatgaacaagataatatagaaagatgaggagagctccttgcaggatacccatcttgagacagtaggaggaagaaagtgaggtaggagagaagctagaatagaagcaaccggatcgaaagatgcataaccagtggagtgccttgtcacaacactgacgaaaggaagatataccaagaaggggcttataaacgatagttaatattttaagcagcatggaaagctcaaataaaataggatgagaagaggcaactgggtttgcaaactgggatgtctatggttgagtttagaaaagggagcattcaattagagtgactgggcaaaaagatagcgaatagaagcaagactttagcatgaactggagctgagaaaataaagtggttggggagactttcttttccagaaatacattactgataaaaaggagattgctaggactttaatttaggaaagaattattaagcatggtagagactggagcatattttatttatcagaggaaacctaccaatggagcaaaaaatattgaatatatataagaaagaatacatttctagaggaagtaggcagtgatataattgaacaaatgcagaaacatatcttttaaaacaatagggaataattgaacctgtgagggcaaatggacaagtgacaccaacagaaaaaattgagaagtgtattagattatccatttaaacaaattaaatgaagtcctgtgcagagagtacaagtatcagatgtggaacaagagaccaggaaatttttaaaagtttgaaaattcttgaagaacaatgtgaaagaatttaaatctaagaacaattagcatacatactgaaataacatcattttgaaaatttttcagcgtgtaaaaatcattctaaaaaattcctagtatcggctgtatgccatgactcgtgcctgtaatcccaacactttgggaggcagaggaaggaggattgcttgagcccaggagttcaagatcagcctgggcaatataacaagacctatttctataaaaacttaaactaaaaattaaaaatgcttagtgtaatagtttgtttcctgccttgtatctctggtggcagccagcacataaagagaataaagaccttggcttgactattaaacatatgaattaaataatcagcatcataatgtttaaaataaatagtcatgtggttacatattatgatgcaagagaagagatatcctgggagttatgttcattgcagttgagacaaataaagtcactgagaagatatgcttcaagaatggagtggaagagtttatctcaattgtactagaaatcaagaaaggctttccatttataaaatagcctattcaaaaccagaattgttctaaaatatgaaacggaatttggttagctgtatatttgaaagcaaaaaggagaatacgtctcaaggaaggtgtctgtgatacattaagaacatggagcaacactagagagtcacttgtacaatgagacaggatcattgtgcaacttgcatgctcactgtctttaggttcagttctctctactgaaaaaatactgtttgagattgtttgatattgatttgctctatctatttttttttttcttgaggcggaatttcactgttgttgcccaggctggagttcaatggcgtgatctccgctcaccacaacctccacctcctgggttcaagcaattctcctgcctcggcctctgaagtagctgggattacaggcatgcgccaccatgccctgctaattttgtatttttagtagagatggcgtttctccgggttggtcaggctggtcttgaactcccgacctcaggtgctccacccgctttggcctcccaaagtgctgggattacaggcgtgagccaccgcacctggcctatctttgtatatgtaatttataaagtgccctaattcattataccctcatgcacgcacacaagtatttgtaaattagcagctaagaattttgtgccatgatgccatcaagaatttatactgcgattatttgtttcttaaggaaactatcgtaacaagtaacatttttatggttagatttaaatgtgctgaatcatgcaaatatataaattatattaaaatttacttaaagaatctttaaaagtatttcactagaaatatgctttatccatattaaactaacaaaagaggcatttcaattgaatttttattttatattatttaataatatttagcatattatgtcatttaaaattttctcaatatgtaaatagttatttgtggaaccatgtacttgtttacataaaattattcttaaagtaaagcaagcgggcattgataagaaatcaagatgctgaataatccttagactaaaactaagaaacaaaaccaatggtatgggaaattgcaagtattgtaatctgtttatgtaagtagtttatattttgaaactactttggttgtatctaattttcccatcctgtgaacttctggattttttagaacaaaccttgttacttagcatttagttttggcagaagtttgtatgttagtcaaatctatttcttaaaaaacctgacatttccatagataaaagctatgaaatctgatagaatggaaaaatttctaatataggtaaatttatttgaacatagtatttatggtgaaagaggttttttttaatttaataatgtttcttgtctattcatgagccattttttgatttctgatttcatttggatatcaatatttctatagcaaatatttattttatgtccatagtataccagacagtgttgtaggccctggggatagaaaagtgaatagagtaaagcctttgcttttatggaacttaaattctagttgaaggaaatagaccaaacacaaacaaataagtacagtcattccttagtatccaaggaggactggtcccgggaccccgaggataccaaaatcagttatgctcaagtccctgatatgaaaaggcatagtgtttgcctgtaacctatgtacatccttctgtatacttaatctctagattacttataataccaaatacagtgtaagtctgtggttgtttgactcttcggatgcagaacccatgaatgcagagggctgactgtatgtggcatggcaaatggtgataaatcctttgaagaaaaataaagggtctggggataggaaatactggaagaatgtgtctagggcattactactttatatacagttatcagagaaagtctcgctggtgaggtaatgtttcagcagaaacctgaagggaatgagggcatcacccatgtagggcaggagcattagaggcagagggaacatatgcggaaccttgaggagaatttttccttatctgctcagagaaggtgggtcaaatccaggggatgagctagaatgttctaaatcagctcttctcaaagttaagcttaagtcagaatcacttgggggcttgttaagcagattgctgggcctcaactccacagtttctaaatcactgggcctggaaagaggcccaagaatttgcatttctaatgagtttacccctgacactgctggtcaggtcaacaactggtctaagcaagtcccattcaccctctgccagtgattggtttagcgtcgtagatgtaatcctatcttggcatgagagatctaaggctacatcttcttagaacgtaggacttcaaagaaatgttttccttcctgatttataaacagagaggtgggaaggacaacccccaactcatcccttttacctaggggcattgttttatcaggatatggtgttcagaaagttgagccatattgtctaaacaaattagccaactcagagccctaacaaccatgaggttctcagatatccattgctggacttccttaattttagatatctgtatttgaaaaaaaaaaagtcattatggaaatcactactagtaggtaatctgttatttgcagcatatagtgtttgaactgatattaagtttttattttcccttaggaattttagtaaaaatagtggctagtttccaatatgtagtgtaaaggttcaggtatttcacaaatgattgcaagaaagcacttaaagttcatgtaacctaatcattaccatgatatttttaaaatagtgaatctctttcttggtgtcagtctaaaataccagaaaacactttgactgccttgccataggtactttggtggaacttatcttcactggcaccagatatagctggaaatcagtaacagacagtatccctagaagccatggaaagaaaaaaattccaaaagctaaggtatacatgtgggcattcatttttcatttgtttgataaacctaaagttgatgtataattactaaagattcatatagtctggagtttacctcttcattttgtatgtttatatcctgggaatgtctaagtcagattattatttactcagaatattacttatggtaagcaatgatgatataagtccttcctcactccctctaaaaatctttgacttcagtgctagcttgcactttaaacatgtattccaatattaagaaacaatcacttgttacaaaagagtagaagtacatgcaagattttatccaaaatccaaatgcataagacataccagcactgatcatgttttgtctaatttctccattcttctttcttttgtggtctattcactaattacttgatgaagaatttgtttttttaaaagcattttcttcataatcttaattttgtctgatgctgcctttgtcaaatctttcattggtgcccttttctctgtgcagatggatgaaatgcttttgtaagtgacagacattcaaaaataacaaacatgagaagaaaaagaacagtttatctgtcaagaagttacagtaaaactgtggaagctccatttggttgtactccatgcgtttagaaactttttgactgaattcatttccattagagtcaccactggtgaacttgaacaactccacaatctccactcttaaattgcactcttgtgtttcatccctcacagaatttacaaaagtggagggtggtttaaaagcaagggtttaaaaaaatctatatttaaatgggcttcagggcctgaaatcctagtcttaatttcttaaattgtactaagatgttttatttttagtctgctgcacgttgaaggaaataggaaaacattagcaataaattttcagatacttttttaccacttttttttaaagggatggaagttaggatcaactgtggtagattcgcctagccattcagaaactttgggcagggatgtggcttttcttggtccctaggatggaattagcctggggaaagctgctagcccttctgaaaacttgtaatcagtgagcagaattttgtagtttttcctctgagtgcctgagcactcttgctgataatcacactcttttctcctgcaagggagcaagtgtgtatcattcttcctgcctgttggatctatgcacaagttgtcaaaaattaatctgatttaaggtttttcttttcctgaactcagaagggaggaaattacagaaaagtatattagtaatagagtaatagactatagcctgagggaaatgaaagcatatctaagcgaagccaagccaggaacaagtacaattttaatgaaaaatcaatgtttcatgacttagaactgacttttgttaggcactaatatttcctgcttttctgtcaacatccttatcattataaattcttttttgtttcaatataaaggtactaaaaaattaacagctaatagattattttcaacctgtttgcaaggctaaagtctctctttgcctttgaaaaactggagtagaataaaaatgttatattaccacaatggatttaaaggctaacgagtggtcaaattgttaattattcagaaatttcttattgaaatgaagaactgtctggatggactggactgtaaagttcatgagggtatgggtatcaacctccttataattgtgtgtgcctgatatttaaaagatatgtattaatctctttggaatggctgaattaattaatattgttattcagaatattatttagtacaataattcataattattcttttcaatgccctgaagatgtatcagtgttttttcctgccatattttaattttattgacataatttagaaacaatgtggagtggtcatttttcttttaatctaatacagaaaaagataaaatgtttatgaatagaagttctgcctttgcttttgctcctgtccccacataccctcttagaatggacaaaatacaggaagaaaacttttacctgagttcttaattttattacatcttacattaattttcacctttttgtgagaaaaataggtttaaaaagtagttgattttttaaccttgcctccacctactagatggagagtattgtcattactgtaaatagaggaaagaaatgatatagaagcccatgacttcaagaagtttatggtccaactcatgacacataaacagatctgaaaaaagtaaagtctaggtaaaatacctcaaaaatgtgtgtgtgtaatataagtatgtatactatacgtaagtattctactaaagagataggaagttttcaagaacagcgatgatgacttgtggaaaatttctgagaagtcattaattctcatctacatcttaagaagtcagctgaactttcaactgggactgggtgtaagcagaggcagaaaagttgtaacagacaggctatatgaggattttccccaacaaatttattcatttattcaacaaaaaattttaaacactccctgtgtaccaggcatgattctagatgacagcattaaaatggtaaacaagacatatcacttcaaggagcttatatttcagatggggaaaccaactatatgtatactatatatatatacacacacacatatatacaaattaagtaatcaagatagttttgaagttttgatacataattcagtgaagaaaaaaagagcagtataatgtgattttgagtgagtttcctgagtaaaactaattttgaaaggatttcggataaatcctcactgagttgatgtttcagctgagacttaaatggaaaaaaaaaaattagcctgtcttataagttgccagaagagcttaccaaggagaaggaacagcagatgcaaaggccttgatgttggaacaaactttagatattcaaggaatagaaaggatcatgaaggcctggtaaaccatggtagagaatttgtgttttaagtgtgaaggagagccactggagcatataaacagggaatcatgatttgatctgtgcttttaaggatcactctggatactccatggagaagagattgtaagctcctcagagtgtgtttagagcacatactgctacaatggtggctaagactaagggagtggaagtggcatgagagagaaatgggtgtatttaatacttttagatacagatatatagtacttgttgatagattaaatgtaatgtaggaaggaaaataaaatgaagaatgataggtttttggcatgtgcgactaagtggatgagtttgctatttcatttggttttgtgacattgtgcaaaaaataagctctttgaaatctaagtaagttgaaatctatgacttctttcccagataggatgaggattgaaaatgttggatttgatatagtagaaaaatatgttgttattagaaaatagaattatcaaattttccagtttgagttacttagcattatatattccaaatattttcctagtttcttttgtaggcattttagggatttcaaaagcatttgccctacttttgtaataaactatttttaaaattaaaaaacagtgcttaaatacacaaatgtgtcatatacagaatactaaaaaatatggtcccttaaattttgccataaagtttctttattcctgaacagatgtaaaaaaaaagttttcttctaattcttttatatgtataacttgaaattgcaatgttagttactgagatgatagtgtgtaataacattcagattctatatattgataacatgcaaacaaatagtacattaaatagtttctataatatcacatctatctttctcttttttttttgccccttcaagcaacaaaatgcattatttttaaccctatgcaaccatctttcttaacctttggtttcaaatttagaacacttcttttcactgattggctttatagtatgatattggtcataagtgaatttaaacttataaagttattaataaaatagttatactccatttcatatttctttttcaaaatgatttcatactaaaaagtttggaatccttgacctaagtcaatgccctcttcctatggatgagaagactgatgtttattgatgatttgattttctgaggcagtacagacagttgaaagtgtgggaacagaaatcaattccctctacttttttcaatgcaccacatttatttcacactgtccatgtagaatcatcagttaaaatgatcatatatgttcaatccctattttcatatcaacaagaataatatgagtatataattaccagaggtctatcgtaataatttctctaatgtgtttaaagaacaagccagagatttttatttgatagagtatactgatagcatcaaactgaggatgccatttgtttattagggagaattttataatttagagtttttttcaaataatatcaacagtaaagtctaaattacttattgcctttaattctaggaatgtcgcattaagtgactaatgaaacggaaataactactgcccatgtaacttcataaatgcccttcatagacatttatgtcagagcaaagatggcaaaatacttgataatgacattatctccccctcacaacctttattttaatgctgtcaatcaaaactgagccagttaacatttctagagaataatattttatcaaatagataagttatttgtaatcatgataattcttggttggggcctctgtgataggctgaataatgtccccccacaaagatgtctacatctaatccccagatgctgtaaagatgttaatttccttggaaaaagagaatttgcagttgtgattaagttaaggatcttgagatggaaaagttattctgcattttccaggtagatcgagtgtaatcacaagagtgctgatacatgtgaggtagcagaatcaaaggcagagaagggatgtgatgacagaagcaaaagtgggaatggcctgctttgaagaagactggggccatgagccaaggaattcaggcagcctctagaaactggaaaaatcaagaaaacagattatctcccttgagtctgtagaaaaagaaagccctgccaacaccttgattttagtcccataagactcatttatgacttctgatctctcaaatatataaaatataaatttgtgttgttttaacccacaaatttgctataacttgttatagcacttatacctaatgaatacaaattctggcacctgcaagtgtggtcttactgtaattgatatctaaaaacatgaaaatgactttggaatcggacagtgggcagaagcttggaagaattttgaggcatatgatacgcggcctaggttgccttcaacagactgttagaaatacgaatgttaaagtgtgtgtggcaaaggtgcagaagaaaataaaggacatattggaaactggaggagaggggtttcttcttaggtggcagaaatttagctgaattgtgcagttctggggaaagccaaatttataagttatcaatttggatatgaggtaaggtgatttccaagcaatgttgaaggtgtagcctttccagacacacacacaaatgtatattatatatacacacttttataaaactatatatatagctatatatacacagacaacacacaaatgtgtattacatatatatacacttttataaaactatagatatataaaactgtatatctacacatacacagtcacacatatacacacatatatatacatatataatatataatttgttgatattatcatctatatgtagtggcagttcaaacttcactttgattatgaagtagcaaatgctacagaaaagtcttaagtatttttatacttagcaattaaaaacagacctttatattgaatctctacatgaaaaggattacattagttttattgcagtattatggtaatatgatttctgcctcttttttctatatttatccaattgcagggaaaaagtattaaaatccagtttggcctcattgaagcacatttgcagagtgttatagagcattggtttatgactattgccctattatagacaaacaaagtattctttatcctttatcagtgtagtgactgaaattatgaattccattcagtttttaatgaaatgtggattacttcaaagattatctatctgatttaataaatgcattagagtagaaagttaattggatctttcttgaatgaatggtgaccactatgtgtgattcataggagggaaagatagaatatgatattctttgagtttgttttatgtgtttaaaacttttaggttagaaaatcaatttttgtgtgatcggttttctcaaataaattatgtaacccctattgatcttacaaaaatcatggagaaattttaattcattttaaaataaaaatatcttaaattttgtaaaaatgggttattaaaaaatgccatatactgaaacacatgtgtagtttattgtgtttttagtttgcaggcagagaaaatgaattttaccccaaacatcagcatagttctagatttgccacctcctgtttttgacacagatctcaactgagcttctaattttggaatcttgttccagttcttatatttcctattctgtattcaagagctcattctgtattaactggtaaagaggttatcatttctgcttggtttatgtagacactctatattcttcattgtttaacaaaatatagaaattcaggtgcttgcaaatatgatggtagaggtgacaaagtgatactcatcacattttgtatatcgttagtagtggcaggaagagccttacagtatgagtattactaacccttacgtacaaatacagattatcttttcgttaacaatgttactctttctgagagatgttcatgtgagagatgttccatattttcaattcaaacaatcttgtaattgctggctgctgctgttgttcacagcacttggctttgcatctgtgcctcttacaattccagtcttgccctttgtttgaggaaacttcctggttcttgtatacctcctgctttcttgatctatttgctgctgtttcccaggtgaaaacccaactgggctatgcatctgaggtagggatggtttcactgtcctagcacatctttcctctattcaccctgatcaccatcatcttggttttgactcttatttaaaaaaaataaaataaataaaactgctttgtattatgcagctattatttttctgacaagttcagccactgtggagacagtttgaagtaaatgtggctcattgttggtggtctaagaatgtctaaagactagagcaaataagaaaatgttaatagagagaaggaaaacagaggataaaaattgaagttcctaagaagtatgtagctaaaatttcgccttatctaattcaggcattttctcttggctttcccagcacagtacttcttagcgatgataacaacagcaaccactttattaatttgctttttttaaatttagaattcacatcatcatggtaacaacaaccatcccttgaatatgtctttgttagttgcttaatttgctacacctaactcttccaccaggcgctaaatattgggactattggccatccattcagaaagtattatgtgcttcctgtctgtaatgcactaaatcagacattgtgctccaaagaagagggttgtaggagggaaggcatcacacctgtatgcagttactatgcagagcaggcttgggataaaaatagacattggccacatctgtgttaaatcatgagctgtgacccttctcatgacagttccccagctctgctaagacacgttctttggaagaagttgcttcacttttcatttgggtagaatatttacagtccaagtaatagatttcctataatttagaatttactaatacttcctttaaacaagtatatgattatccaaaatgtatataggcttttttgattccagttttataaaacaaatcactaatccaatgttgtgttttaaatagaaactttgctgtatgtaatttcagttggcattcgttatatatttacttaatgtgggcatttcttttcagacttatttatgaacatagaccctatctgtatttctacgtctacctgagtatagaaaaatacactgttttttaaattgttatcctaaaatagtggtctgaagcttgcatttttgaacttaaaatagtgtcttggacttattttcaagtaagaaaatataagtattccatagcatgagtatatgtttaatccttcctatactgatgaccatttagtttattcagatttcttgggattacatgcaatgatgcaattaacatccttggttaagatctttacattctctgttataggataaattcctagaagcaatattgtcaggtcatataatatgtatacattttaaataattacagccaaatcaccctcagaataattatacaaatttacattccaaacaatatgttagaatacctatttctccatatccttatcactactaattagtgccagtctttaaaagtttcgcttatgtgatgggcagatatggttaacattttgtgatgtttcatcataacatgattcagttaatgataacactgcttgttgtaaaattgttgcatgaagaatgaagagacagttgtaaaattgttgcatgaagaatgaagagacaaacgcagttaactgttcaacttgtgtggtgcattttgttgcactttgaaaaatgaaaaaaatcaaacatttaaagtttttttattgatggctgctccttaagaaaagcctggaaatactttagtttgctttggaatgtctttaagtgcatagtggtcctgtcgcatttcctgagctgcagtagattctaaatcatcttgatttaagataggcttttttgtaatcactgacagtctctgatttcagaattctgcagacattgtcattgagtggagcagtatctctagaagttataagaactgtactttttgctcttaataaaaagtaaagtgtgtcaaaataatcaaagtggaagaaagcatatgtaacagccatacaaataaattgagattcattagataagctagttggtagaggcaaatgtgaagaatatttttaaattcactactaagataatttttttaaaaaatgttaacttaaagttgctatttttaaaatttgcataatgctttgaagaatgacagtaagacaaatgtcatcacaatcataaaaaatgtgtataaagtacattagtattttaaatttctcctagaaaaaaaaattgctgcatctcttccaagatatataaccaagttagaaaaaaaagttagataaatatgcgtattaccagttaagttcagtttgacttctgcttaccagatgttttgatagaagtctttttcagtgttcactatgatgcctgtttctcacattgctgtgaaacatctaagctatatatactgttttttgataaataacatatggttttgaaaatcagtgttaaaaccacatgaaaatttttaaagtgaaaaattcagttttactctcaatataataattgttttaaaaatctttaaaaaataatgttaaatttcaccatgatatgtacagctgtctaaggagtctattacagggacaaatagaagaatgttatacattgctcaactcaggattacttccttttttttagttttagaagaattcagttttagatttaaccaaataaccagtaatgtatacatctccctgatctgttgtcatgagcacaaaatttatttactgacatgatgctaagaggttttctgcagatactccaaatctgactgggttttgctccatttttctttcactaatcaagacttcagtgaaataaatacatagtaaaattctaataatgctagacttatttcccaaatgtcttgatgttaagtgaataataaactccagatctgattttgtaaatattattttaagatatgcattcttaaatcttgataggcagatgttctaggaggctccaagagagctcaattgggtaactctctcagaggactgacttgctccatatttgcatcatacttttgtgtggtttcattcacaggcacagttgcccatcgtgcaggatatcattaaatgacctaaattaacttttctgcaggaagtggaggaatctcaggataggagaatccagttttaaatacccctgagacttaaattgattcagtcttaatctgggatgactcaaatgacttagtatataatgtctcttgtttctctaaaagagagtctctcaatgacagaggcctaagtctggagatcaagtatgtagtcctgttgactgagaacaggcagaaaaatctgattaatccaaaggaaaaaggcgagggaggtggcagcacagtgaacagatttgcacccaagcacaactaaaagaatgagttagggagggcggggagcggcggcttgtggctgtaatcccagtactttgggaggccaaggcaggcaaatcacctgaggtcaggagttcaagagcattctggccaacgtggtgaaaccctatctgtactaaagatacaaaaattagctgggcatggtggtgcatgccagtaatcccagctactccagagactgaggcaggaaaatcaattcaacccgggaggcagaggttgcagccgagatcgcaccattgcactccagcctgggtaacaagagcgaagctccatcttaaaaaaaaaaaaggagggaggagacggaaagaaatcagttcgtttattttcaaaatgatcaaggatgaatggtaggttcctttacaatttttgatgtatctatttttttaccaactctttattttctttatttatttcagtattttagtttattaagtacttgcagtgttattaaacatagactgaagaatggaaatatgagtaagatatgtgtattaattttaggacactcacatcgtagtacttgtccatgttcctttttttgcctttttccattgatgaaggttatcttctctcttgctcatggctaataattatcactttttctcttaacaaattattttattgttgttatcatttcttacctacaaagttactattctctgtacaactctgttgctagcaaccatcttacaatttggttatccataagaccaaattttgtctctaaaacatctcctgggtgtagctgctcccatgaagacaatatagctacaatggagtatgaatccatataaaactcagtagtcttattgggctcattctctcacagccctgggagaagccttggttgcctgtgtctctttctcatattttgaggcatgcttatggaacagaggtttcccaaccctattcagaccccaaatataacaactgtttgtaagaccctctgtactatgaaaaagaaaaatccattccattccatttaccaacatacgtaatttcaaaagataaccaaagttacctaactttaatattaaaaagagctaaaggaactaaaacatatgcttattgcctaaactgttgaacacaaccacattagaagacagaaagaatactctgatgtttgccactattctgagaatcaccaaatgcaactactaattatgcagactgtcctgtagatctcaggatgtctatcagccctgccctttcccactaaatattatagagtcttaatctaactgggagacccaagtgtccctacacatttcctagatgcctccagaaggcactatctgctatactgagaaccattgctatagaactttaccttcaatatcacttcttatttgtaatgtctgtccctggtggctctgtagaagattttgctctcaatcttccatgagcaaatagaaacttggaatttttttttctgtttcctaaaatagaatacagatatgtccacacttggaaatatgatatatttttatgagtatatcttcaagtggcagatcataaggtgaaatcccaacttgccttatattgtatcattaccatgttgtcgttttgtgtccagatgacattggcagtaagcagcgaaggattcagtaatgttttgataaaaagagcattaatgtaattatttatttatttatttattttgagacagagtttcactcttgtcacccaggctggagtgcagtggcacaatctcagctcactgcaacctctgcctcccagtttcaagcgattctcccacctcagcctcccaagtagctgagattacaggcacttgctacaacgcctggataattttgtattttttgtagagccgggatttcaacatgttggccaggctggtcttgaactcctgacctcaagtgatctgcccgcctcggcctctcaaagggctgccaggcttgagccaccgtgcccagccaatgtaattgtttttaatctgcatcatcttttgaataaaaagacattttaaatatcagaaaatgaccactgtctaaattttctttaaccagcataaatggatgtaaactaagtagtttgcaaattttcatgtctgtttcacttttatctttctccttggtaatatgttttctgacattgctgtgaaacatttcatattacttaaaatgtgtatctttaacagatttttcacttttcagtttaaacatttcacacaatccacacgtatttattaaggacttatatacttgacataacaccaattgatgtttcagtcatcaaatcttgaacacctacttctgattgtctaacccttctttttcaaattaacaacaaaacaaaccaaaacaactgtctcatacaactactccattctccaaagagaagttgtaaattataaaactttaacagtcttattttttctttgatggcctacttaataaatctaaagggactataggtttacaaccttggagtgttgcttttgatttttttccccctgtatcagtccctaaaccaaaacatttacagtactgtgtatatttaataattttgtactgactgcatgaagatataaatgtgtgaatgaatacagcttgttaaacatgcaagtatatttcttcaaagaagagtttacggattctttttccttagcaaagggaagttgtattaaacattgtggtggttgaaatgctgctaatcaaaaattggtcatcgatttgaatacatcttatagcttttctatcatgttgttggtttatttctgaaaacacaagggagaagttgattgggctgccttagctgcctttttctatggtgacaggtgtttagactttaatccctctaactgtgcacatagatgtttctggtgaaaagaatgtactgccctttgtataaaaaacataataatgataataatgtaagtttgagaacggtttagtctacacagttattgacaagaggtacagcttgtactggaggaccagtctggattcaagaagatggtcctaagtgtaccgaagtatatcttttcgtatgaagatataaagaatagaaatatgagtggtatttgaggtgtccgcatcctctttggcactcagaggactctaatcaaacccaatgttgtgtactgaactattcctgacttgtgaaattcatcttttatcccctactttaactttttttttttgagacaaggtctcattctgttacccaggctagagtgttatagctaactacagcttccacctgggcccaagaaatactcccccctcagtctctcaggtagctggaaccacagacacaagccatcacactcagctaattaaacaattttattttttgtagaaactagatctctctacgtagcccaggctgatctcaaactcctgggctcaagcaatcctctcaccctggcctctcaaagtgctgggatcacaggcatgcaccactgtgctcagctaccccaattttaccttttaaacacaaaagctttcattaaatgtaaagccaccatttcctttgactttcaaatccatgtatcagtaaaataaaacaaaaatttatttgaatgcaataatagcagacatatgctgttctaaaatcctcagaaatctggcagtggaaactgtgaagatagttatgatctcatgaagtttgaatatagtcctaaactctttggaatgagagatttgtcagctggattttcatgctctaaatctgacttcaataactttcactttctgccaagatgtatccattatacctcagtatctcctgatattctccaataaaatccactgtcaaattaaaagcttagttctgtcgtttgtgccaggccccaagtgctacccttatattccaaaatcagtagcgctttttccaagttattactcagggagtataaccaactagaaaaaaatttagaaatactagaagcatgttctcctagatttcctacatctatccctaccaacttcccaaagagccctgtagtatcttcacctaccttcctatcagctattcagacataaaaacagctgctttcttcctgggaagatcacgtaatttagaactggcttggggtgtacctctgggttaccaaaaatgattttttaaaaatatctgtcattcaagaaaataagatctggggtcaggtccaggcaatattgtcctgagggtgcttttcttcttctcgtggctgatattcccgcagtgacatatgatataatatgcactaagctgatactgcttcagtaaccatgtctgtgtctgtgacaggtgctactgactcctttcttcatgttattgatctaaaatattttttaaaatgtagaatctacaaaaccctggaggcctttcatccttggaagctggaattattgcatcttttcatccttcttaaagaggggaatgttttcacccttacagttaagttgacagttcatatgcgatgtttacttgactttttatatctggttacaataaatgtataggctgttaacacataataaataatgactcatatatttgatttaaaatttcctggattatctataatcagaatttagaatttctctcctagaagtgtggcgagctgaagctattagagctgtggcctttacaatcctttaacggaataacccatctcctgttgctgatctgaaccgcataactggctaaactagtgcaggcagcatgattcttcacacacaaccagatgccagaaagaagaaaaccacaaaggggctgaaaaacacagcatagagcccagaagcaagagggtaaggtggggcagaaaccaaccagcagtgattggaagggaagattaagtcaggaggcagggctcaaagggcatctgaaggtgagaggcagcagcccgaggatgcctcaggagtctgcgttgtacaagaagctggacattagagataggtcgcaggtcaaaatcagatagaattttgcgatcagagcagacacagcaaaccagaagcacttgaactgttcaaatagcaccttctttccacagcaagtccttgctgttgtgactgcgaatacactggtccactgaagcctgtgacacttgcaatttgggagcttatcacagccggaggaccctgacacagggtgagggtgcaggaaagacaggacatgagattgaggatgctgactcagacaggtcactggaccgttccagtgtttttcttacagggaaagagtgtaggaggcagtgcatctctttgtctttgtcacttaacttttggtgttctttaaactgttctaaattagttcaagatctacaaattgaaggctaaagaagggaggataaataaagcccagcccaagcagttttgattgtagaaacatttggaagtatttgggttgttaggggaaaggagcatagctgattttttttaaattgatttggagtttggttatttgtcatttactcattagttactttcctccccaacaataacaacaaaagataattaccatagtctgttcttacatgaaacactgagaaattttatgtagacattgaaattacttcatcagtttcttctgtgaatgattcatttcacatttcccagtcttatgtaaattactctgcagcatttatatagcattagtgtcatgcaatttgtatcattattgaacatttattttcttttcaaacaaagtgcaaagtgccagaggatgggaagtatatctttagctgcagtttgaaagaaaatgtaccaagcttggtgtcggatgacctgggttctacaaagcagtcgtgtacgtttagccaaatcacctgttcaaatctaggttgcccaaactataaatgcacttgaatgagtgatttttcaagaatgtggggcaaaatgaagtcagagcattcaaggctgtggtatcttatttctgtttcagctactgtgtctgtgctctcagtgtttcatatattgggtccctacgtatgattttattttttaaatttctactgctaataaaagtttcacagatgtgatagtgtccagtatttctttcaaatttgaagtttcatttgatttaatcattttatctatcatgtcatttagtgtaatttttgaacctagtaagtgtctaataaatatttgctggggaaaaaaatgaatgctatggttcaatcatgcaatactcagatgttcgtaaccatttccatgtgaaaagtttagtataggctgtagagaatgacattttagacttttgaggggaattatttttatgtcagcttgaaattcttcttgaacttgatttctgacttgggggaaaaaaagcaagcctgatgtgcacaagctttatacagagaatcaactgtttttaaaagaataatccagctgctatctgatcagccaggtaggagttgttctgtggaaatgaagaagccctccattttcagtcagagtcacgcatataaaggctttgataagattaaaataatccaagaatgcaatttcaagatgcacagctagaaacagcaactaagaaatatccatatcttacaggacacagctaagggaagagtcaggttttaaggaccgtctacagataatgtcaggatgtacagataaatatgagcaactgctgattgagctagaaacactgctggttaagttataaatcttatgatttttacccttcaaaatgcctctttccttgctgctttatatttttttaaagagcggagtatgttgtcacttggaggttgtgctgctttcctgtgactttagtcacctttggtgccctggccagatcccttttaccaagcctgtaaaatgcccagtttccgtcagtgttagctgctattggctcacagcccccacttctcttcagaatcacttgtagctgaaaaacatttactttgccaaaccttatgtgcccatctcccagcactatcagctcatatctgatgactaactgacatggggaatacaaaaagccagtgccctcacttcattaggtcaactctggggcaattcatgctctagtgctccccgtgacatcaggctgaagttagacttatgctaataccacattctcacttagctgctttccctttcctaccctactttcctctctccttttcatctgacaacactcccttaataaatcatgtgcatccaaatccttgtcttaggctctgcttctagggaacctaagcagtgatatttttgagagtatagattctttcttcttttatctttcatcctcaatctccagcacatctggatcatgatgctttacaagtattttgaagagtaagcaaagtaagaaatttggccttcatttggtgtgttagttagtccttgcattgctataaagtaatatgtgaggctggattattattattattattattattattattattattattattattattattttgagatggaatctcactctgtcacccaggctggagtgcattggcactacaacctctgcttcttaggttcaagtgatttttctgcctcgcctccccagtagctcggattacaggtgcccgccaccctgtccagctaatttttgtatttttagtagtgatcgggtttcaccatgttagccaagctggtcttgaactcaaatgatccacctgcctcagcctcccagagtgctgggattacaggtgtgagccactgcatgcagtcagagactgggtagtttataaagagaagaggtttaaatggttcatggttctgcaggctgtagaggaagcgtagtgctggcatctgcttctggtgagggcctcagggagcttacaatcatggcagaaggtgaaggggaaccatgtatcacttggcaagagagggagacaggagagggaaggtccacactctttaaacaaccagatctcacaagaacactcattactgtgaggatggcaccaaggcattcgtgagagagccaacccccaaaaccaaaaacctcccaccaagtcccatctccagcattggggaatacatctcagcatgagatttggagggcacaaacacccaaactgtatcagttgatcaagaactgaccatggaagatggatagttgaagtcacaagcagtccagcacaattctaaccttaccatgaatctgaattcttagctcactaaagatttaggaacagaattggggagtagaattatggtcatgtaaaaatagagtccgtttaacatcctaaccttaaatcagaaaccatcaaagcatcatatcaacaaaaaaattgttttcacttatgaaaaatatgaatattaacacaattttgttgcacacttactctctgccatatgtcttacactaggcattgagaaaatactaaaaatacataggatatgttccatgctctcaagaagttgtgaattgtgaaagaacctgatagttgaagtaataatttcatgcagtgtgcctaaacatgaaatagaattccatacaaagtgacatttaaataggtagaaaaaccagagaccatatccacactggtaacagcatgggcagaggtttgcagttagacatgaaagttaatgcagtgttcaagaatatactgaggagttagtaagaaattaggctaaaatgtatgttgatacagatatgagaaagggctgtaagactcaagattcactttatcttgagggcagggtggcagctatcaacagtgctaaagcactttctcttccactttaaaaattaaaacagtgtggtaaccttaaaaggtgttctgaaacaatattctaagcaactgttatcacttttgctttttccttttttttatcaggtgcttacttaaacatttctcataattgcaaagattgtgacttgtaattatttgtagttactattttaccatgagctttacccacatttttatgtgttttaattttaagtggctaaatattattataaatagtgtgtgcagtataatttatattcgtcattttcattttccctgaaatctttgtaggctattaagaagaacaatgataggatcatatttaagttttagaaaaatgacaccttaaaagctgcaggtagattaggatgagtaggacttggagtcagaaacttcaataagggagtggctgcaatatagactaggaaagaggtgataccaacctgtcagtgtcctcatcggtaaaagaagatacagctgggcacagtggcttatgcctgtaatcccagcactctgggaggccaaggtgggcggatcacttgaggccaggagtacgcaccaacttggccaacagagtgaaaccccgtctctactaaaaacaaaaattagtcaggcacagtggcacacgcctgtagtcccagctactcgggtggctgaggtaggagaattgcttgaacccaggagaaggttgcagtaacctgagatggctccactgcactccagactcggtgacagagcaagactctgtctcaaaggaaaaaaaaaacatacaacaagcctcataagtgcttgtgaaagctaattgaaataatatattaaaagagtttggcatttagaaagctctgaaacgatcattcatttaacagaggaagctatgaacattttttttttaaaggtcagtttgacttttaggcacctgatttcctgaaggactctttgaactctttgaatgtgggtactgttttatgcattttcatgtgataactaaacagcctgatttacattcttgcccaatatacgtatttcttcaaataatgaactaatgaattcccgggcaataaataccttttggttaaatggacaaacagttctgttcagtgggaaacatgctagtagagtctgcttttaaaggaattgctgtatgcagtattctaagaaataatgaggaagtatttttacttcaaaatactttgatcataatatgatgataggtattttcttctcttgcctgtgaaagtgtgtgttaggtatgtacattatggggccaaactagtgattgttgctaattaggatatatgtggcgcattctatcaagaatcccagttttctgggcactgtgagctgtaagtcaagtcataaaaaggagtgaattgtctttttcatatatagcactgaaattgactggagttaattatttaatgcctacctcccctactagactacaggctgtgtcacacacctccctcagcatctagcacagcaaatggatttagtaatatttattgaatagattaagaaatacagagtgaataaaataggacactggttggagtgttgggtcaaccacaattttggtgtgatatattctacatatcacagtgagaaggaaaatgatataaaatgaataatatcctccttaaagtactatacaaaaagaatacttcttatattttttcaagatgatgtaatcttgtcaaatatataatatgttgcatgccagtgctttcttaatccttaatagtaataccagtaattgtatattaagttcctgctatgtgtcaaatacttctaggtactttaaatgtatattcagtaatcttcagaacaagcctagagagcagaatttagttatttcattgtaaagatgagaaaagtgggtctcaaaaaaagcagataacttgtcccagatcacacagtagtttttcttggtacctggagtgattttcatccctctttcaaatacaaccctttggctattgggaagtagctattacaactgtattttttctttaacttgatgtaagggaaagaccactttacacatatacaaataggagaaagttttgccagaccttctgcagctagtatttacatgagtgagtagagaattgtaagaggttctggtagcagtaaaaacaaattacaaacaacggaacatgaagagaagatgttgtctaccaacatctgtcaaatatggcagatgatcttctttgtcttattttgttcaataccactcaatatcatcacttaggcctctctctcttactgtttagatctcttgggattctcttaattttttaaagcctataccttgaaaaattctgtttaaaaatacattggaaagcatatagattttagtaggctgaataatggctactggaagataccaggtcctaatcccaataagctgtaaatgttatcttttagggaaaagcggtctttgcaaatgtgattaagtaaaggatcttgacaaggtagattatactggattaacagtgtgggccctaaatccagttacatgtattcttataagagcaaagcagaggaagatttgacagaggagaagtcaatgtgaccacagaggtagagactggagtcatgtaaccccaagtcaaggaatgccagcagcactggtagctggaaaaggcaaggaatgagttctcttctagagcctcagcagcgagggtaaccctactgacaccttgattttggcccagtgatactgctttggggccctctagttcccagaactgtaagagaataaatatgtgtggtttttagccatcaagtgtgtggcagttttctgcagtggccttgagaaactaatacagacatagaaaattattttatgactttttcttttagatgcagttgttaagtcagcatttgatcttatttgagctagatagaaccagggttttctaatctacaaactattgattttcatcttgatttaaatgtgtttacttattcttcctctataaggtaggacaattttgcaaaagatgtataagaatgtgtgtctcctttcaggttcagctgaaataatcttcatataacaaaagttagagaaaacaatctgtctgagccagagacttcgttatatgaattcatacaaactaatgaaggaatacaaaacttggcctcacagggagagagtggagtgtcttatgcaaatctttgttgtcagccacattcctacatgcagaatgcaaaaaccatgtttcagtttgttgaggatttggaaatagcttgagataatcttaatttaaaaggactggcaaattctttcagctttgtagaatttattccacatatgtcaaagacaaacttgttgtactgcaaaataaactagtactgtgtgatcttagttgaaaaggtaaatattacaatttacattctattctctcatattcattcttttggtacatgttaataaattgcaaaactatattgctgaaaaatctaatgatcctgaaaaatctaatgataaattctagcaattatcagtgattacaatataggcctggtttgttgttgttgttgtttttgtttttgaaaaggaatcttgctctgttactcaggctggagtgcagtgccacgatctcggctcactgcaacctctgcctcccaggaggttgcaattctcctgtctcagcctcccaggtagctgggattataggtgcctgccaccatgcccagctaattttttgtatttttagtagagatggggtttcaccatgttggccaggctggtcttgaactcctgacctcaagtgatctgcctgcctcagcctctcaaagtgctgggattacaggcgtgagccaccatgcctggccataggtctcattttgtacactaagaaaatgtcaaattactaattttcatacttagtgctaaatttacatttatcataaatgtaaacatgtaatagagaaccagtaattttttattttccttaaaaatgatcctggtaaataagagaattgattcataagatcatggtttgttgatgccatagcaacataatcttatattgagaacatcatctgttacaatgcaagtagttgtggccatgtgcctagaatagacttagttattaaagtacattgtgatatgatagaataagatttgtccagatgtttacagagctcttacaaggaattattttagtctgtttctaaattattttagtgtgttcatctgggttgaaatgttatgtgcttaaaggattgagttactgtgatgacttggaatatttaagtagctttgaattgtgcgggtatgttaaatgcctgtttgggaaagaaaaataatatgagtgaacagagattaaaatttgtgaattatctgattgccctagagatgtctctatttgagtttaaaataagagattggcctggtgtggtggctcatgcctgtaatcccagcactttgggaggccaaggcaggcagattgcttgaacccaggagttcaagacaaacctggacaacatggaggcacctcacctctaccaaaaaaaaaaaaaagaaagaaagaaaacattagccaggcatagtggcatgtccctatagtcccagctactccagaggctaagctgggaggatcgcttgagcccaggtgggtgaggctgcactgagccaagatagctccattgcactctagccctggagacagagtgagaccctgtctcaaaaaaataaaataaaataagagatcgaatagttctgttttaaaatagtctaggtgagaaatgatagtttggttttttttgttttaatcatattgtttaaaagaatacttcccagcagagttttattgggaaaccacaccaaaataaggaacatgctgggggcaaattcagtggtgaacataaatctgaatgttaagaagacaaaggaggcaacaccagctccagggcagaaggagagttgagaaagttaggaggggctgacactaccaatctagcatccagagaggtttgatgaagaaaatttgactttagggagttgtgaatttaagatcagaagtgatttatgcgtagaaaatgatttctgtcatttcacctgattcttgtaacttcagcttgaagtttctaatttcaagaaaattagaaatcactcgtcagctaagatttggggaaaactgttaatagtcacatgtgatgttattaacaatttattggatagctttatcgatcctgtttctcaaattatacttggttttacagattttagcctttggtttgactcttcttttgccccatttttcttggctgctccagctccactgctgagttcactacaggtcagagaactgttcagtatttttaaagcagaaaatgcggtgaggatgggattttgtaatgtaagtttttaatctccgtatctgagcattttggttcgtgcagtgatcccaagtagctgagatgaggcaggctccagtatcttaacctactaagtatgtgtaaacttgatagagaacacaattttcctttaaatatcttagctctctagtctctcaaattgtgaaaacatattgggggcagattgtgaaagaaatatgttcataaaatataaattcagtgatatccatggaaagagcaaactcagagtgaggcagatggaagaggaataacttggatcatccaggtgggttaggtgttccaggaaatactgaggacccccagccagctgtttgatctggcaatactggaggacggtgcctcagcgatcccttcaaaatcaatgaagatttttcctttactccgtaagctgggggtcattgacagtagttggactcatttggagtgaggtgcatagaaactggcttttaggaattcaaaactctcatggaatatgtgaaccacttggattcagtggatttgaaaataatcgaaaaagtaaatatactaaaggtcaaggaaaaatgaagtcacttgcttaaaggctgctgagtattagattttaagagaagaaacgtaagggaccaaaagttttcatggcaaaaagacaaaacaagcacccctctgtcccccgaccttccagccccgctaccaacacacgcagtgttttatgaagtggtcgcaggagaatctgaagcagccataaagaagaaaggagtatgagagatccaactgtgccactaacaggcacttaatttcttctgagaactaatttataccaactactctagcttttcaaatagcaagcaaaagccaatttgcatttacattgtaaaactctgttttccaaacagtggcgtacagagtgttggtggtcaaatctctaatgtaagcgagggatttggggatcaaatatttcctgaattgttactctttgctagagagtcaagataggcgctggtatgtaccctccaagaagaaataaatggaaaacacacacaggaaacaaacctttataagctttcttcaacattatctcatataattcttagaatatatataaaagaatattactactacattttatagacaaagaaactgagattcaagttatgtaacttccccaactctatacattggtgaatggtcacttcagaaagccttgctccttctaaaactccagcctacctctattaggctgtgatttaaagttcaaatgagaaacacagccaacaagtgcagagaaattccgaagtcccttgggggattgagggctggaaaaggctttgtggaagagatgaaactttctttctttttttttgagacggagtctcgctctgatacccaggctggagtgcagtggcacaatctccgctcactgcaagctccgcctcccgggttcacaccattctcctgcctcagcctccctcccgagtagctgggactacaggcgcccaccaccacgcccggctaattttttgtatttttagtagagacagggtttcaccgtgttagccaggatggtctccatctcctgacctcgtgatccaccagcctcggcctcccagagtgctgggattacaggcgtgagccactgcgcccggctgaagagatgaaactttcttatcaaaagggtccaatttagacaagggaagatgttgagtataaaaaggttgattatctagaattggacaatctatagcccactgaagtattttgggtgtgtttgttagatactttgagaattagaaattgtgaaatgtagttattagaaaattttagacagccaagaaccatttaaaaataaggctcccatcttttcattcattcactcaaggccaaaaaatattttaggattaaaaaccaatctcaaactctaaaatatttattaataatttagactttatactaaattatcttggaaaagctagagctcaactaaaatcattttttaaatctggttcatctgtttaatattaaggcagtctctaatttagtaaataaacacctctaaaaattgtagtgcaacctctattaacgtgatttaaaccatgttgtgtattctcctgagatatgccagattaaggaattatcgaagccttggtggaaaatgacctactcaaaatgaaaatggaattcataactaaaagcatcccaaaaaacagctagtcttaacccttcatttcgtaaataagcagagtgggaataggtttaaaatgtcgaccatctttactattttagatcacatcacgttcttataatttgagcactagtaaaggttttatttgttttctatttctttctctaatattcaaatgtgattttgttcctgtttgtgctttgaatggcatgtttggatgactgtcccagatctggcattctgagattgtaccactaaaaatgtcaagtgcatttgccttttaattacatacagtacctggattttaatattttagatttttccctgaagaagagacttttctggtcctgtagtttgtgggagggaaaaaaatatcactgacattatcatgaagctttttcccccaacgtctccatatatccacatttatcatttcagaacaatttcattttgggtcaggtttagttgttctgtagcttactttgctataaacactatgtttaaatatataattccgcactgtttgtttgtacttctttctcttatttcccattaatgttcagctcagcttgttttactcttaataggccattactacttggatgtcacatatgtaataatcagtatgtggaaggtatagtttcttgtgatttacactcctttccttcctttacctttggcataaatgtgaaccagctcattactttccagggtatttctttttttacttccccaaattaaattttaatttcatcctattgttattctctgatttttattatttcaggtgggcaaaaaagtcttatttgtcaatgaaacaactccataaccactgaactcccttttgcacctactacatagacaaggtacttaaagcatttttgcttttgagatgatacagttcctcaacttaaaaaaacccacaccatctacctccgtgtcttcttcagaaaggtcttctctcagctccaaatctaacacagtcaccaaggcactccaccttgtccttctattttaattctcagtatggaagtcctcactatcaggtgatccttgtttacttgtctattgtttactagacaacacagggatgtaaactgcacgagagtggagatattctctgttttgttcagtgatgattcttcaaaccctagaagtgtgccaggtacatgccagggacaacaaataattcatttaattaatgaaaggaaggaaacaaaaaagtaaatgttttctttgtgtgtttaagatggggcatggaacatgtattttttttttttctttttgcttctaaggcttcctctcagaaccctcccagattccattcatttgtctatccatttaagtctgcttttatttgtccccaaaagaatgtgactgactgccaatttatgtgtatttatatctccccagcttttcctttctttttgttaggtagtagttgaggttgacacctctattgtatcccccacctcacccccatgttttgaaaaggcagtgttaaacattactcctaatataggcagcttaatcacatttctcccaagtgaaagtgccagatgggagtcagaaagcataggctatatttttaattatgtcagaagttaatactagaactattaaaaagccactttcctctcctgagattgtctttctttatttgaaaactggagttggactttttttgttgaatgattctaagaaatgttttagattgtcaagaaatcagatacaaattcatccccctgtggaggagccctatctgtgcctcttctgtaataccagtagccatggtatgtattgcagtatgatgctaataagtacagtcatttgagtacttaccatattcttcttctagtttatacgctctctaaaggaagaacacttgttcatctttctggttttttagcctagtacaatgttttgtacccatcagataattcaacaaatacgtactaaatgataaacaataacagattcttatctctgttttttttagaaagtagacttccctccatctaatgctgcttctgtgatgctataatatttatggtgcagaaatctagatttagaaagagaactttattcgaatctgtttatacattccctaatacttactgaggctttatgaagtaccagatattgtccttagcactttacatgtttcaatacatttaatctttgagtcaatctagaaggtagactcaatctccattttaccaataagaagtgaggagcagtggttaacttacctaaggtcaacttgtggcaaagctggaattcaaactctgattaatggttttgttttatcaaaaaaaaaaaaaattaaggccacctgacaagaatgttcactattagtgtttttccagagatgttgaagctctttaccaactgatgctatgaaaagcagaatttttctcttaaagaatgttttagattttataaattagttcagttaaccctagcattaatgtatttgtttcaaaaaaagtttaaaactttaagcagtatattatagttgataaatgctcttatataagtagcataccttgacaaattatgagcatttttaatatgttacctattcattgggcaaatatatattaaaagtttataatgtattggtaactatgtaaaaatcattagccataaagacatgaatgagattatatctttgcccttgattcgctccagacctagtgtgagttgtagacttgctgagaaatatttgcaatacaatttttatttgggttatgggaaaatgattaactggtatttagaggtgagagggtagttaagggaaaggtgttaggaacactaaagaacataaaagcccatgatcccacttcccattttggaagcctggcaaattaggttctcagaggacctctgcagaacagtcctaccctggataggacacatctgtggatacattgctggacttacagtggctggtggagatatctcaggactcactattctgccaaatatatatatatatatatatatatatatatacacatatatatttatttatatatgtataaatatttatatatgtatatatatttatttatatattatatatatagagagagagagagagaaggagagagagagagagtgagagcgagctgaaaacagtgagcaacaggcagaaagagaggttggtaatacctgaagggggatgctaaaactatattgcccttgagacttttatcttcagactggtaataagagtgttgcctagcctgggactcccatatggagctggcagaggtggtctgaggtctgagacacctcatagctactggtaggagatgtaaattatctttgagatgaaagcatgatcaatttaggcctgcagggttcccacaggctaacataaagcaattaactcacaatcaaaggtcaccaagcattcttgaaagtaactcactttcaagagtgagagttagcagaaacaacagatgtaaatcctcaaaaaaactgcaggtattgggattgtcaaatacaaatagccttgtacaaaatctctaaagaaataaagtgcaaatcataaagattaacaagatgctatcaggaataactaaacaaagatccgtttacgaagaaccaaatggaacttgtaggaagggaaagcataattgttcaaatttaaaaataactctttggatggacttagtagcagatttggcaaaatgaagagataatttattagctagaatttaaatctgaagaagttacccagaacaaaacataaaaaagagctaagatgctcaagaagaaaagaactaggcctgggaatatctccataatatatacaatatgttacagaactatagtagttgaaatcatttactgtcagcacagaataatatgtttcctctaagaataaaatggaaaatccagaaagtgactcatgtacttaacgtaattttgatataggacagaagtggctgtgtagatcattggatcaattcaaaagttatgcacaggtaactggatatgtatgtggggacggaggaggacctgaaacaactttctactatacatcttggactcttttaaaactttcaaataaaaaagaggatttttgaaaaactcagctttgaaggagcttcttaaacaataggccctaaccataaaaaaaaagattgatatatttgacttcattaaaattaataactgttattcataccataagtaaagtaagaagaaaagcaactgatggctttcagggcacattaccccaaaatatggcaccttggcatactgaatattttaacctgaaaaaagttggagaaagtgacaaaaacaggaagatctctctgaccttcccttgaagcagatcataagaccctcatatgagaagtgtcctccttatagctaggggggaaaataaaaagcacctttctttccgaagataagggacacatagaagaatctgaacaaacaggccttgctaagttttctgcagtttactatacttagctcatactcttcgccctatcatagtcctttataacgtcacccttcatcaaacctgctataaaaacactcgggtttaactgttgcattagttcttcatttccttatgaagtctaccatgacttgtaaaacttatattaataaatttgtatttttctcttcttaatctgtcttttgtaataggggtcctagccatgaacttttaacatcttgaaaggatggttttcatcccttatacagtctgataggagaagatatttgtaatacaaatttcagtcaaagctatatactgagcatttcagagaaaaaaacaggtagagatatttcaggtatctcaaaaggtcattttagtagtaatcaaatatgtattacatttcattttctactactgaagtgacaaaaatcaagaaggctgataatacaaagtggtaagatataatttaaatggggttggcatacgctgctggtgggtatgtaaattggtaatagtttggtattatcttgtaaagctgaatatttacaatctttgttttatcaaaatgggatggataaaactcagggaccacagtttgccaactcctaaaataaagagtatttgagaaatggtgaaaggattttaatgataagagtatatgaatgaaagtgtctcagaagatgaggttgaaaatgttgattggcacctgcttgtgaaaggccgtatgtgtcataacttttgccttttcctcttgaatgtaaagcagtgaagtcatttcttcgcatttaccttttagaaaactcatccaactagtaatatgtaggataaatctgaggtagccaacatgggaagcaggaggactagtgaaaaaacaagattgggtcttgaaggcagtcgaaggtggggtggagaattcagaaccaatttcagagagaactaagcagatagaatcaactgtgtttaagaagtaagacagtgcactaacgctctattttacctaattgaatgaatttagtgggaagcttgatgaaaaattaatatgcacattaaaacatttcttcttcattactatgaaacaaaataatattttactttttttaccattatatacattcctaaaatatacttattttattgctttcttaaaaagtatttctgtcacttcagaattttgtacagcattttgaactgtgtttttaaaaccaaaacaaatttagagactctaagactagaaggagatgccttaagcagtgtaaaattaattttcaatatctgcagtattaatctgtaattttatttcttagttgtttaaagtcttcatagacttttgcactattttccacatcagaaatctttggatcacgtccatatcattattaaaggagaataaattattttccaactactgttaaagcacgtggcatttagctgctctcttttctcaccagtaaaatctctggtagaccctgttttagtcagtgatctaatactgggcaagtttcataagatcacatgcaatgaggaagccaaattacttcaaaagatcattgagttaaataatacatacttcaagacacccataaggtttaggtgtccagtgtggcagcctgtgtaataaataacatgtgctttacaaaacctgtcattgtatatttatataataggcagctaagattttttaaaagctgtttttcagtaatttcatttttcctattcatagtttttcatttctatgtaatggacccaaagaactgacatctagattatctctacctagagcagcagcgtctactactatttctactatcccatgtgttttagtttacaaaaacctttcacaccattatgttacttggtattcctaaaagctacacaagatgggtaatgttattaattttttttatagatgaaggcattcactctaaaagattctcacttgctcattgtcacacaacagataagagaacaaactaagaatcaaaacagggtcttgctgatccaatcccttgtgctttcagtgacactggacttttcttgcacattggtttggtgataggtggtgacagatggtggaaatggttagctctataaaggaatgtaacaaaggggcttgaaatttccagagacaactcagaaatgtttgttatcaagttcatcttatgttaatgtccacaacagtaagagatatgtctgatcagagacatccttgtgttttttaaggagataactgattttctatatgccagtgcaacctagcttaggcaggcttagtggtggtctttcatttattcaactaatattttctgttctgttgctcctttttaggtcctactagaaattcaatggtgagcaaaataaatatggtttttgctttcatgggctttaccttaacagcaatgggaagctattggagggctctaatcagtgaagtgatatgatacagttgaaatcctagaaaataccgtgtgctacaatgtgggttttgaggtggaacaggcagacagtatattcagagatttaacataggtggctgctgtgtgatctgcctgagaggatactgatctgaatgaaggtagtagcagtggggatgggaaaagtgatgacaaagaatatttaggaagtagtaattttgtaactaattgtgtgagaaagtgactgtgcattccagtttgcccaagataattccagtttttgttttccttcaaaagcatcccaatttggatgataaatgttaatcctagagataaggaaagtggaggattcaagaatgatgcataggtttctggcttgaagaactgtatggatagttttgccatttactgaaaggggatacactagaaaaagaactggcatgagataagattatgagttcgggttggacatggtgtgcttaaggtgactgtcatacattgacgtgaagacatattaatcacatgactccatgggtcaggaattcgggttgcaacttttggtcagagatatatcgattagagagtgatcagttatcaggatggtaactaaagagatgaaaatggataagatcaccaagccagaaagtatggaacacagtgtcaagaggcataggtccctgaggaactcaaaggggcacctatttttaagggatgagcaaacaaaaatctggaaaggagagaccagagtcctcagaaaactaggaggtacccaagttcatggaagtcccaggaaaagggtgttccaagaaagagggagtagacaggaatgtcacatgctattaagaggtcacataaaataagactagaaaagtacacattgaattcagaaacttgcaagtcattagaaacattggttatggtggtttggtgtggatgggggacataagcctgccggtaggattttaaagaatgattgggaagtgagtgggaacagtttctcagatctataactgaaaaagaaagaaagcactaatgaaatgccgggaggatttgcagaatttgagtgacaataatgtctctgaagacaccataagattacttaatacattgtacttacaggcttctatctctaatgtccattatgaaagtagaagaattagtttgcctaatcacagctattaagatagttttaattttttaggtaaatttgtgtgactttaaagctatttcatttttaagtagtgggagcaaggacacaattgatcaagtcactttagctatttttaccccccaaaatgcatcctagaaatttgctcaataaaaataaaattgtgccttagttttttttctcgttgtacaaagaattatgcttctcttggcttctgaacactggggattccttatatgctctttggcagataaaaaaaatggtaaagatttatggccaaggaaagcatttctgaaaaaggtgctccacattgtctttgtgtatgtgcagaaattataaacagaactcaggggcaccaccactataatagctttttgctctctttgaagaaaatggaaaatgctgacttaggggctactgcttgtatttcctttaatgaatcttctaagcttgaatgattttaaataggatatttatgttcctcggttatagcaagccaagtacttaaaaaaatacatgtgattaaaatatccaaactaataaatatatacagacatatttagtaaaaactactgttcatagtagtaatagtaatgatagtaataaatgccacagctaaagactttgaggagaattcacagtcaaggaaaacaaccaccaaatcacatgtatttggagaatttgattagacttctatacttaagtttaataattatgttgaagattagtgaacaactcttggcacaagaattgtcttgacagacaggcagccttacccaactcaaataaataacttaatgggcttttttttctttattaaccacttggtaaatgtgaattgaagtctagtttttaacaaagacatatagattatgactttattatctctgatttgcataatagattatgaaagtctcaatgctttgtactcttggtatacctgcaagcgttttagtttctatctatgttaaaaaaattactttcagatttggctttttatttctggaaatatgtttacatgaattcattaacctatctatattacttgtaagatcttaaaaatgtcttcatcccctgagtttgaaattgttttacccatcaccctcatgtcagttctgttattttattactaaacctaggtaatagtattaaagctgctgttcttacttcatgatgatagtttatatttgcacctacatacattatatatattatatttgtacccatatacattatctgcttctggtagggattagcagctctgaagatttttgtaaaatgtagcatatgcgactcataataaaatatatttagaaaattataccataatagcatgtattttatttaattaaactgttatgaaaaatactgacctcattaagcaagaactgctcttccagagaattttcagaaacatttaattctataactcagatatgtcagaaaatcactaagggatcattatcattagcccctgaaagccaagtgtctcatagaacctgaagaaagtagtctttgattagtgaataatgatgatttgttgcatggactaaagctttttttctagagatttctacatcaaacttctgtttctcttcctatttgaagtagtatctgtggcaaaccaatgtaatttgagttacaagcaatgactatgttccttttaggttttttcattcaactttgtaatatattccacctgttttcaatatctacatatatagagatatagatatatgtatatatttctaacgtcgccctggaaaggaaaagatctctaacatatttactacatgttttggtaaattcaaccataaaataatttgaaagccttaaggtatctctgttcataattatgaggttagaaattccctacagccggaatatatggaaagtgtcaagtcagaaagggaatctcccttagtttcccaaaatacaccagccaaagccttgctttttctgcttgagaataatagttagtgaatctagtctatggagaagtttttatgcaattgaaataagataaattaagacagttatagtgaattgttttacaaagttaactgttctgacgcttttatttgagctatgtctttctcaccagtttagctttaaattaccattttatataatgatatttacattagatatatttattctttcagatttcttactttgagaaattaatagttaacctcaacagtctccttttggcagaatctgtggctgttgggaaaagtggagcagatacttggatgtatagaactatgggttgcggggagggggatagagaagccaagaggagaaggtaaagaagaaaggatcagaatgtagacaaatggttgatttttaagagctgattaacagattgtccactggaaaggcatgaggttaggtttagagatttctttgcgtatctgttcatgtggacaccatctcttgactccaagtgcaaggtgctgtgttgggtgcttcaaggcaatttcccaaatgtgtctaatcctgagaatcacctggactcttgttacaccaatttttagcagtaggagccatggatctggagacattgagaaattttgtgttaaaagacagaagatatagtagattttttctttgctcttgagcaatttataaactatccttatctttgtaagcctcagttcctttatcgataaagtgtagataataatactttccttgtcaattttcaaggtaaatgaggtaaaaggaaaatgtcctcagagagttactggggcttgtaaaagggttaaagttggtaattttaattgattgtgtgtatgatgagtagtcagatggttttgagaaagaaaggaagttagggcatacaaagaagtttttaaaaataatcatcttctcaaagttgtttcccaactttattatctgggttttatttaataaaagaatttgaaatattccttggtgtgtctgtttttctttgcctattcttctcttgtgccaactcaactattcatctcaaattatatatattaaatcataaacacatgcttctaacagttatattaggcatttatttaacctaaccccttctgtcccagacaagtaccattaatactgccttaaagcaccaagcataccacctggcatttgagtcaagaagcatttgctgaattgactgataaacctctaaatctgaccccatctctttccaatgtactagttgctagacaaccttatgttcggactttcaaggacacttggggaaaactagttcatcattctctttgatatttattgtggaggtttgttttattttttgtgttaacaaaacctcttgtcagaaagatttccttacctcaaccctaaatctcgtattgtattttagcatgcttctgtatttacattgtgggattatttttattaatatacaataaacaagttgtgtttcttggaggtaattactgggaataatttttttctgtgattattagcttctttcagtaactgatttttttttttatccatttagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggtaaggcctaatattgtcctgtcccactcacttaccatttatgtcactggttttaaaaacctgtttttctcaagatcctttaaattagaacaaacaacaggaagaaaattttaattttaacaatgttgtcagcacctgagtctattggacatgctttctaataaattcttatttggttatttgcagtttaattttggatataaacatatgctttttgttaagttgacctagaaattaatatccgaatttaaatgtctcaaatgcaaaggtacttgagatcatttatcttatatttgaagtgttattattaacaatggcaaaatatggatttattgtgatacttgggctgtggtctaggaattattttgtgctctttttctgtatttttctacttcttggctacaaataagatatgagaagaatataaacattatttagtaaaattgtacattaaatattcattgactaaaaattttagccttttaaaatagagagtaaattgttttaattgaacattaactttttatactatatcaactaatatcaccatcttctgacgttacttgaagatactgagacctactggaatttaaactgagctttgctctggagaccaaagtatattcctgatgaaaagcatttcaaagtacacagtttttataatatgagctattgtacattatataaaatgccataaatctgtaaggcattgtcttggaaactaatatagcactctaatccttcccatcatgtatttgggttaatgctacaatttggaaggacttttaaaaaaaatatttataagcaaaagtacagtcctaaaatagtttggtgtatagaagtggttgtgatcagtgaattctattgaaaaatataataagtgatgttgcttatattacattaaattatctagtttactattatagttattttatacttgaaataaagcattaacattatagataagactcatactacatgttttaatgattccatcagagtttattttaatatattgcctctttacgattatcccctggagatatatatgttggagaagacacatctgcattagaaacattaggtatgcattatagtgttttgtgttaaattagctacatacgtgctttccccaaatagtgctttctcttgctgttgtctccctctgtggttggaaaatacatcatatgtgaggcaaaagttttaagtattttagcaataaaaatttgccagtaaagatcaataaaaatcaccaaatgtaaccttcagaccttatgtctctgtttagtttaaatttgtatttggagacttaagtaaacaatttagagagtaaagttaactaaacattgcttcacaatgttctggtcacttcagattggatgtaaacatgaaagtggcttctgattatatcctcattcagctagaattgggctaaactattcagttttatttgttatttatttgaaaacattcatttgtcttgataactctccctatccaggcctctgatttagcaataatgaaaaaattgaaaaattaacctcctaaagtatgctaaaaccatcactaagcaagattttgggggaaggtaaaatgctctgacagctctctaaaattgtgtaatatgacaacttgattttctggttcatatattaaatggttaagttaatgagcctctctattaaaatatttaacatttgagctttcataattatgctttgattgtcttttgatagaaagtatgctagggcttttgcttctgttcctcaccatcacctttatacccaggaaaagctgcacttttaaagatagaccaggtttcattatttagatatgttaccttctaatatatagtatttatatctacattacttgaatttcttacttaccaaagcaattttgtaatgacttttactcatatgtagcgtgtcacacatgtaccatgtatgctttaatcacaagtatgtttatcatacatataaaaaagtatagatatagcagcattgcattggatattatcatcaagtatagcttaaaactattaatataaaatgtttcccttttaatatataaatttataataaaaataatggaaaaggaaattactttagcctcttatctacattttagtgggaaattgttaagtttgattttatccctcactgggatgaatacatgtagatatatttcttatgcggaaaacagttccatgtctttttggttgttttgcaaaagaatggtgtataattcaattgagtaaagttttacagctaaggatatgtataaagtaagtttttaggctaagaaaagggatattgcatctttcaaaacgcaatgtcattttttaatttaatcgctattcaattatttccaaatgtatgccattttttcattggttgtgtattatattttacatgcacagcatgaacacattaataactcaaacataaatttgaaattatgtttcaatacagtaaatgtttgtgtatgatatcatgttcacatgcatctactgtagaagtatctgtgtatatatagtatatggtatatatgtatattcacataacatatgtatatacctatgtaccattaagatataataacttgtttgtagaaatttaggtgttattctgtatatatgatatattaacataatagatctttatgttttgtatctaaagaaaaataatctatatagtacacaagttctatgcacagctgttccatctgtcatatttagataatggatgatattatgcttaactgcatgttgaaaatacacaatccatttaatttttcaatattttggcaataagaaataccagcatgttattttttccaaattatgtattttaaattttatttttatattgcatatctgtctgtttaattgcatggcaaaaaaaactaacaatgcatgagcaaattgaaatgcaaagcaaaaaaaacatgaattttattttattttattttattttttaacgcacatttttctgctttattgaatgtgacagagtcacgcttttcattcaccattgcttctctttttccactgtctgtgatttgcttgccaggaggagctactattcttactcctactacctgtaagtagaaaatgggtgatgtacaactttacgtgtgttaaggatgcagtatcccttttcaaaaacaaaacagaatgcttgcaattttggtgacatttcaaaaaaaaagttttttcagactctaaaactataaactttatctatcacctattttgccaatctttttaaaaagggatattgtatttctgtatgtccagctacttttaatttagttataatttccataagtagctttagtctagagccaaaaacataatttatttactaaagttaaacctgtaccttatcttagcaatatggcacttcactcatctggtaaatgtctgttttaatttggtggctacagtaaaacagacttgaaaagttagtcatgttatttctaaaaggaactaaaagttgatcaaaagaattaattacccaggagtatcaaaacttggctttagcttgaatatttattgaattactctagtaaggaggtatttattttgcttttaataaatataattatattttatgatatttaagagaacaggaaatgatgagagatttggattgacagcttgaatattgaaatatgcatctgacaaaatacttttatagcaaggagcaaatataattgtttgaatgtcaaacttaattcctgaaattgtgaccagtgcttggggtttctaaaccatgtttgtaacattatcctcgggctcacctggactatttattgctggtgttaactctcctgcaagcctcaaacactaaggatgcccttttgtatttgccttggcagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatgtaagtttttcattaaaattttaataaatgatgttacaactcatttcactttgaattctacacgataccttttgagtaatgagagagagtaggaaagtgaggggagaagcagctagaaagaagagaaagagatggagaatattatggaatttacaagaaggattctcatcaagattgatactggatttagtttaacttcaaactctatgaattttattactgtatcacaagggatattccaaacatataccactcagtccatagcacgtgtcattgctttaagtggaaatacacgattgcctacaaaaagttagttcatgtcagaatttataattctttttccatttgcatcttcctttgtgtaagatgaaagtctcttttgcgataagaggaaacagtaattctttttgggaattattgacataggtaaaatcattgcattaaagtagtatattgtagactcctggaaaattgcaatactaaaaagttaactcagggaaacattagtctacatgctcttaagtatctggtgtgaagtccaaaagtatacttgaattgggggttttgcaaggcatagtgaaattcatccatccatctgtcttgaaaattcctaatgttggtctatgaaggcaaggcttttaaaatatttccgctgaagtaccatttaaaagcagatgattttaataattaccccagaatcaatattactgtttattttcaaatttcatatgaatgttatattctgttctatagtgcatctgtttaagttaattaaatttaagtgaaattgcctaactttgtttcttcaaatcctcaagtaaaactgatgcttgaggcaggcaaatcaggtatatctcttgagtatactggccttgtataacttgggccttatggcatttggctcagatcgcagagatatgctcaccccggtttggaaaacatgggtataagcaaagaaacaatataagtattatctcctgtacaaactatgaacatatgtaatagtaagattgaaaacaaagtatttgtaggttgtatgcttgtatgtaaagagggaagtttttttctgaattgttcagcttggagaaatttttcagtaactattggatctaaaatgaagcccatcattttctatgtatatatgtataccaaattagtagttaaggatgctatacatgagtcattttggaatttagttataatcatgacagggcctttcagatctattttatttttatttcactatagataaatgatagagaaaaatgtaaaatactattactgttgaaagtaagttttgcggaaaataaagatgtatcatctctttaactacttaatttaatatttaatcaattaaggttttgaaagcattcatgcctcccaaacttgtctatctattgcctaccttagggccttatttgaaagtttgaattcagcagtgtaactataaatatccacttatgaacttagagaaaggattaaatctatttcccacagataactgaaaaaaattatttggaatgaatatgagataattatttctttaaataccttacacttgatagatctaaaatacatgggtttttttttctttaattttttaatgtcaagtttaatcttctggctttttaaattaaacagagttctgaaccataattatagatacacctctcttgatgtttagatataacccaagctgagagagaaaattttacatttgcagaatacagtaatctgagaaagtttaataattatatttcttaagaaagcataaatctattttaaagaaaaaagattttaaaaaacaattttagagcaatatattccttcatgagctttgttttcctgcagtgcccaatgatccacttgtaccgactgctgtgttaggtgaggccctaaatctttatcatcttttcattgcatggatcacacctccttgcatgggtttgcccacatagagattatttacagtgcaggaggcagcttgattttgaaaatagacagccatggtattatcaaagagagcaactgtgttcaacccaatatcagatctagtggatttcaaattagcaaggcatgctatttaatgtattcttcaattcttggttgttagatttggagcaaaagtacatggcccttaatgtctgactaatattaatgtgtcaaaattagtagaatgaagccaaatgcatacatctcagggtgcaatgttgcctgaataactagtttatatgtaaaagtctacctaatggaaagggatgtttctaaatcctcccaatttataaccacgaaagaacaaatttacaagtaaatattaggattatgtgcatttgctctagcttttgtctttattaagaatgttttaatgtaggtaaagttgctaaaatcttgatgtggggtttgacattctacatgaaccttacctgataagtaatgttatctttcaagaaatttagaacaagctacttgggttaccactgtataacatctaagacaatgctattactaatgacaattaacgcttttacagatgtaaaattatattaatttttaaacctacctatatatttaagaatggaatgggtttcatttttcatttcactttgtaccctgttccttgactaattatacaccaatgattagtaatcagcttgcctgtatgtttacaggttccatatcaattttaccagcgtttctagttaagctttaaccaaagaaatatggaaactatcaaataaatatatcttgtaaattcccaaatgtcatgtttgttatttatatttaacatttcttgtgaacaaaaaactttaacttatattttatgcttgtatttttgttatacatacaatcaatgttcaattgcatttttaaaatattttggaacaacacaactaactcagttatgtaaaatatacctcttatttactaaaataaatatttaaaattataattttataattactataaaggatatatattctaaaataatctgaaaagtcaatgttcttcatctctacttgcactctccctttgatgtccaccaataatggttaggaagtgaactggggatttgccccagggagtggtcttatcacacagggaggagccataaatcatgatcactggggatcattaaggatacatcagatgcctctgaaaatgtcatcttctgctaagcactgtagaatgctgtcagtataaagttaataaataaatttcaattaaaatattgagaactaattggaaaaaaattagttgcctaaatgttaaaagtttccttacaataattttctacacatatgtaaagtccaagtctcggtcctcctgtggatttacaatatgaactcataaaaataccttacatctttgttttcccatctataaaacagtataataattcctaccatacctttttcatggggttttattataaagagaaaattagatgatgtgtatgagttttataaactgtaataattatcatagtaattttccctgtgaaaaaggatattcatgtttaaggaaagctagatttaacacaatagagtcataaagtctagttatataaacattcattacacattttatttaattttgaaagtcaagctggttttaaaaatatattggcattctttaaaagctaaatatctcattaatcatattagatgtagaaatgatttgttgtatttttcatcattcttaggattgtggtctttagagttttgcatccaatcatttttgtatttataatgcagtttctgaaatcacttcaaatattgcttaatgctaatacttactgatttaaaagggcttagaaacttttcatactgattcgtatttttggtttttgtgttttactgcttcattgggtttaagttcctataacaggtaagtgtattgcaaagaactctagaaaacctttcaatcaaggatatatttcaagttattattcttaaatgtataataaggataatgattagtacgtgtaccctcactactagtcacattattaggtggtttaatgaggtggaaatgtattgagattaataatgcatatgtgattattttaaagaccttactgctcattgtactactgtattaaagcttaatgcaaaacaaaaggcactgtctattttatattgggacacaatcatctgtaagatttggaatatgggtgaattctgtgtttctcactgagcctttttcaattgtaaatattctgctactccagcaggtaaaagtgagctctggggctgctccactgagccctggctaccttcttccagcttgagtgattgcattttgcctctctgacgttatctgttctctttacttctcatccttaactgtatattctgtggcagtgcccaaatcaattgcttctgaatttaatttttctggggagatgtatttattctttatgtcggtctgttgattgtaatattttaatagaagtagatccattgactttggtcgcatagtgagaacaggaaactctcatgaatcatgtttgttagccaatgtttttgtgtagaggggtgggcaaaatctgagtaaaagacatgaattcacttgagtggttaggtcacaacagaatctatcagggattttttgattcagtgtatttttaggaatgaatgctacaaaaagagcattcagcttaataagagggagtaaagataaatgcaatcaagctaaattacagaggcacacaaatctgattgtagggttcttttttttttcccttctccaggaagaaaaaatgtttatcatggggacaacaattcattttttgctatatcctatttgtagagttggtgatagaacaggcaaatgtactagcacttgaaatatgtttatctgttaattaaatatcattctctacagtatgcattatcattaaaaaaaaagttcccctaagagtgtattttctcttctgttaatgagtatgacggtataatgcttttcaaagtaacaccccttaaaacatttgtttttttttttaagtggtaagtttaaatgtgataaatatgagcatgcttctcgttgtaatgtttagtacttcggtcattaaagtactgtttattcttcataggcaaaaatgttcttgttcttttcttccttcttatgacagaaaaagaatttaaagtttcttttctttttaagctaataacacaattgggaagggacttacgcttaattgtgagtggtcagggattcagttgactttttaattcattcattggaatatttattgagttactgttatgcatcaggcactaggaatagaaagaaaaatattctgtctctgtactgggtgttcagaatttagtgaggaaaatagccaagtagataaatcattaaaatatagagcaagtgaaatgacatgtaaaaatgaataagaggtcatgggaacataaagaaggagctttgtaactcaacctggaggggccagaaaagacttccaggggaggaacccacattttgctccagaagcgcgccctgatttctctcgcagcgtggccaagagactcaaaatacatttgcaataaaaacaataacagtaataagtcaaggcggcagaggttgaatataaatgcacgtgtagtctggctagcagacagagtggcatcagggggtgatcatgtggaatgcccatgtttcccagtgcagagtgtgttgtggtaaaaagccccagagaatagggccacgagaacaagaagagcagccctttggggatgggtcacctagatcgggtatctctgagggaggttgggatatggttgggaaggagtttggtcgacttaatagaccatgaaaacacctccacttgacagctgggtcctctggtcccactctatactgctatgactacagatgcaagaaaaacaactcagcaaaatttcccgcttaagcttttaaaaggtctatcagatgtctccctgcatctcacagtgtctgttgtcttgctgatatacacataatatactctcacctgaaaccttgagttttgtctttggggatactgtctaggcctatactgtatgatatttctttcccagaattcctcttgttatcagaaagatcttaaggtcttaaaatcttcattgcatagatacatatattaaacaagataactttgtctcttttttaatcttctgaaatctgaaaaatgccagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgaggtgaataagttttgatactgtattgaatttgatttttaactatgatactcagtggaatttagcatttttttccctctctttaacacaacaaggaggggattgttctataggctctctaatctagtgtttatgagtgtacaaccaagtgtgtgtacctgggaatgggaagggaatggggaaaaaagcacttcccagagatatatgagtctaaatttattacaagaatctttaatgttggattccgtaatttattttactatggtattaaaaaaaaacactttgcgtatctccccatgcaaaaatcaagtagcaatacactttgggtcccattgttccattgcagattctatcatttgaatgaatcaagtagcaggtacttctctgcccctttttttgttgaccttatggttgagaaatcagatgaagctttgtgctctaaatatactacttgccactctcagtttaattttatggattattggttgagggtggctgagaaaaaaaatagagcactgcaaatctagtaaacaacactgagaagccaaaagaaggcagtgggaaattcttcttccaaccttatttccccttcctactcaaaccaaaataccaggacttatctcacaaaggcaatgatttaaaaccaaacattccaacaaacataatatagcaaaaggaaaatagttcctttgccacccttcacttactgagaaataccaatctggggcatggaaggaagccagtccactacccatgaacacatcacagtatgcacacatttaaagtgaaagaatccaagtaatattttgctttgaaaaggccatccaaaatacatccaatttcatgaagaatcttttaaactccatattttatctatggattacctgtataccttaaattaggagtgttaattatctctgaattttgaaagttgattttagatatatgccagaaacactgccgtggtaacaaaataagtacaaggaattagactattctgccagagctggttctttttgttcatttcatgtgtactcctgtgtaccttgcttcaaagaccactgggctctttgaagaccccgtttcctgtgttgagcaaagtttaagttcttttgcaaaatgaaatttacacccgttttaaattgctgcatatagtaattaaactagtcaacaaattcttctgttcccagattcttgaagaaggggactctattttaatttttatatggtcccttgttgtgaagactcactctttttcatgatcttcaaagaaactcagatgcgatgtattgcacacaatttaatgaataattatggagggaagcaggttttctttctactgttataaatgctaaatgatgcacacttgaaagatactcattaaaagcttttttgcagttttgatgcattatcattcaatacgttttgaaaagaatgatactttgctacttctacttctcattatagtgatcttaattttaaaatactttcaaggtccattttttttctctaaagttatttttttgtctttaatttgacctgaatccaatttaagatgaacaagtatgaatccaacaaagcggctttgaggtctgagaatgaaacttgtttactactgtaggactgctttcctctctgagaaagtggtttttactatttggggcttcagaacagataaacctgatttttaaaaaggaattaaattcagtctgcttattcgttttgttttcccagagcttttttgaaggacagtcagcatcttgggatgtagctaaaaaagatcaaaatagagcaaaaaaccgatatggaaacattatagcatgtaagttcccattcaattcttggtgaatgtaaatattatatgcttatatggttttaaactttaagaaaaatcccagagagtggtgtgtctgtttatgaagtaatctatttaatattaaaacagcatttacaatcaggcttgagggctcatgcctgtaatcccagcactttgggaggccaaggcaggtggatcacctgaggtcaggaggttgagaccagcctggccaacatggcaaaactctatttctactaaaaatacaaaaatcagctggcttggtggcacgcacctgtaatcctggttaatcaggatgctaaggaaagagaattgcttgaacccaggaggttgaggttgcagcgagcagagactgcattactgcactccagcctgggcgacaaagcgagactctgtctcaaaaaacaacaacaacaaacaaaaacaacattggctattagcagtgattctgaaattgtcatcatcctcattaattaaattgactcagccacttcaccctgtggagataacttgctgtttgatttcatgtttgtacataaatgcatggggtattactgaacagctgagactatcaggataatgaaaaagtaagatcttttcagttataaattgttttaacacttccatcaaacatattcaagattggggtgttattctttccacgtgcctttaattcttacttggagccactgtctaaactccagttgttcgatattatttatcgttagggacttcctcctgagtaagtcctcaagatatacacgggataataaagtcattatcagacaaaaccacaggatcagtaaagaaagtagcagatagtttaacttgtaactagctgctgatttacctagaccactctgctctgaatttaaattattttaaagtatcttatgaatagctcaaaatctaaccttgattctcagggagtaagaaactgagagcgggaattcaaaattcactttttaattctgtggctcatttgctgtaaagtgcagaagaaaaggatccaacccgtttaaagtcatgactaaaaagcaaaattagaagttaagtctagttcagttatgtagacaattctatgactcaaatgattacttaccagacaatttcatgtctcctaaacactaactatgaaggttcaagtcagtgaagcttaagtcacacaatattataagtgtaatagcaaggttcactaacattcttatatttcttcaaaggactgatttggtagtagtatactatggatagactatgggcaaccactgaattctttagtctctaccaatgacattgtctcagaacagggggaaaatttaacagcttatatttattattttaaaattttagatgatcactccagagtgattttgcaacccgtagaggatgatccttcctcagattatattaatgccaactatattgatgtaagtatttttatagttaagtatgtctactttattggcttatatatatgaacctttttgcttattacctataaagtgattgctagctttttaaaatataaaagtacaaactgtacacttttccttgttctgcgtcctagtacttactgacattgttgtgctttctttcacacctgactttggtttgggctgtagatttggctgtacagggatgtaagtaccactatatgtaaataacagcaccctattataaatacaaacattcttaattacagttattactaacgctctgttactactagttatttctgcatgcttcacctaattagcttcatacaatatatctctgttcgtttttttgtaattctttcacatgcgtaaagatctattttaccaccttcccttttcttgtgtagaaaaacaggaccatttttagctttgacagtttattatgtactcgagttttatttgttgatgatttctgtttctggcttttattcttacccttccctaaacatatgtgagaagctggatagtatgatgtgtattagtgttactgaaattttactttttacatttgacttctgacgttaaaatgagtagggagactattttgtgatgtgttgtattggcttttaaagtaataaaattactcaggcaaaataattactaaatttcaattgtaaaatacacatatcacacatatatatcgaatcacagaaatgaaaaaggttgctttgatcatatatttcactgttaaattttgattacatacatatctacatggaaattctttatttaaaggaagtaattatcaaacaaaatatagaatattcttaaagggcaatatattacattacctataaggaagacctggttcataatcaccctggagatcttgggaatgttacttctctctctgtacctcagtttccttatctttgcagtggggataataataacagtactaacctcatcactttgttgtgagaattcaatgaagtaatgcatgttgagcattttgcccaatgcctagcatatatttagcactctttaaacttcaactattttttttacaattaaaatctaggtgtgctataattaaattgattcacaatatgtataattataagacaaaaggtggaggtattaagaatggtagcatatgtatacttctatagacctaaaaggtatgaaacctaggacccaacattttataatttccataaataggaaataattttcattacatttattaggttcacattttagagttatgaattgtcattatgtatttagttgaactaatatattttataaagcatagtatatgagtatatgagttcaatttctgatcataatcttactcttattcattatataaatttatcaaacatcattatgtaaaactaagctaatggtctaatttttagaataaaaaaatcaacagttctatgacaaatttgtaattgttcttacctatttagtttaacctgggttttctgccaggacttgtacactggagccttgttataaaattatttcatggttcatatggtaggactgtattttaaataagacttgttatctagtctttctgttaagaccccagtgtattttggtctatttctatacaatttcataattttccctctcccattagttcattatatgtaaacgatatgagtatatacttctgcaattggtattttttttaagaagtggaaatgaaatacttataaagcttggaaaaatttttccataaaacattgtgctattttccataaaacattgtggtatattaaaaatttgaaatcttccaaatttgcaataacgtaatactcatgctattaaattttaggttggagatctcagttcacatgtatttatatgtgtattgagttgcccacaccagtatgtggacaaattgtaccacagacttttactaaggctcattggtaaatatgcaacaaattcagaacttaggatcatatcatcaacatttttacaacttatgctttgttgttattcaaaccaattgaaagcaactaaaaatctattcctcctcaacagaacttttagcacactgaaaaaaaaaatactaaatttttgctcaagataagatgcatttttaaaaattcttctttccctatatatatgtgtgtatctataattatgtgtgtgtaaattaacattgtgagcacgcacaaaatagtttttgcatatccctgaatgtgttgtagaacaggaatattctctaaaaatctcagcaggactttgattggatgcacacatgcattgtccagctctaacattggaatgttctgttatttttttatggttctaatatgtcctcgtccatttgtaatgcagtgtgttgtacttttggatgataaaatgagaattaatatttttaaacactattttaccaggaatgaatgactaaacatttacatgaaggcataaacattttagtgaaaccaaacaaaatctatgaggttattccatggcaaacaaaaatcaattatacaatatatattctaatcagagcctttaaaatatttaatttttgttttatgtttacctttcagataacataggtttgagaagtgaactatgtgttcactactcatttctggactttttattataacttaatcttaacaggtggttgtcttcatctttttatgccttcattcatttatttctgatattgatgtaaaatgataactaatttgttctcttattttagggctaccagagaccaagtcattacattgcaacccaaggtaaaactttgccttgttaaatgttatagaaaaaacaaacttgcttattcatctatgtggtggtttttattattttttaaattttatcttagtaacaaaaaaatcagcccttctgattaacactgctccttactcatttgtatagtacaaatttattgtgtgtgtaaagcttatataaatttaagcttgatttacttttaattaaaagtgaaagaaaagctggtagtggttattatgatttgatccttgttacacagataggtcagagcactagtcaatagtgccagtcagaggaattactcatttttgaggaaaggaaaaagaagtctcatataagaggcctgtcttcttgcagcaagtttgttagtagtacccaagaccaatattgttataatgagctgttatactgagcaattttttgacgagtcaagactgagacaaaacaaagagatggaatttagtcaagttaattcttcatggaatataataagacagtagagagatcttgttatagtggtacactggggagtaaaagtatccaaataacaacaacaaaaaaagcatctgtagttatctctctaaattgactactggccctcagaagagaaacctgtacatcttttttatataaaaggaaagtaaaacaaaagctaggtttactcttttaacaggggtcatttttctgtgttttcacatatctttggagtaattgagttcagttgtgtactctttaaagttagaaagatcgaccatagtggtgaacaatattcagttttatggtattcggtagagaacagcccagcacatgcttttgcagtttggagatattatgataagattaggatatgtccttacgtgtaaggatatgtttttattgatccctaaacatgcactatttataaatagtgggcacttatttaattggtaatatatgctgtctggttgatggtggtataagagttctattttttacacatatttgaagatgcattaaagtgacttagtgacaaatataaatacccaagaaactagtgatagtttcttctaaattgggaagtgtagagggcaaattgaaaaaaaaaaaaaaaaaacttgtatatgcctgtgtttttgcctattgtgggaatttagatatgaactgaatttaagtattttcagtgacattttgtgttagaccttttttggaattacttagtttactctgcttcttatcttagctaaacttcttactaactacaaaattcctttgataacataatattcaaattaatttctttgtaggtcccgttcatgaaacagtgtatgatttctggaggatgatttggcaagaacaatctgcttgcattgtgatggttacaaatttagttgaggttggccgggtaagaggaagaaaaagaatttttttgtcataaaaatgaacatagttgagaagcaacatgtaagacactcaaaatagaatatcatccaattgtttaaaaaaaattataggcacaacattttagttgagtacttctaagtagaccttgactggctgaaaaattatttgatttctcattgagtaataaaataagctttaattttgtactggaatctaactgcattatcaggcttgtatattttttgtgagactatataaactctgtttattgtataatagatttttttctcatttatagatttttaaactgagttttaattgtgacaaggagttattgctggaattaaatcaccttggctaattagtattatatattcaggtctgtctatatattctttttgtcacttaggttaaatgctataaatattggcctgatgatactgaagtttatggtgacttcaaagtaacgtgtgtagaaatggaaccacttgctgaatatgtagttaggacattcaccctggaaagggtaagtactctaaaattctattttaaaaagtgatatcaaaactgctttttctcttaaaatctttgccaagttctgttttgatgatgctataaaatccattcattcatgtattcattccacaaatgtttatttgagagtttactatgtgccagacatgtttctaaaccttgggacacatgttaaaatcgcctcgtgtggatcttagagccgattgaattaagacagcaataaaaataaataaatcaactaatatatcatacatcatgacaagtgatatagagaaaaataatgttggggaaggaagtagggaatattatttaggcagggtaagaaatggtttacaattctgaaaggatgatcaaagaaaaactcattgttgagaaagtaatatgagtagagacctgaaataagtgagggagtgacgggttatgtccagggcaataatgtttctgacagaggggagagtcatttcagaagcctagaggcatgtgtaaagctgttagaatgccagacagtcaccaggccaagatgtgcagatatccataagtgaaggggaaagaaatacaaaatgaaggcagagaaatcacaaaattggataagtggtgccttgtaggccatgatgattttagttcatactaaaattgagttaggctgccattgtagggtttgtgagctcagggataacatggtctgaattttatttctaaaaggatcactccaagtgttacattgcaaagaataacgtaaggtggctggtgtagtagactaaagtgaaatatagtaacagtgaaatacattttgtggtaaagcttggtagatttgaccacacaaaattgtgaaattacctgtggcacaaaaaaatatcaaaggtacatacagacagaagaaccttgcgattgtttattaatgtccttaatttataatgttaataccagtagaagaaaaaaaaaaaaactagaatctctgaagaaacacaattgttaacaagcctattaaaaatgtttaacctagtgtacttatataccattttgtccttccaaatcagcaagaactttaaaaaagaataatcctcattgattgttagagtatgttgaaacatatttttatacattactgatcatagttaaatcgctacaaaccttctttaaatcaataaaacagtatatctccagagctttaaaatgtttatgtcctttgagaagttaactttcatgaatctctcctaaggaatttatttaaaatacaatgacttcatttatagtattaaaaacttatagataaccataaatgcccaacaatagagaaataattgcatagtattttataaaaatacttgtgagttatcctaccaacatgaaaaaattaggcaaaatattaagttgaaatagcattatacagaacaacataatcatgattattgtaactgtaaaatatgtatgaaaatttcttagacaaatcaagtagaataaaataagcaattgatatgggagatttcagaaagaaccattaagcttgatttaatgaataactagctcatattattaaaaaagaaatgtggaatatgcagtctcttaagttcatacaagtcttgtaaaaatcaatgatgaacttagtaataaggaaaacctgaatacataacaaaaagttgagatattgccaaaatccaatagaaagcaatgatgacaaactgctgaccagtgaccccagaaattagcctattagaagtcaccaaatcctcttctgaataatccttgaatgatttcctcaaaactaaaattatattatatagatcaatagttttacatcaaaatttacctcattattctgtaagaaaaatttatactcataagtgatttctgttttgaaatgtgctctgaaatcatgtgaaaaattataacattggaaaatcagaaaaagtagaatagaacaaaggaaaaattaaatataaaaaagaaacaaatgagaaaaaagaaaaagcttgtttattgaaaagatcaataaagtaattaaaccactattaattctaaatgaggtacaatgaaaatatacaatattagaaaacacagagggacatagccattatacttgctattagaaaagctatggaaaatattatgtataaacttaaaaatataacttttagtctaggacacggattttctgacaaatgctgattctcaaaaattaggtcacaaagatttagaagcatgaatagatggtagaagaaaataggatgattgttattatcattaaaattgcactatggttttaaagttaaagttcctttatactttaaggaatagctaatatctatgttttaaaagttagcataatgtacttggaaggctgaggcaagagaatcatccgagttgggaaagcagaggttgcagtgagccaagatggcgccactgcactccagcctgggcgacagagggagacactgtctcaaaaaaaaaaaaaaaaaaaaaggttagcataatgatgataacagaatcagataaagatagcattctctggagctctcattccctctttcatgatgtctttcttctctctcttcctctcttccccctcttcctctcttccccatgcacacacatattgcagaccaatttcattcaagaacatgaaaaaattcaaaataagatattgaaaatttggatctagtagtgaattaagaaaatatcactacatgacctattattttttccctaagaatgcaagaatatttcaactgtagtgggaaatcttaacaggatatttcattatgtcagtacattaaagtaccaaaactgtatgactttaatagattaatgcatttaattttattttcaaaatatttatagtaatactctaattagggaaattaagaggcatcctaaacatgataaaggtgattcaacaatacctagtagcagccatgttaaggaatgaagaactaacgactattcatttatcataaaaaactagtataaagattatattactgcttctacaatcatgaatgttatgtggataatcagtgtcactaatattaaacatttttggaagttttagcaaatgaaataaggcagcaagaggaataaactgtgtaactactagaaaagacaaattattttaagatgaaaggatttataccaagaaaagtatggataatatttttaaatgggatgtataaacatttatttaaatgaccaaatctgcataaatattcatgagttatagcttgtctttatattagtgataaacagaagtaagaaaatattactaaataatctttaaaaatacaaagtgccaaaatatctcagaatatatttaataagaacgatatagttcctgatttaataaaaacacaaaagtgtacttacggatacgcataatatgtgaatgagtggagacatgcaccatgttccagaatatgggagtacttgatattaatatcactgtatggatttaatacaatcctatttggaaaatcattggatttttttttcttgttatttagaacaagaaaatggggggggttgtttttttaaccacatatttgaaaatcattcagaaaaattaaaaaaaaaatcagggaataggtgctgacatatgaaaatgtactaaaaagagcaaaccctatacatgtaatagaaagataaagggagcaaggcctattaagcaactccaataaaagaattaatatagaaggagtaaagtattacctaaaatcaggccatgaaacaatttttgaccttcctcactagagttgaaaagtagcaaaaggtgattttccattggggtgattccatggtgatgcttatcattgtgattgttacagttatttattgatgatccctgctttgtgtagggtattgtgctaggaattggaattaagaaaacctttaagaaatgatcactaacttccaaggttttggtggtattggtttgtataagattgaatctaaagataaactgtttttctcagttttgtttatttcatgtaatgtgtctaccttttctgattgaacaagtgagattgatagttcacagatagttcacagtagaatttgaattatatagattatagtgggattttttttccttttgctacaaatgtgagttcttaaaaataaattcggcaatatttcatctataccttccaagctgtgctacctcagtctacagacttcttctaaaaaaaggaaggaaaaagctttgaaatgtgcatttacagggttctcttaaattaacccaataggagagcagcacaacagcagatgcttcacttctttcattttgtatttttgttactataaataatactgcgctgaattatttcacagagctaagaaaaatagtttgcccaaagaacagtttagctgcctgtatattttcacaagccaatctagagcagcactgtcctggaaaatccctacatgctatgcttcaaaaccattttcaacatggataagcaaggcattaaaatctctttgtgaggtgagaagctggaaagttgcttttatacaccacttgagaactcaatgcattgggtcaatggggcagcattttagctttcccatttccttcttttcccctaataatttaatgtgttgtcactcccagcaagaaacaagctgtcaaagtaaataaaatttacccagacttttagaactgagcaagacttataattttctttctttggcagttgtctgacaataaaggtaagctcctagtccatgttaggccttcattttattatattttttttttaagaaaaggcatagtctttcgtaaaggttttattgttatcattgtcagttgggtctgtacccataattgtgtttaatggctttattttggccattaaaatggcttttgaaaacatttctttccatctttgcacagagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcaggtaagtggtggtccaaatggtattgactgtatgcaatcagctttttttagagtatcaagacaaggcttttgagcacaaaaactaatgtgtgcttacgaagttccagcttgcttgtattatagataaagtaaaacagcaataaaataaaagttggctgtaagtagtctataaaacaggaacttaagaaatacatacattcatcctaatgcgtgtagtgttatccacaatttaaagtatagaaactctgccttttaatggcaacatctgtgttttttgtttttatcacttttgcaaatcccatattgtatagaatgctaggttgaaatagacatttcttgccaatctagaaaattcccaatagaattccagctttaaaactaaatttcagacatacagagttactaaatggcctaaattgcaaggatttgtgctgcaaaacagctatttaaaaattttttttaaagaattcacattagaggaccttgaaaactgcatcagtgagattcagcaaatatatgccaaaaaacacgagcattatatccagactttcttctgattagaaacttctcttaaaacaagcatttagagatactaaaagcaaattacatggcctcattttgaggtgtgaccagaaaaataagtactgaatctgaaaagcgtttcctaaatgatgctgcacaccattctcatacgctcttccctccaagctacataataggttgtacctaagcattttttgctttctgaaaatccaacctattcaggatttaaataaccatgtataaaagaggggaaaaaaagcagagaatgaagtaaaggtaaaacgtcccataggatcagatactatgtaccctgaaaacaaaaaaaacttcctttcaatcctcctcatgaaatctgatgtactcttaaattacattcctgtctccaactctgggaacagtgattgagaagatggtaggggacaaagataaatagagatagccacaatatcttttgcttaaatttctaaaagaacagtgagtttaagagaagtgaccaaatctgaataacaaggaaataatgttactagcctatctaagcacttagaaaatgagataaataggttttcaacttaagaatttcttgatttatcagagaggtttactttcttatgaattgcttgcttcagaaatgctccaagattctcagatactctcttgaaacagaagtgtcattttccacctacactgaagcatctctggactacaaagtgaattccccactccccgcaaaaaatccttattttgttttccccattgacttctatatataaaattggagaaacattccccagctgcaaaataatcacagtatattacaattaaaggacacaaaatatggtgagatagaggaatacattttagtgttctgtaccactgtaggatgagtctggtaaatgataatgtttagtttgagagagctagaaggaagatactgaatgttcacaacataaatgatacatgtttgagaggacgcatatgccaatcacccttttctgatcactctacattatgtgtattaaaatatcactatgtacccaagaatatatacattattatttgccaattaaagactaaaatataattttttaaaagtatttttaaaaattaactttagaattaaatacagtaagatagcggctagccttttgatttgctgggaatcatattctacacctaataattcattttcatttctcttcagatcatgattcaaatagtctttacactgttactctcctcccctttgataaccgtcattctcttgcccacccccaccatttgcatttcctgtgaagcgtggctcctcagatttcccgtttaaagttttgggaattaattttcttttgccttggtatttacaagaggtgaagacagtgagtgagccaacattctcacattgttgccagaggacacacaactagatgaatctaaaaatattcaatcttgagttaaattttgaagcgtgaatctgccacttgatcaattctatgaacttgaaattatgtgtattaaatttacataaaatgaaaattgtgagagaggtgtggaacttaaacagtgttattttcaatttgaaaataatttagaactcttgttccaatctttagtttataccaaagcagatactctgcatgaagctatttgtacattaataagcttttacacagcagggacaagtgctgtgccttgcagtttgttaaatcaatttgattctacctatctgacagtggaaaaagtccttatttaaggttatgaagactaacatgcttcttacaattcattaaatttaattgtttttcagtgctggtgctggacgaactggctgctacattgtgattgacatcatgctagacatggctgaaagagagggtgttgttgatatttacaattgtgtcaaagccttaagatctcggcgtattaatatggtccagacagaggtatgtagatttacctgtagtggacttttttttattttttattttttttgcaaacaaagagtagatgtctctcatatatactctactcaaccgaaagagatgtttttcatgtgtaatcaatattagctgagtcatatagaaaaatattggtgttttaattcatatttccatatagagaaaattttctgtatttcctaactttgatgacagaaaagtgatactaaaactagtacaaaattttctttttcattcttttggtaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcaggtattaactatttctaaaacctcttttgtgacttactacaatttgttctgggcgctaggaatcctttcaaggaaggtctttcaagtcaaatttataacctttgatcctgttttaaatacaatacgtatctctttcattatacatattatatagtcacttttctattgatgaatttatatctactatatccaaaatgacaaataagttcagacttagggaagagcaaaggggaaaggtatcataaaagtcaaaaattaggccaggcgcagtggctcatgcctgcaatcccagcactttgggaggccgaggcgggtggatcacgaggtcaggagatcgagaccatcctggctaacacggtgaaaccccgtctctactaaaaagacaaaaaaaattagccaggcatggtggcgggtgcctgtagtcccagctactcgggaggctgaggcaggagaatggcgtgaacctggcaggcggagcttgcagtgagccgagattgcaccactgcactccagcatgggcaacagagcgagactccgtctcagaaaaaaaaaagaaataataacaagtcaaaatgagtggtgatttgtgtgtatttagtgtgtatttatagcctttttttcatgcagtcatacagattttgacctgggtcactcacaatgtgatgagatcaagcacattaattataactgagtctgggttcagtggcagctcacacctataatcctagcactttgggatgccaaggcaggcagatcttgaggtcagcagttcaagaccagcctggccaacatggcaaaacctcatctctacaaaaaatataaaaaatagccgggtgtggtggtgcatgcctgtagtcccagctactcaggaggttgagatgggaggattgcttgaccctggaagtttgcttaaccctggaaggctgtggtgagccaagatattgccactgcactccaacctgggcaacagagtaagaccctgtctcaaaaataataatagtaataataataataaatgaagtttgtagtacatgttatttcaaaatagccctaaatgttttcactgcccttaaaacacccctgaaggtgggtgaaaataaaatcaagggcagagaccaaattctttgattgttgatccagtgctctttccaacatgccatagcttatcttcaaatatggcaagcccagatgttactacaaatgataccgtttcccagtgtgatgaagggtcattatcataatggactgcccgattgcattttctttggttaaggcaatgcattttgcaggtagcagtgttgtttagcgtaccttttccttttaagaagaggagccctgaacaatgtgtgtcttgtttctttgtcacttctcaggcttcattagctttaactacaaggtctatcagcctgtcatagtagcaaatgccattgcctcgcacaaatccttcactttctacttggccttctaaattcctgatggatctgtgttatactgttaaatgggtcacactgtcttttaacctgggttctcttttctttttagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacgtaagagactgccctctttgttagtgtagagtgttgtggaaagctacataatgcaactgaacactggctagttttcttttcgaggaaattaaaataacctaaaaaggaaaagtggaaacttttattgaaacacatttttttggaaaatgattttaggttttccctatagagattcttaagaactgtcatttttatagctttattgtagatttggagcttgattgtcaattattatattcatgtagtaaatattgcaagttataaatttcatcttaattattttcagaaaagaaaatcatgccttatctattttgaatataattagaaatgaattttttaaatcacagaatgccaaatcctacaaaaatcatgttaatttgggaaatttttatttctgacatttaatgtttcaataatttacaattaatttgttggccattaatcaataaggactattataagtaactagagaggggatggatggtattatgttaacacatccatcataatgaaagaacaatcttgccccattctaaaatcttaaattgcagggtgttatatagcccatagacagaacaatatggaaagaaagttttctgttttagtttttggtttttttttttttagacagagtctcactctgtcgcccaggctggagtgcagtggcatgatctcagctcactgcaacctccgcctcccaggttcaagcaattctcctgcctcagactcttgagtaacttggaatacaggagcgtgctctaccacaccccgcttattttgtttgtttgttgttgtttttgtttttgagacagagtttcgctcttgttgcccaggctggagtgcaatggcacaatctcggctcactgcaacctctgcttcccaggttcaagcgattctcctgcctttgcctcccaagtagctgggactacaggcatgcaccaccatgcacggctaattttttgtatttagtagagatggggtttcaccatgttggtcagattggtattgaactcctgacctcaggtgatccacctgcctcggccccccaaagtactgggattacaggcgtaagccaccgtgccgggccttttttgtatttttagtagagatgagatttcaccacattggccaggctggtctcaaactcctgacctcatgatccgcccaccttggcctcccaaggaaagaaagttttaaattatgactttggccactttactttgattatgttggaaagaagcaagaaagctatcatggtttataatctttttaaacagtttactgccttcatttctagcttttgccctttctcctatgaaaccatatcaaggagaaattagaagccacggttcatttctttctgactataacaggctttctaagttattgttcctgttaagcccacattctgtttctacgagtagtcttcaccagttactttactctttttggtgctgcaaagcggaatagtctaaaggcaggctctcgtccttgctgtggtcactcttgcctgtgaaaagctctcatccttgctgtgatcggagtcttgcctggccattaatcacatccactgaaatcacattaaatcctaattataccttttctttttatattaggtgtctggaaaggcaaatatactaaatagagagatggcatacaatactttttcatttctgcatctaaatatggaataaaaaaaggatgtgtgaacaagaaaaggagaaaataataatatttagaaaagcattgatgcctttgaattttttgccattggcatctttgtcaaatttttctcaatgtccagattgtctccttttcttttcttttttctttttctttttgagacaagctctcactctgtagcacaggctggagtgtcgtgcatgatcacagatgactgcagcctcaatctcctgggctcaagtggtcctcccacctcagcctaccaagtagctagaactaaggtgtatgccatcatgcccagctaattttttttttattattttttgtaaagatggggtcttgctttcttgtccaagcttgtctttttttctgtatgaaagttgaagcttgtaatccacctgctcttactgtctgcttaatcccctgtgattcaaaaaaaagacatttcatagttaaagctgttctggggatttagtagtgcaaatgaaccgttggagaagtaaagctggtttgatttacaagaacagggtttattgttcacttctttctccctaccctttatccccatcattagtacccttttgccaggtctatgagggattaggagctagggccaagaattctgtaatttcaaagccttacatatgttcctgcatttagagggaaaaagaataggaagtcttcagtcttctcctctcttatcagctcctcctcatgcatatcccctcccctgtggctcaaaaaatgagtagatagccgtcagtctgctttgacttacctttgcatggagcagacatttgattggaagaagagcttcctttcttctaacttttctcattgtattagttcattctcacactgctaataaaaacatacctgagactgggtaatttataaaggaaagagttttaattgactcacagttccacagggctggggaggcctcaggatccctgcaattatggccgaaggggaagcaaacccgtccttcttctcatggtggcaggaaggggaaggagtgccaagcaaagggggaagccccttataaaaccaccagatgtcatgagaactcactcactatctggagaacagcatgggggaaactgcctgcatgattcaattatctccacctggtcctgcccttgacatgtggggattattacaattctaggtgagatttgggtggggacacagagccaaacaatatgactcatgaaccttcctgcctttcttaggagacactcatcccagctgcacgtgtaacttggtaaggttttgaggtcatttagaagtagccaggtaaattattattgtcatctactcagatttatcctgcagtcttcagccaacgctgaatgccatggttggtagcatttcccaaatggtggtagcatcagtgaagtccaagaaccagttcctgtgctgatgttaagattcttgaaggacttaaatagtagtatgatacaaatgagttacaagatcattgaaaatttttgtcagcattagggaactctataatctactaattattattattattattgcaaataattagtttaaatcaaatggcaattgtccagtccagataaatattgtttttactacttctccctttggaaagagataatatattgtgttctaatcaaggaggacttggttaacaaggagctatctccccgcttatgtggggacaggaaatatattgctgttatgctttggtgcttcaggatcttaaatggttgagactgtcattatgacctttgatatatgttagaaatgcccaggaagctgtggaaggtggattgtctgcaagatgtgcagaatatcctggtagtgtccacataatgtaaaagcacaagtgtttgagctacttgtggtttttcttatttggagtggagaagagtaaaacaattttacttgcacgcacacacactatacacatacccagatgattgatagacataccaggggttttgtgcttactttgccttcagcctctcagagactgattacgtttggaaaattgaaatagcccaacaggaaccttacagaggatgttaacctcagaagctttttagtttcttcttttgtatttgtcctgtatttacgtctttcagtaaagtaaaaactcagttattgacttgaattgctttggaagcattgaagtcttccaccaaattgattcattactgtactaattcagttcattccagtggtctgaatctcctattccatggtttaatcatcactctggctccttctgcatatgaagctattgcatcttactggtcctacattgaagtgtattgtatctgtttgtacaaccgatcatacattttaagtttttatatttctccatctaccttgtttcttcacagagctacaggcaaccagctgctttcatcgtcacacaataccctctgccaaacactgtaaaagacttctggagattagtgtatgattatggctgtacctccattgtgatgttaaacgaagtcgacttgtcccaggttaatggctatggattgcttttatgtacttatatacaacttaatagagtagtaatgaattgctaaaatctgctttatactctcctaactagaaaaaataatactctttttttttttctttcaaaacgttcatcatttagggctgccctcagtactggccagaggaagggatgctacgatatggccccatccaagtggaatgtatgtcttgttcaatggactgtgatgtgatcaaccggatttttaggatatgcaatctaacaagagtaagtcactatcggatcctttgagctgatctagaataggtcagtcataaccaagatgtggtataattttattcagacaacagggagactacaattaataagcactatatcatccacctcaaagctagtaaccatcttatgccttagtactcgaataaaaatacaggaaaacagaaatgctggaagctaggtttttcggtcagtcactagactagcatattctctcaggaaatacagatgcactggctcagtcaagttggacagcctaggcctggcctctgagtgtatgtagacttatcttaaggatgactgcatgttttattagtattgacatccagcccagaaatggcatgtgataaaaaaaataagaacattgcaataacaataatgacagagaaactgtactgcaggaggaaagagacatgttggatcaaccattatagaagggttccatgtcactgttccaagttcattattgattatcctacctgcaatttcatcttcctaaacgtctcaacctatggctctaagcagatctaaaggtagaaccagtgctgctaccaccatgccttttcccagcagcaaagtagtaactgtatcgtctttctctgactcctcatttgctttccactacatgacaaattcaatgtgggtggggaagatcttaaaaaaaaaagtgctaataaagcccgggcacagtgcctcatgcctgtaattccagcactttgggaggccaaggcgggcagatcataaggtcaggagttcaagaccagcctggcaacgtggtgaaaccccatctctactaaaaatacaaaaattagctggacatggtggtggcatgcctgtagtcccagctagtggggaggctgaggcagcagaatcatttgaacccgggaggcagaagttgtagtgagctgagatcacgccactgcaccccaggctgtatagagcgagacttcgtcccccaaaaaaagatattaataaaaacaatttagattatgtaaccaaataacaagcagaattggaaaagaaaacattagtaactttcatgaaattaagctctttttagagagaaacattactctgttttttaaagcaccagctctgtgggtatgtattttaagtgtgtgattaggattatcatgtttcagtgtctctcatatcaaaatgactacgtgtgtgtctggttaataagtctatatgtatataactatgagcagggaatggaatcatatcgactcctattgctcatttcagtggagaaaaaaaggataacttcaatcatctcataatattcatgcatatcttagatgttaatttaaatggaatctcattatgtctgcacatctgttacattatggttctagtaatatttgagttggaaaaaaacagaactgctgaagacagtaaggcttgtctgttaattgagcagtttatgtgaaaaatattctaggaacaggaactgaaatgttatatttttgtcagcatatttatttatttgtttgcttacttattgaactgcctctgtatttggtattctggtccttattagtacatgattttttttctgttctcactctcatcatttaatatatttaatatatttaactgcatcaaacatttaacatgtaccaacaagtttgtagagtactaagtagggcttgtaatctaccaaaagatgcatgggctcttgccaatctgatatgatttactcatatattacatattcttcctgatatttttatttcaaggtttaaggttttgattcattctttcaacactactacttttggggaagtattatgcaaagttctactgatacagagtgtaggaaaaaaagatttccgtgtacttaaggaatctttatttttttcaggaagaaaagcattacatgaaaattgtataatcctttttgtataaaagtgatgcattttacagtgaaagagtaaagaatatagagtgtttaactgggtgatctgacataactgtgtgatcagagatgacctctttgcgatagtagtatttaagccaaaatttaatgaatcaatagaaattagttgggggttgatgtaacccaccatcctggtttgcccagggcaggagctttcccaagacacacagccttcagtgctaagaccagagaagtcccaggccaacctgggacaagttggtcattctatttgggattgagaagaccaagcaaggaagaagtattcaaggcaaagggtacatacagtatatgcaaagtccccaaggcaagaagagacttgatatatggattaaaagaagacaaagagaaggttgaagaagggggtggagccagatcacataagtttttttaagccatgacaacaatttggattttatgctaagatcatttgaaaatcattaaagcaggaaatgacaagattgtatctgcagttcaaaataatcatgatgcctatagtaagaatggactggaaggagatcaaagtttattcagggagatcagctaggaggtaattatcagaacctgtgactagtagtgtattgatgtcagtggtgataaagagaaggcaatgaatctgaaagttatttaggaaatgtaatcgtagtaatgaattactggatacatagtgcgagggagaaacaggtataaaggatgattgccatgtttcctgctgttgtcacttagaatgtttttttactagcatgtacatattgaggatttatatcagctagactcaatccagtgtagatgccatttgtattgtaaattatatgcaccttttactttttagtaaaaattgtagtcccagcgtatttacataaaaacacttccctctacagccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctgtgagtagggcagctcagcctgtcattcatggggccttggtgcttattttctcattttcaatgttaaagactatctggcttgcatcttatggacctcccatagatgttatttttaaacagtcttcctgtctcatgagtctataattaactactaagtttattttgtatattttctaaatattgattattatatagctatattatttaaactctttggaacactactcgtaacaacttctgatttacacagtttacaaatatatcagaatctcaaagtctagattgcagcaatctatgcctatagcattttcctgagtataagctactgatctaatttcatcctcaagttttctcctctctgccttgtacacatataaagcaaaattaagacacaaatggaaaacaattaaaactacaatgtcttattttcccaaacatatatgatggtgtgacctgtggtcacttggtgctgctatctaaaatgcctttgctttctttgctttcagaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggtgagtcacagaatcttagatttggaaggcatcttagagattagttagtcatatacctacttattgatttgacttcatacacacatagggaatcagatgtgaaaatgagacgttgtggggactttcctgcctaattaatacattgctgagcatccccctctacccacagacacttaatcacgtattgcataaactgctaatcatgaaactattttcatttaatttgggaaatttgtaggattttttttctgttatagccaaaaaatatttgctgcagtaaactttggtaaatggtcctataagaagaataaatcctatatcaaggctgtatgtctaagggatataggtttcatcagtaccttagacacccagtatttttaaaaggcaatgaaatttagttttgtcattatctataattattcattcattttctgatcaaattgtaaatggttaaactatcatggttaagttttcagcttttaccaactgtagagggcagttcatatcatgctacttgagcttgtcaaggctcgtaaagtcagaacatagcttacaaaataagagctgataggtatgtgtgtgtgtgacagttcatctaggtgaagctgtatgcagagtaagaaagaaagttacacttatctaacacattttacttctaacgagagatatctgtgggttacacatatgtatgtgcatggtgggatcaggttgggagcagctgtgtagtgtatgctcacagaaaagtaaaccagaaaaaccaaggcatcattgttgcttgccctacatttatcaagatgatcagataactagaatgagcaattcaataaacctttaaagtatttcaccacttcctgctcatggattgctcgcacaagagttgcgttgcttcctgagacaaaatctgaagacttaggtttgtactgtttcacttttacaagcggtaccagacttccaccctttctacaggtgtcctcaaactccctacaccacctcatttccctgggttgttgcagctgtctacacaagattacattggttttgattggggtgctggctatggagatgagaaaggggggatgaatcggagggatttttgagggagaactctcagatcgtcttagcaactaaatgaatagtggttatgtctctaaactttgcgatttgaagatttcttgatgtaaactctgcctccatttttcaggtcaagtcttaaaatcatcagtgggatcatttctgacttcagaattcaacttttaccttcaaatttaactgatttcccaccttttttaattaaaaaaaaaatctatggttaaactgtgccattctgggaccttccaaaaagttactattttcctttacattcatgtcccgtgaatcctgaacaccccaccctctgatttgtgtttaatcagtgttgatgattagtttagtgagctgtggagttgagctgaggagtttggtgaggagatttagagtgaaggcaatattgctggagactgcttaaagagacataactatttctaggcacattttggttccttgaatgcactcgccacagtggtaggtgaatttgaatcataactacttggtgaatagtgttggaatgataaagacctcttaaggaaagttttattaccctagtttattgctggagacacctcgaacttctattccaaaataatatgcattttagactgttctccagcctgaattttacccacttgaatgaactgagttgggaatttttaaatgaattgcatattataagtaatagtttatgatatggtctctgaatttttctaaattcttattatggagcaagtccatagatgggcttagaggaaaggcagttttaactcaaaaattttattgccaatatgttgtcttaaacatataaaggcagcagaaatacattttcaggtataagtaggctcaaaatttaaggatcactaaccattcttgaaaaatttgcttaaatactctgatggacaaaaacagtgtcaaaaattaagaacttgaaattgcataaatggctgtttaaaatggctggctttttttttctcaaggaaatcatctgaaatatatggagaaaaacatttgcagtttatcactgtagcattataaaatagagaaaaaaataaaagcaacttaatagtcaaacaatacatatatttgatttttatgtggtattaaaagatgttaaataacatggaaaaagaattgtaacaatgttaaattttaaaagttacatttaaaattatattttgaaatatacatagttatatttattctaagataattatttcaaccatgcacaaaaagaactgaggcaaactaaggtgatattttaacaatttcttctgatgatagaattatagctctttttctcattctttatgtttgttcagaatgtgtatattctttatatttgtacagaattgttctgtaatgatcaaatattactattataaacagataaaaaattatagatatttaaaaaattgatagaaaatatgcggcaaagataaaatgtctttttaagataaatttcctttttcttaaatggatcattagactcaagtataaaatatgtatgcctagatattaatctcatatatagaaaaaataaattgtaatccttgagtaatctaaattggttgtcaagtttcatttggtaactgttattcaacattagtctctttcttaagttttctcactctttgtgttttgacatctttcaggagcaataccgtttctgctatgatgtagctttggagtacctggaatcatcttagttgggtgagactctttaaagtgcatccatgaagaaacctgtccatctattgagccagcagctgttgtacctgttacacttgtgcagaaagattttaatgtggggggtgggagacttttacatttgagaggtaaaagtattttttttatgaagttgtgtatcttaataaaaaggactgaattagtttttattactatattaaagcatcaacatttcatgccacataaattatatttaataagaaccagattgaaatgagaacgtattggtgtttgtacagtgaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattat

SEQ ID NO: 36320 - DNA, 36640 bp, Homo sapiens
ttctccaggcccggctgacagagttagccgaggccgccatattgaataagcgacccggcctcctagggggtcgtcgtggtccagacagtttagcagaacagcctccgcggctccggggagaaggtgaggtcttgtatggatgggaagggtgaggtgcgtcggccagaggcttatttattgacgggactgtttcctttggcccacgcgacgtagtcttctgttgtccttgactgggcgccgcctcccgccccgccgcctcggaagcccctgagagccggcagatggggggcttttagccacggtctctggtctgatgaagcagaaaagaagatgaggatcagggggtcctcgggaacgctgtcacgaatgtaggcttgcaggtgaccttccctctgcagggaaaattcaggacatttccctctcagaggaggaggccgttttattccccgggagaggaccagtgtccgatgacttaggccttaagactaagcctttccccccagatttttacacgcctgatacagtgcatgattgtttggtcgctgttgtgttagcaatggctcacgcttctgtttgttgtccttgtttgtttggtccattgaccacgttggacagcatttttttattcctttaactaacgggaaattgagaaaaacgacttttgaaaagttagcccaggattgcattgcaaataacaaaacgttgtttacaggttattgggatccagtgcttgaactgtaaggtcttggatcagacacaactctgttcacacacgaattgacggtatagaagtgtaacgttaactgtttttgatgaataaacaagttatttttgttttgcggaatattcttgttttcaccgacttaaggctgccagagcacctgcactttttaaatccgggaaagtggtctctacaaattaacgaccagaaattagagattcagttcacttaaccgttattgaacatttactacgagccagaaatgagtccgtaaagaagaataaaatggatgatatgctgggggaatcgtaaatgttagatagcctggtcaatgaaactgagaaaaggcttttaagccaagatttgaaggataaggaggggccagggaagagcatttcagtctgaggtcacagccggtggcaagaggggagaggctgtgtgggaatagtgtggaagcttggtgacctgttaagctattgaaggccggaggcggtggctcactcctgtaatcccaccactttgggaggccgaggcgggcggatcacgaggccaggagatcgagaccatcctggctaacacggtgaaaccctgtctctactaaaaatacaaaaaattagctgggcgtggtggcgggcgcctgtagtccagctacttgggaggctgaggcaggaggctggcgtgaacccgggtggcggggcttgcagtgagccgagatcgctccgctgcactccagcctgggcgacagagcgagactctgtctcaaaaaaaaaaaaaaaaaagctattgaaatactccaggcaaggagtgatggtggattgggatagggtggtaccttggaaggcaagaagtaaatggatggatccatgttggagaacgtggaatagcatagtccctatatggaaaagtatccagtctagtttaagaaatgattagtcattaacattttccatccaaagagataattatttctattgctacttggcatatcaatgttcaaagcacatatcgaagtgttgcaaatctgtatttcttatgttgggctatgctttgttgctggatgtcaacagtctagttctagttgatttcctatccaaagtgagtactatttttatattgcattggagataaaaaagtattaaagttttaaaattgtatgaaatactgattgttgatttcaaatctgtcagtgctctaatggagtaagtttaggtttatatttatgccatcagtagtttttaataggacagatgctactctagttctagaacttggtgataagactgtttggtggttattttcataagggtcctgtgctaggtcttcaaaaaagggaaatgtccaaattccttgtcctcaaggagcttacagtctggtaggtactaaaattgattactaacctacagtttagtaagtaaaacaaaaatatctacacagtgtgtactggtactaaagaaaaagagctcaaagaaagagtgctttaaaattggttgtctgccaggcgcggtgactcacgtctgtaatcccaacacgttgggaggtcgacgcgggtggatcactgaggtcaggagtttgagaccagcctggccaacatggcgaaaccccttctctactgaaaatacaaaaattagccgggcgtgatgacaggtgcctgtaatcccagctacttgggaggcaagagaattgcttgaacttgggaggcggaggttgcagtgagtcaagatcacaccattgcactacaacctgggtgacagagtgagactctgtctcaaaacacacacacatactgattgtcagtggccagtattgcctaagttgaattcagctttaactggcatttgttgagcccctactaatagctcattgtctaggaagtattgttttcctcctgctctataagtaaagaaccagaaactcatttacccaacattactcactagcaggaaacagattggatatttgcaatttcagtatcacatattcttaattaatgaaatttatgaatgaaatttcctgttgtacatcatctatgataagtatgcagaattttgtgcttaaaacctatgtatatgtactattattcaataatactattgcaactattgaaactttaatgttgaaattttttaatacgttctaatcacataatttgccttttttcttttttttttgagacagggtcttattctgtcacccaggctggagtgcagtggcatgattgtagctcactgtaaccttgaacacctgggctcaagccatgctcccaggtcagcctcctgtgaagctgggaccacaggcgcatgccaccacacccagctaatttttttttttttttggtagagatgggatcatgctgtgttgcccaggctggcctctaactgttagacccaagccatcttcctgtgatggcctcccaaagtgttgagactacaggcgtgagccacctctcctgtccaatttgcattttttttttttttttttttgagacagagtgttgctctgtcgcccaggctggagtgcagtggcgtgatcttggctcactgcaagctccgcctcccgggttcacgccattctcctgcctcagcctccccagtagctgggactacaggcgcctgccaccacgcccggctatttttttgtatttttagtagagaaggggtttcaccatgttggccaggatggtttcgatctcttgacctcgtgatccacctgcctcagcctcccaaagtgctgggattacaggcatttttaatacctttaaaagttccaaatgattttggatgctcaacctatatgatcaagtgaatagaaggaaagttcagtgcttagcctatatgatcaagtgagtaggaaaaaaaaaaaactcaaaaagtttagaagttttggtgacttggccgggcgtggtggctcacgcctgtaatcctagcactttgggaggccaaggcaggtggatcacctgaggtccggagtttgagaccagcctggccaacatggcgaaaccccatctctactaaaaaataaaaaaattggccaggcgtattggctcacacctgtaatcccagcactttgggaggccaaggcaggtggatcacctgagatcaggacttcaggaccaccttggccaacgtggcgaaaccctgtctctactaaaaatacaaaaatttgccgggcatgttgatgggcgcctgtaatcccaactactcgggaggctgagaattgcttgaacctgggaggtggaggttgcagtgagccgagatcttgccactgcactcctgggtgacagagtgagactgggtgacagcaagacccctgcctcaaaaataaataaataggctgggcacagtggctcactcctgtaatcccagcactttgggaggctgagctgactggatcatgaggtcaggagatggagaccatcatggctaacacgatgaaaccccgtctctactaaaaatacaaaaaattagcctggcatggtggtacacacctgtcccggttactcaggaagccaaggcaggagaatcgcttgaacctgggaggcggaggttgcagtgagctgagatcgcgccacagcactccagcctgggcaacagagcgggactccgtctcaataaataaataaaataaataaataataaaaatacaaaaattagcctggcatggttgtgcatgcctgtagtctcagctactctggaggctgaggcaggagaatcgcttgaacccaggaggcagaggttacaatgagctgagatcgtgccactgcactcactccagcctgggcaacagagtaagactctatctcaaaaaaaaaaaaaaaaaaaaagggccgggcacggtggctcacgccttaaccccaacactttgggaggtcaaggtgggcggatcatgaagtcaggagttcgagaccagcctggccaacatggtgaaaccctgtctctactaaagatacaaaaaattagtcgggtgtggtggcgggtgcctgtaatcccagctcttcaggaggctgaggcaggagaattgctttaatccgggcggtggaggttgcagtgagccgagattgcaccagtgcactccagtctgggtgatagggcgagactccatctcagaaacaaacaaacaaaaacaaataaaaagaagttttggtaacttttctgttttgtgtgtctttaagtcgtggtgtttatataatcgacacccatttatttcagtaattcagcaagccttttagagcagtgtctcaacttcagcactgttgacactttggataattatctttattgtgggggactgtcctgtacattgtagaatagccagcaccttgtcctctacccactagatgtcagtaacttccccttgtttgtgacaacagtgtgttcagacattgctaaatattccctggggagcaaaattgtcctcagttgagagccattgtttaagagcttactctgtgccagcctggtggataggtactgaagatagaaaaattcaaggaattaatgcagtgagggcagaacgggcttataaacacataattggaaatctgtaagataagtgtaccagaaaatagcaatcaagacacctcaaaggcttgggctggtgagctatctcagaatatctcaggaacatttagtagacagctatgcttagaacatgaaatgatagaatgggtattggtaggaaataaaagcagaaaagacaactttattttacataaccattaatgataagctcactgttagtcttgcagtttattttactgtgtggtagtgctttaagtttgatcctttctatgtcatttttttttaaatggcaaaactgctctctgcatagaattagaaagtccaaatgtatacaatagctgctgctgcttagctctttgacattgtacaagtcagtatctctgagactgagaattctcatctacagactaagtgaaaatatcagaacctatgagtgttcaatgacataatgtatgtgaaataatttaaagccataaaacattaccaaacagttggtgattgtttttttccctacaataatataattctttgttttatttttagcaatatgttaaggatacctgtaagaaaggccttagtaggcctttctaagtctcctaaaggatgtggtgagtattttcttaaatttgcattcgtggatattagaccttatttttgtaaatttataagtctatggcatagtttatcaaagaccctaaacccatgattttttaaaataaaaatagaaaccggccgggtgtggtggctcatgcctgtaatcctagcactttgagaggctgaggcaggtggattgcttgaagccaggaattcaaaaccagcctggccatcatagtgaaaccccatcactactaaaaatataaaaatcagctgggcatggtggggcacacctgtaatcccagctacacaggaggctgaggcacaagaatagcttaaacccgggaggtggaggttgcatacagccaagattgtaccactgcactccagcctgggagatagatcgagactccatcttggaaaaaaaaaaaaaaagaagaaacaaatgatctaagttgaataattttcaaaatataattttactttaaacagtttataggaattatcatggaatagaaagtattaggaactacacacatcaatgccaaaatggaaaaatcacattctgtttttgaaaagtgatcttcccatgaacatattttcagtgacattaagagtttcagtttaaagttgggtatggtggctcactcctgtaatctcagcactttgggaggccgaggcagaaggattacttgaggtcaggagtttgagaccatcctggccaatatggcgaaaccctgtctctactaaaaatacaaaaattagcgggcgtggtggtgagttcctgtaatcccagctactcggaaggctgaggcaggagaatcgcttgaaccggggaggtggaggttgtagtgagccaagatggcgccactgcactccagcctgggtgacagggcaagactccctctcaaaaaaaaaaaaaaaaaaagaagaagaaagaagtttcagtttaaactactctgctatcaaaagtagacaaccataagtttgcatccagagcaatacagaggaataataaggaatgaaaaattttaggtttgtagttagagtcaattcatccattatcatctgctataataaactgttaatctgtttttcgcttcaatatctttgatggtcagttcgaacaactgccacagcagcaagcaacttgattgaagtatttgttgatggtcagtctgtcatggtggaaccgggaacgaccgtcctccaagtaggcatacattctaactattttgtgtgtgtgttctgatttttttaaaaatactaatttatttcctttatactgattattagtaaataattctttaaaataactatacacagcaaagttatattaaaattatttcattttaaatcttggcacttcaaagtgagctatcatatatttgtttgtggcatttttagtgaattatggtagttcttttgtttcacttttcattccaaatgaatacccattaagaaatttgaagtccgagcgcagtggctcatgcctgtaatcccagcactttgggaggccgaggcgggcggatcattcaggagttctagaccagcctggccagcactgtgaaaccccttctctactaaaaatacaaaaaattagctgcgcatcgtggcgcgcacctgtaatcccagctactcgagaggctgaggcaggagaattgcttgaacccaggaggcggaggttgcagtgagccgagattgtgccactgcactccagcctgggcaacagagcaagactctgtctcaaaaaaaaagaaaagaaatttgaagtaacttaaattagttactataggtaagtttgtgaaaaaataacctccatttgttgtgggcctgcttaatgcttttcattttcatataacctttctgtggttagtaatattcataggaatatatcctacaaagcaggtaaatggagggtagcatgtgcttacattcatgctctaaatatttcttcatattcctccagaaataataaattggtcatagagaagtcatgcttcactccatttgtaagttgtcacagatctaaatgttctttgttcattttagcagtcatttctagactatctgccagtcacagacatgaaagcacaaaatatgatataaatgtatgttcaaggtacagtgaaaagttgtggcagggataggaggtagtagaaagaggtattgggtgcctcaggtcatccctgaggaggtgttaaaggatgaacaggtgtgttcatattgtgaacaagaacgacatgcttgcatttcctatggaaaaagttaaggcagatagcttgtcatattttgaaagcttcaaatagtttaatattgatgaaacataaggtataagtagaagatgagatcacaggaaatcaagttattgaggaagggaaggtccagtcatgaaatacagtatctgctatgcagaagagcttatattttgatccatcaggagttttgttgcctatttaaacagggtgacagcgactgtagaggatgatcatttggagaatagcaagactggaataagagacaaggaaaaagcattttgtattattgggacaggatactacaaaagccctaaaatagatagtgtcaatgggaatgaaaacaagagagtagattcaagggagaatgaaatgtagacaggccttcaggaatgatgaagacccgagggattttttcccccgtcgtacagaacttcccaatattgctttaacagtgagaaaaaaaaaacacaaaagaagtttcagtagagccacagacaaatagttctttagaactcaaagagaccggaggaattcttgtggttttctgcatttgttaggttattttggagtgtatagaggggagagaaatcatttgaatttaagctgtctgtggaacatacacatgcaaatacctgtaaatctgaagcttggagaagtggaggtctaacatggctgcagattaaggtttggacataatcagcataaggaatgtcagctaggatgaaggctgggacactatctgtctttttcactactatacctgcatcctgcacaaaggaaagactcaacacatttttgctaactaaatagtttaaacactggaaattgatgagattgctttagaatgaaggctgaggatgaggaactaactctagaggaaatttgaacatgtttatagactaaaaggaggaagaaattgcagagcagggtaggtgataattggcagagcagggataatcccccttactgggcaaacagaaactgggaaaaccttcagccacagtgggaggtgagtcctgggtagcatataggagccaaagacagatagccagctagataatgtgtagtgaaatctctaatccaaaggaggggagcgaggcaaagaagaagtccaggtatgaaaccactggggacattgtggacaatggttcaaaatggatgtgggaagtcaagtcttcagcacagtggaaggatactttatccagtttcttccacataaggtgaagtcacgccaaggatcctgagatcctctgaggcagcttcagaggagacgggttagaatcaaaggcaaagaaagggactgaaataagaatgaattaagatagatagatagatagatagatagatagaagtaataagatgctgtatgtgtgtgtttcagcaataacagcagtgaagtcaggttattctaatgctttttttttttttttttttttttttacttctaggcttgtgagaaggttggcatgcagatccctcgattctgttatcatgaaaggttgtctgttgctggaaactgcaggatgtgccttgttgaaattgagaaagcccctaaggtacttgatacctaaaattctacaccatgctgtagaaggtagaaaactttaaatcttgcagcaaactttatttagaatcaatatcgtagtggagaacctagccctctttacttctatctataaatttaattcttttgtacaattgattctcttcatttcaaaactggaaacacatagatagaagtgctttacaaacacatgtcatataattgtaacatatctagaaattaaaggtgatttatagttgtcagtatttccaaatggctgtataatatataaccaggatgtagagttgccaagtagcacattaaaagtgctgacgccctgccatttttagtagagaaaagggttgcagggaagaagttcactttcagtagtttaatttcattttggtgtatgcaatttttttattcaatagtgcctgctaatcaaagcagttatttggtgttctgtttcagagcagaataaaaaattgcattgactattagaataaacctaaaaaccaggatgttttatttctgagataaatgcaaagtactagatcatcgtattatgaatatgaaaacttaacaaaattcagttttaaaaaataccctattctttgcctgttatcaaatgtataatttaatgtttttatataatttaacatttttatatattgagttgcttgtaatcacaaataaatacaaatacacatttttttttttcattgaaatcccaggttgtagctgcttgtgccatgccagtaatgaagggttggaatatcctaacaaactcagaaaaatccaaaaaagccaggtactttattgttattcaatgtagtaccctttcataaagcagaaaattgcacattttggtatttagaccttcccatagattaagaatttaatatcaaactcggaagaagttggtgtgctcagcttctaggagcaatagaagtgagtactacatagtagagaaggtgaagtcaggagtttatggtattgagctttaggatcagcattaaaaatccttctttagtaacttgctcaacttgtgaagaagggtgaatctggacttactaagctactactatactatactgggattgattgtgtttgtttttattttgaattaatgtgaatattttctgaggaccattcagcaacttttgatcattcggtattgttaaaagttacaattttctttattttttgaaacgaggtctcactatgttgtccaggctgggcttgaactcctggcctcaggtgatcatcctgcctcagcctccctcccatagttctgggattacagacgtgagccaccaaacctgaccaaaaatcataattttctatgttctctaatgatactttattctaggctcctctaagcattttccagattgtgtgtttaatactaccagaatgatactcgggaggatcacttgagcccaggagctcgagtccagcctgggcaacatagcaagaccccgtctcttaaaaaaaatattaccacaatgatagataattggcatttctgatattaaatgtaaaattactattaattgtataacaaatatacatctatgaaggttgtttaaatggcctatatgtgggcctggcacagtggctcacgcctgtaattctagcactttgggacgccagggcgggaggatcacttgaggtcaggagttcgagaccagcctgaccaacatgatgaaaccctgcctctactaaaaatacaaaaattagccaggtgtggtggtgggcatctgtaatcctagatactcgggaggctgaggcaagagaatcgcttgaacctgagaggtggaggcaggaggctgcagtgagccaagattgtgccactgcactgcagcctgagcaacagagcgagacaccatctcaaaaaaaaaaaataaagtctataggtcattttgagtgccagcagttaatgtcagtgtgtgtgtatttgagagtcattttatatgttacaattttcatacagggaaggtgtgatggagttcttattagcaaatcacccattggactgtcctatttgtgaccagggaggtgaatgtgatctgcaggtatgtagtagaattctgtcaatctttttggttgtctcagattttaattttattagcagcatgagattgactctttcataatctacttaaggaccagtccatgatgtttggaaatgataggagccgatttttagaggggaagcgtgctgtggaagacaagaacattgggccattggtaaagaccatcatgacaagatgtatacagtgtactcgctgcatcaggtaactttttttccttttttttctattatagaatataattgtatacttaatagtcacaatttgatgaataataacattggaaagaatggctactttttttgggtgggagaagagggatgctgtttctgatatatgaataaaataagttcactttcatttagtaccaacttcaggtggatttaaaaattaaaatctataagcatttgctttcactcataacttggtgagttgtacacatatgatttgtacaagtttctgcctgtgtgttacacctcaattaaatgcaaacatttcattattttttattctaggactgtgctcacctttaaaaatatactcatttctttttagtgtttggaaaatcatctctttgtgatcatgaataagaaaggaaataattttgctggacttgaccattgatgacacattttttatcttgtaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaaggtatcttttattttatgacaatttgtttttttgtccttaattcattactattcaaaaaaatattaaggttcattttcttcctgggtttcagttgttttggtctgttgactttgtttgtttatgtaaaaccctttaaatagaaggtaagtagttagaatggattgaacctgtgcaaattaactgtagttttcttggaaattaattctaaagtactcaaccacaaaattatttttttcatgtgttcttccaaagagtttaatagtgttgacattttaaatgtatagtctcccatgttgttgtttattaagttttcaactatgaggaatgtcatttagccagtttctgctaatagacatttagcttgtatatttctttatgattacaaatctgtaaaaaatattgctgtttacacatttctgtgtatatctctcattctcctgattaaaccaagaaatggagtagatagatgcaagaggtgtgattatttttaaggttcttaaaacataacaaattatcatccaattttaaactttatacttttcaacttgggatttggctttttgtttctgtgtaatttctgtgtccttactgagaatctctacttgctgattcgtggttgtcatacatccccttcaatttttaaatatgattttctttggttctttcaacatattttaatattcttggttttatttttaagtgaggcttcttaggagttcccctgtgtctgcatagtttagtagtcaggtataattgtacttcaaacaccgtgacctaataagagttatgttctttgccaatggatctgtttgtggatggaggagcatattcaaagttgaggctgttttcaagtttgcccagctattactttgcactgggccctttgggtctcagagttatccaggagtttatgaataggttgagctttctctggtttcacctgcacatgtagcagcctctgttaggaatgcttgccgcaattaccactacaaacttaggctggtaaaatcttggctatcctcagctacgatgacctccaaagtatcacctccacaaacaagtttgcctcgtgctccaagttaagtgagttgtctccatctgtaccaaagaagttctcatcttcacagcctgccccggcctcgaagaaattccattttgagggggtggagaggagcataggaggagcactgagcccagccaccagtttttcagtgcataaaagcttcccacattgtatgtgtttagatttctaaactgctgaaatggtgggttttgtcatttttggccagctttacttttgcttttcagtgggaaggttttttgagctccttaatctcccatagacagaaatcctgcccctcttgttgaatcgtcccagatttggctagttggagccccttcaaactagcttctgtgtcagataatagttttaaagccttccttactgtgccaggaatttatgtgttcaaatgtgggtgtgccgggagcagtggctcacacctataatcccagcttttaggaggccaaggtgggaggattgcttgagaccagtagttcaagaccagcctggtcagcataatgagacaccggctctacaaaaaatttttaaaatgtggtgagaggatagtttgagcccaggagttctaggctgcagtgaattatgatcatgccactgtagcctgggcaacagagtgagaccccagggcaaaaaaaaaggtggggggttcttttatttaattgcagttcctctaagcttcattttttaaagtaattcagaaagggaattaattgtaaaaaaaattttttggtaaaccaggtaacagaaactttctttattcccaaaagcaccatagtaaacaccgtatgtgtttctcagaaagacagaatccattgatgtaatggatgcggttggaagtaatattgtggttagcacaagaactggagaagtgatgaggattttgccacgtatgcatgaggacatcaatgaagagtggatctctgataaaaccaggtatatgctatattgttttccttaacttttacagtttatttaaaggaaattttataataattttgaagaattatcttttatatttgcaaattagttactgaatatagactactggaatctgagttgcttatataatgtgataatactgactttaatagtcctaggtcaatccctggatattgtatttactttgagaaagatattttttcctcccacatggagaaattcaagtagattgatacattctcaacttatttcagtttgttcattagagaaaagaagctaggctgggcgcagtgactcacacctgtaatcccagcactttggaaggccgaggtgggatgattgcttgaaaaagaagctgaatagaagagtttgcacaatataattttgataaaatatttagagatactcatgctttgtaaataaaaatgatttgacttttttagctgtcagatttttttgtgttgtaattttaagattgttcagttagctgaaagtataagaaatcaaacttttttttgtatgatttaagggaagaaatcaaactttcagatggtattttagttttaggtgaagttcataaaatctattagttcatctctaaaaatatctggaataattacttgtatctaggtgtttagatatttgacactttaaccagtactgtatttaaataacatttcttgttgatttaacttgaaaattatagttacttctttagcaagattccacaatggtgtaatttctgttttctagatttgcctatgatgggctaaaacgtcaaagacttaccgagccaatggtcagaaatgaaaaagggcttttaacctatacttcttgggaggatgcgctctctcgcgtagctggaatggtaaaatttgaaataaatagtgttaaatagtgtttgtgattatcaagaaacatctttgccatgaagggggggatgtatatttcttcccttttttacttttaccaagattatgatttaatctccttccattttacagacatctactgaggacatatgctagatattatgctattaagggatataaagaccagagacacatcattcctgcatcctacaatcttgtagtagagaaagttgcacaattcagcaattattatatgcagctatgagtaattatataaggagtaatatgagtgagagcacgtaggaggaatgcctaactaggacaggcatatcaagatgccttccttggaggttgcagtgagccgagatcgcaccactgcactccagtctgggtgacacagcgagactccatctcaaaaaaaaaaaaagctgccttcctacagaaggtgattcttaaagaagaatctgagaatgaatataagcttgccagagtacaagtggagggaatagttttcttgttagagaaagacaacataaagcactagagggaaaggcagatacttcagaggaggtcgcatttaaggtaactatagttccacttcattctccagacctcattttgaagtgcctttgttcctaaatataaaacagcttccttctaagttgatgttattagctgtggccccacataacacctctgcagcttttcacttttagattaattaataattgttgtacaactttttttgtgtttttgagatggagttttgctgttgtcgcccaggctggagtgcggtggcgcgatctcgatctcgggtcactgcagcctctgcctccttggttcaagcagttctcctgcctcatcctcccgagcagctggggatacaggcgtatgccaccatgcccagctgatttttgtattattagtagagatgggatttcaccatgttggctaggctggtcttaaagtcctgactgcaggtgatccgcccacttctgcctcccaaagtactgggattacaggcatgagccagtgtgcctgggcatgttgtaaaacttttaatcagaagtctgttaactttttttgtacttgaaaacaagtactgttttattttctgaacatttcattgtggtctttgctgcgtgtaggtttcttggtgatgcccttttcatctgtttctagttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctgggtgagaaatatgaagctaggatctaggctttcctttctttttttagttacaagttatgtataaaatgtgacaacctggattctccaacatatcccccagtttattttcatatatagaccaagatcaaaccagaagttgtaggaaatagaggaatccacttatcactaagtatctcaggcacagtggctcacgcctgtaatcccagcactctgggaggccaaggcaggcagatcgcctaagtgcaggagtttgagaccagcctggccaacatggcgaaaccccgtctctactaaaaatacaaaaaaattagccagacgtggtggtgtgcgcctgtaattccagctacttgggaggctgaggcaggagaattgcttgaacctgggaggtggaggttgcagtgagccaggatcacgccactgcattccagcgtgggagacagagtgagactctatctgagaaaaaaaataagtatctgaaatgttcatttaatttagaaatacttcataaaattttttgtttgagaaggcaatgggtttgatgataggagaatatttcatggattctctgtatgtcttaattttaaagtaaatttgcattttatatattgtatttctagcacagatttgcgttccaattatcttcttaatactacaattgctggtgtggaagaggcagatgttgttcttctggttggtacaaacccacgttttgaggcaccactgtttaatgctagaattcgaaagaggttggtaatagtatttattcaaggtttaaaaatatttatgtaatttttttgttttatatgtgaaaaatggcatcttcctaatagtgttagtggtagtgagactccaaaagataactggaagacaatttttttttttttttttggtgggacggagtctcactctgtcacccaggctggagtgcagtggcaggatctcggctctgcaagctccgcctcgagatggggtttcaccatgttagccaggatggtctcgatttcctgacctcgtgatccgcccgcctcagcctcccaaagtgctgggatttcaggtgtgagccactgcaccgagcctttttttttttttaatttttttaattttttagatttttaaaaaattatttttatttttattttttatttttttgtctttgagacagagtctcgctttgtcgcccaggctggattgcagtggtgcgatctcggctcacttcaagctccgcctcccgggttcacgccattctcctgcctcagcctcccgagtagctgggactacaggcgcccgcccctgcacccagcttattttttgtatttttagtagagacggggtttcaccgtggtctcgatctcctgaccttgtgatccgcccgcctcagcctcccaaagtgctgggattacaggtgtgagccaccgcgcccggcctttttaattttttagagatggagccttgccatgttgccaggctagtctcgagctcctgggttcaggccatcctcccaccttggcctcccaaagtactgggattacaggcatgaactgccacgcccagttgcaacaatttctaataggtccgttttctcctctccttgcgagtcttttaaatttactttattagctttttattttgaaataattcaagatgcttgaaatggtctttgtataccattttgtatattgttcacatagattaactgatgttaacatcttgccatatttgtattatgattctcagtgtgtgtgtatatatatatatatatatatacacactacatatatatgtgtgtgtgaatctaattttctgaatcatttggaagtttctggtggacatggtgcccttttatacctaaattctcagcgtggatttcctgagaacaaggagcattctcttaaataatgaagaaatttaggctgggcgtggtggctcacgcttgtagtcccagtactttgggaggctgaggcaggtggatcacctgaggtcaggagtttgagaccagcctgaccaacatggagaaacccatctctactaaaaatacaaaattagccgggcatggtggcgcatgcctgtaatcccagctacttgggaggctgaggcagaagaatcgcttgaacctgggaagcgaaggttgtggtgagccaagatcatgccactgtactccagcctgggcaacaagagcaacactccatctcaaaaaaaagaaatttagtttttttggtttctgagatctcagtttcgggtcactgtatcctctgcctcctgggttcaagcaattctcctgcctcagctgcctgagtagctgggaatacaggcatatgccaccacgtccagctagtttttgtgttaggggtcttgctctgccacacaggctaaggtatattagcatgatcacacctcactgcagccttgacctcctgggctcaaatgatgctcccaccacaacctcctgagtagctgggactgcaggcatgcaccaccatgcccagctaattttttaaaataccttttgtagagacaggatctccctatgttgcccaggctggtcttgaactcctgagctcaagtgttcctcctgccttggcctctgaaagtgctgggagtaatagacataagccactgcatccagccagaaatttagttttgatacaatattatttcataagcctacgtttatatttaaatttcattgattttttttttcataatttcttttatagcaatttttttgtttcctcaggatccattctggagtcatacattacaattagtttcatgactcttctggtcccttttttgacttttttttttttttttttttaagaacacaagccagttattttctagcatgctttctgtcttttaaatttacatcttagagatttataaagagggtaaccatatagtttattgtctaaactacgggagtgaaagagggaattaataattacatcaggataacagggaaaaaaaaaagcattatctcagacaaaccagactatatagtcattgcacttatgactttttggaggaactggagccatagttccctgctgtggagaataaatgtcaataacatggtatattttcatgaattatgaaaatgtttaaatatccttaatggataattaagagataattgaccctgtcatgtaaatactgcaaaataaaaattacagattaattctaaaattaaaatttttttaggccgggcacagtggctcatgcttataatcccagcactctgggaggctgaggcgggtggatcacctgaggtcaggagttcaagaccagtctggccaacatggtgaaagcctgccttctactaaaaatacaaaaattagctgggcgtagaggcaggtgcctgtaatcccagctactccggagggtgaggcaggaaaattgctggaacccgggaggtggagcttgcagtgagtcgagattgcgccacagcactccagcctgggtgacagagtgagactctctctcaaaaataaataaattaataaataaataacttttatagctggcttactagcatttctttcttttttttttttttaaattttttattttgaggtggagttttgctcttgttacccaggctggagtgcagtggcccgatctcagctcgctgcaacctctacctcctgggttcaagcgattctcctgcctcagcctcccaagtagctgggactacaggcatgcgctaccatgtccagctaatactgtatttttagaagagatggggtttcaccatgttggtcaggctggtttcaaactcctgacctcaattaatccacctgccttagcctcctaaagtgttgggatttacaggtgtgagccactgcgcctggtctggatagcatttctacacagcaaattaaatcactgaattgccttggcatgcctttttgcaacactgttttgaaaggtacgtagtaaatcatatctgttaaatgtattgtctgtgcttttaacattttgtaatagtaaatagatgtatcacttaggattgatgagaccagtaactgcttagcttagttatttacttcttaaaatgttgtttttatttcagctggctgcataatgacttaaaagtggcccttataggcagtccagtggacctcacttacacatatgaccacctgggagactcccccaaaattcttcaagacattgcttcgggaagccatccatttagccaggtgctctcaacttatgtgtatctactcttgttgatttttaattattattatttaaacttaactgtttttgtaataatcctatgtaagtgttaaaacttacaccaggttgggcgcggtggctcacgcctgtaatcccagcactttgggagtccgaggcaggtggatcacctgaggtcaggagttcaagaccagactgggcaacacggtgaaaccctgtctctactaaaatacaaaccaaagttagcgtgcgcctgtagtatcagctacttgggaggctgaagcaggagaattgcttgaacccaggaggcggaggttgcagtgagccaagattgtgccactgcactccagcctgggcaacagagcgagactctgtcccacccccaaaaaaacttacaccaatacagaaaagaacatgaggaagaaagtaaaacattacctaaaattccaccaccccaaaacaggtattgataaaacatcataatctctccatttatgtagagagcaaagcaagatggatgaatagtcaaacaaaaatgagatcatactgtacatgcagtttttatttgccagagtttaattttcttgaaattatctgaaaagaaatcaaagtaaacctgaaagaattgcacttttaacttcatttaaatctttctttattacaaaaggagttattccttaaaattttaccagtccttctatttttgtttctgaggtacatgtttttttcatttgagttctttctttaattcattttgttgttggctttattgttttgcttttccccaaaggtggctcatggttgcctgtattccttgagttcttgcttgcttgagaatgtctattcctgaagagacagcttgtcaggatgtgaaattccagggtcagacttttttttcccccctttctgagctttatagacactgccttttgttagtgaagaagcatgtaaactttattcctccgccccgccccaaaccctgtcctgattatctttttttttctttttccttggcggggagacgaagtctcgctctgtcacccaggctggagtgcagtggcacgatcttggctcattgcaacctctgcctcccgggttcattctcctgccttagcctcccgagtagctgggactacaggcacgcaccaccacacctggctaatttttgtatttttagtagagacggggtttcaccatattggccaggctggtctccaactcctgactttgtggtccactcgccttggcctcccaaagtgctgggattctgattatcattcttgaaattcagtaacttcaccaaaatatgtcttaaaggtgaagacatcactataagactataggacagaatgtactttcagtctaaagatacaaggttctctttattttagaatatatgtgtggtggtggaggtgattaaaaaactaaggagttggccgggcatggtggctcacatctgtaatcccagcactttgggaggctgaggtgggtggatcacctgaggtcgggagtttgagaccagcctgaccaacatggagaaactccgtctctattaaaaatacataattagctgggcatggtggtgcatgcataatcccagctactcaggaggctgaggcaggagaatcgcttgaacctgagaggtggaggttgtggtgagccaagattgcaccattgcactccagcctgggcaacaggagtgaaaccctgtctcaaaaaaaaaagaaaaaaagaaagaaactaaggaatttccggccaggtgcagtggctcacacctgtaatcccagcactttgggaggccaaggtgtatggatcacctgaggtcaggagttcgagaccagcctggccaacatggttaaaccccgtctctactaaaaatacaaaaattagctgggtatggtgatgggcacctgtaatcccagctactcgggagcctgagggtggagaatcgcttgaacccagaagacggaggttgcagtgagctcagatcatgccactgcactccagcctgggcgacagagcgagactccatctcaaaaaaaaaaaaacaaaaaaaaaaccaacaactaaaaactaaggagtttctgtttgtcacacaagggggtctggaggtaggcacattgaaagctgatgcaggctgggtgcggtggctcatgcctgtaattccagtactttgggaggctgaggcgggcggatcacaaggtcaggagtttgagaccagcctgaccaccatggtgaaaccccgcttctgcttaaaaaaaaaaaaatacaaaaattagccggttgtagtggcctgtaatcccagctacttgagaggctggggcaagagaatcacttgaacccaggaggcagaggttgcagtgagctgagattgcgccattggactccagcctgggtgacagagtgagactccatctcaaaaaaacaaaaagaagaaagaaaaaaaaaaaaaagctgatgcagttgtccaagcatatcatcaaagagagcctgccttcctgctttgctgtcgtcagtgcatttgcttgctcacatgtgattgtgtgtgtccttctccttgtggttccaagatggttgcttcacttacagtctcaggtgtagggaagaaggtgatgtgcaagaggatgaagtagcaaagcacaacttgtttattttgaatagaaaaaaaattatgattaaaagatcaaaaatattaaaaaatattccgtgaaaagtcttcctttctcctctctaattcccatccccatgtgataggtgactactattttgagagaacgtttccttttctttttttcttttttcttttttttttgagacagagtcttgctgtgtccccaggctggagtgcagtacggtggcatgatctcggctcactgcaacctcagtctgccaggttcaagcgattcttgcctcagcctcccgagtacctgggactacaggcgcacgccaccatgcccagctaatttttttatttttagtagagacagggtttcaccatgttggccaggatggtctcaatctcctgacctcgtgatctgcccgtgtcggcctcccaaagtactgggattacaggcgtgagccactgtgcctggcctgagaacgttttgttctataatagatttaaatacatttttcattaattctgttaccttcattaagaactcttgatgtggtggctcacacctgtaatcccagcactttgggaagccaatgcaggcaaatcacctgaggtcaggagcaagaccagcctgggcaaaatggtgaaaccctatctctactaaaaaatacaaaaaaaccccaatttgcttggcatggtggcgtgtgccagtaatctcagctacttgggaggctgaggcaagataatagcttgaacctgggaggtggaggtcacagtgagccgagatcatgccactgcactccagcctgggcaacagagtaagaccctgtctcaaaagaaaaaaaaacaactcttgacaatgcagttgtcgaatcttcttttctatatatgtatttttaaggtctcactatgttgcccaggctgcagtgcaatggcagaattgtagctgactgtagcctcaaactcctgggcttaagcagtcctcccacctaagcctcccctgtagctgggtctgcaggcatacaccaccatgcccagctaatttttatatttttttgtatagatggggctcattgtgatgcccagtctggcctcaaactcctggcctcaagcaattctcccacctcagccttctaaagtgttgggattacaagcatgagccaaccttgcctggtttttcatatctgtgtttttttcctttttccatttgttttgtatcctgtaccctgtctttcctgtccttgtatttaatcatgttttctttcttttctgtcttttttttttgtttttgagatggtctggctctgtcacccatgctggagtgcaatggtgctgtcttggctcactgcagccaccactgggaccacaggtgcacaccaccatgcctggccaattttttgtagagacgaggttttgccacgttgcccaggctgtacttgaacctgtgggctcaagtcatccacccacttcggcctcccagagtgttgcgattacaggcctgagccactgcacctggcctgtttagttttttattgtttctggaatggtatttattacttgtttgtcttccagttctatcctgaattcaatgatgaaaatctccttactatataatactctacagtgttgcttctttgagtttttaagtgagaaagagtgtgttatttttcattgtctttgagactattaaaaactatttctctcaactattcacatttccttggcaaattcctcttgtgattaatgtattcctctttataatatatcagcataatttccatgctgattctttgattgtggccagctatttattgaagaatgacacaaaggatgggtgggagaatgagacgtgtattctataactttacacgttttgttttgttttgtttttgagacagagtctcactctgttgcccagacggagtgcagtggcacaatcttggcccactgcaacctccgcctcccaggttcaagcaattctcgtgcctcagcctcctgtgtagctggggctacaggtacataacaccgcacctggttaatttttttgtatttttagtagagacggggtttcgccgtgttggccaggctggtctcgaactcctgtcctcaagtgatccacccacctcagcctcccaaagtgttgggattacaggcgtgagccaccgtgcccagcctataactttacatcttatttgcccatcttctgtgaaatttgtagtttcctttactcttgggatgcattctcctagtttttgtcatttagagttactatggtttaaaacaaagccttaaaattgtaggtatttaacattgtgatctggtgatcattgctttccctgcctcctcctccctatctgtggcatggtaagtagatggaagatagtaggcatgatacttaagcatagtttttcctattctttaattaacatctgaatctctggagagaagttccccaatttttctgggacctgcccatagttattctgaccacaggataatttgctaggctttttattctgaataattacttttagaaaacgtgttttagctgatactcaggcatatttcacagtagcattggcaagatgctttggattaaactaaatctggttgtatatgtgtgtctgtatgttgggctaacaaattgaagacattcatgttacacctaagacttgggacaacctatattatagaggcaaatatggtttggtgttcagcttacttgtaatattttaaaatcaaagttgtttttttttttaaataggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggtttgttgagtaattgctttatatactataaattcaagtaatgttgtgtatatgtatgtgttcctgatacactgttaaatttaatttacaaacaacatttagcaacattatcccagttacacatgtgaaatatagacctttactctgtgtgagaagagcccgagatgataaggaatatttaaaatatttgaaataacagtgagtgttgagaaaaaaagtgaagtactataaaaattgttatattagttacaccttggttcaaaaattgcaacaagttctttaattaaatgataaaaatgtaagctaatatgagaattcagctaaaggatttctttctttctttttttttctttttaattatttggctttttgttttgagacagggtctcagtacagtggcatgatcatagtccactgcagccctgacttcctgagctccagcgatcctcccacccctgcctcccaagtattaaatggctgaagctacaggcgcatgccacatgcccagctaattttttgtttttgtagagataaagtctcactatgttgcccaggttgatctcaaactcctgggctcaggcgatacttctgcctcagcctcccaaactgctgggattataagcgtgagccactgcacctagcctttatttcaaaccatatcaataatgcaggtttaatttaggtaagttgaaaagagacagatatgtgcagaaatggaactgatccttattctacaatgtgtagataattattactattttcatgcattttcttctagtttttttctttaccctgcgtaatattttattttatttttttgagaccagagtctcactctgttgcccaatctgaagtacagtggcatgatcttggcttactgcagcctccccctcccaggttcaagcgatcctcctgcctcagcctcccaagtaagctgggactattggcatgtgccaccacacctggctaatttttttattttattattattattattattatttttgagatgaagtattgctctgtcacccaggctggagcacagtggcacgatctcggctcactgcaacctccatccctgaagttcaagcaattctcctgcctcagcctcctgagtagctgggactacaggcgcgtgccactatgccaggctaattttttgtatttttagtagagactgggtttcaccgtgttagccaggatggtctcgatctcctgacctcaggcgatctgcccacctcagccttccaaagtgctgggattacaggtgtgagccaccacgcccggcctaatttttttgtttttagtagagatgggatttcaccatgttcgccaggctggtctcaaactcctgacctcaggtgatctgccaccctcggcctcccaaagtgctgggattacagatacgagccacttcacctcacagctgtgtaatattttttagttacataggtgaaattatactgtgaatacaattttgtgtcctggtttcaataggttttcattgccaaatgagaatttcctactatggtcagaaatttttttctagaaattgtttgtaaataaaaatgttaatggctaattgatatcatgaatatactataaatttttttagccattttcttctttttaacatgtatgttgatggtagtttttaacttcttaaataatacagtgattcacagatacctttgcacttgaaattatcttcttaggatatatttctaaaagtagaactattggggcacacaggataaccatttctgagcctttcgaagcatgcttccaacttgttttaggtcctcagaatggctactatttctagatagttaacaaataccaagctaaaccaaaacaacaaccctgctattcaaagtatatttattccagacctcttctttaaaagattattttgtgcttataagagtaatatatattcgtagaaaaaatttctataaggttttggttttctcattatggtttttgctgaattacagtttaatgagtggttttcaatttctcccttttcatttttgaaataatctgatttttcttctttgaatatatatgacttatcatgttttatgtcttactttattgaataagaatcagacttaaagcaattacagttggcataaaatttctagaattatttcattcaatactatgtcatggagagacagagcgtcctaagaatctgacatttctttggttgccattctcaaaacagtaaaagactgctgtttctggttttagcatctattttaaatgggtaagaatgggattttttggccaggtgtggtggctcacacccgtaatcccagcactttgggaggccaagacaggtggatcacctgaggtcaagagttcaagaccagcctggccaacatggtgaaaccccatctctactgaaaatacaaaaattagccgggtgtggtggcatgtgcctgtagtcccagctacttgggaggctgaagaaggagaatcgcttgaatccaggaggcagaggttacagtgagccgagatcacgccactgcgctccagcctgggcgacaaagtgagactctatcgccgagaaaaaaataaaataaaataaaatgggttttttgacattgttgaaaggaaattattccaaaaatcacatttaattttttacattgaaaatactgcagttatggtaaaattccataattgctttgcaggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggtaagtatcacctgtgacaccagaaacaaaagagagtagtacattatgtatgttagaaaccatttagtaatatatttagtgaactgaatgttttccatttgagaattttgcctcccccactcctcctcctttttttttaaacaaaccacaagtgttattagttacataattgatactgcttttaagaattattacctgccgggtgcggtggctcacacctgtaatcccagcactttgggaggccagtgcgggtggatcacctgaggtcaggagttcaagaccagcctgaccaacatggtaaaaccctgtctgtactaaaaacataaaaattagccgagcgtggtggcgggcgcctgtaatcccagctactcgggaggctaagacaggagaatcacttgaacctgggaggcagaggttgcagtgagccaagatcatgccattgtactccagcctaggcaataagagtgacattccctctcaaaaaaaaaaaaaaagttaaaccaaaatatatgaactaaatcctgttccttgggtgccgtggctcatgctgtaatcccaccactttgagaggctgaggcaggaggatttgttgagcctaggagttctagaccagtctgggcaacatagggagaccctgtttctacaaaaaatttaaaaattagctaggcgtgttgctgcatgtctgtgatcccagctacttaggaggctgaggtgggaggatcacttgagttcaggagtttgaggctgcaatgagccatgatcacgtcactgcactccagcctgggtgacagagcaataaaaaatgttatttttaataaaattaaaaacaaaataaactaaaatcctgtttttagtcctttaagaaataatcattgttgagttttgatatgcgtacttcataacatcttcatacgcatatacaaatgtgcacaaattatattaaactatatattattctacgattttcttacacttgattcagatgtttctaaaggtcttcttttctgaataacttttttcttctgccagttgttattaatgggtggcagtgtttccaaatttttctgtagtttttcgtttatgcctttttcagtattactgtcatattcctgtctttgcatcctcccccatttcagtctactttaccaaatttcacaaactggtacatctgagcagttctactttgtaagcatcagtatacttacttggctattttatatgtgtgtattatattatacatatttgtatttgcataaaatagtctgagaagatacttttttttctttaaaaaaaaaatttttttttttgagatagagtctcactctgtcacccaggctggagtgcagtggtgtgatctcggctcactgcagccccagcctcacgggttcaaacgattctcatgcctcagccctcttgagtagctgggattacaggcacacaccaccacattgggctaatttttttgtatttttagtagagatgcagttttgccatgttggccaggctggacacaaactcctggcctcaagtcatctgtccaccttggcctcccaaagtgctgggatcacaggcatgagccaccacacctggcccccaaatgctttaacaataattttctttggggccgggcgcggtggctcatgcctgtaatcccagcactttgggaggctgaggcgggtggatcacaaggtcaggagatcaagaccatcctggctaaacacggtgaaaccctgtctctactaaaaatacaaaaaattagctgagtgtggtggcaggcacctgtagtcccagctacttgggaggctgagacagaagaatggcatgaacccaggaggcagagcttgctgtgagccaagattgcaccactgcactccagcctgggcgacagagcgagactccatctcaaaaaaataataataattttctttgggaagggagttgaattagggttgaggtgggctttaatttttattacttcactactgtttcattttagttttaaaaacttttgtgactttacaaaatgggatttaaaatgatatatactatcttcatgtacagtagaaaatcagtttttaataaaattttggtttaccattttccatctttgtgcaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgaggtataatttctgagtcatttcttagtgatgctactaaaggcatatttgatattttagcctgttagaatgattttcaaagtcaaggaagatgccagtctgaaatgcagagatgatttgaataatttctatagaaaacatgtattcagaaacaggaattcaaggttacagtgagctctcattgcaccgctgcactccagcctgagggacagagcaagaccctgtctcttaaaaaataaaggaacttgaaattggtgcttttattttattttatttatttttgagacagagtttttctctgttgcccaggctggagtgcagtggcgtgatctcagcttactgcaacctccacctcccgggcgcaagcttcctgagtaactgggattacacgcatgtaccaccaagcctggctaatttttatatttttagtagagatggggtttcgccatgttggccaggctggtcttgaactcctgggcctcaagcagtcctcccacctcggtctcccgaagtgctgggattacaggtgtgagccactgcacctggcctgaaattggtgcttttattgttgaaaattgttgacttgtcttttgcctgaaaatacatctgttagctctttattgatgtaaaagtaagcatcctgacttttaaaataataacacattgtaaactttatgtattttaataacaggttagcaaaaacatttggatttagcatagtattgtctcttcatttcatagagtcactaatgtactgacagctgtgaatgaattagaatttttgatatttgtgttccctgcttaactgcttccttcataaatgtatgtctactaatggacaccaataggtttttcagtagtgctgcattatttcaccatagttacaattatctattatttgatatttttaagtattaaagctttttgttgtttttggggacctgacatgttgtagattgctggaatgactcttccatatgatactctggatcaagtaaggaacagattggaagaagtctctcctaatcttgttcgatatgatgatattgaaggggctaattacttccagcaagcaaatgagctctcaaaggtaacagctcgcctatgagcagttttcataatgttgtatctactggtgtaacagtactagttttccatattattgttgatctcttcttttttgtgcagctagtgaaccagcagcttcttgctgacccacttgttccacctcagctaactataaaagacttctacatgacaggtatgtaattgtcaacatgactctgccaaatacgaaaggtaagaagtaatcagatcacctcatttggtgttataattccaatttgtgattgatagtgtttgcaattcttaatctttgaaggttttcaaacattggaactaacgtaagcatattttctgattctactctagtttttttgtttctgaaatgtaagcaaagtttgaaaatccaagcaattaatagattttaaatataaaattttgctgttgtaaggaaagtcactgtgtagcaatttatggtgaattttccaaagtggcaaataactgcaggtttttctgagaattataggtggaagaatcaaaacatttaaatgtgaaacatgttaaacagtgcttctgatgtaaattgttaggaatgtttttaaggaatgcagacaaactgaaacttgtttattgcagattcttagaacagttgatacaacatctaggttatgaggtagttaatagttgatagattattttgactaattttctatctaaaagcacatagaactcttaatttttttatatagtttgtatctaagattttttaaataagtattttagttagataataaagattaccttcattgtaaaataatacctatgctcaaaagcacaacaaaaaatcacttctatggtatttatctgcgaacttatgaacacaaagaaggaaacaacagacactgtagtctacttgagagtggagagtgggaggagggagaggtgcagaaaagataagtcttgggtactgggcttaattcctcggtgatgaagtattctgtacaacaaatccctgtgacatgagtttactggtgtaaaaagccttcacatgtacccctgaacctaaaagtttttttttttttaaaaaaagaaaaatcactaccctcccactatcaagaaataactataattatttttaacattttagtcactcttcctccagggacatacatatgcattatacacatatatattatattaattaactattgttatttatatgtaattattactgtttacatgtacgtgtgtgtgtgtgtgtgtgtgtataatttttgagatgagattttactctgtcacccaggctgaagtgcagtggcacaatcttggcttgctgcaacctctgcctcctgagctgaagtgatcctcccacctcagcctcctcggtagctaggactataggcgcataccaccacatccagctaatttttgtattttttgtagagatggggtttcgccatgttacccaggcagatctcaaactcctggactcaagcagtccacccacctcagcctcccaaagtgctgggactacagatgtgagccaccacccctggcctatatattttttagtgaaacagaaggtgagattaggcctggtgcagtggctcatgcctgtaattccagcattttgggaggctgaggggggcagatggcttgaatccaggagtttcagaccagcctgggcaacatagtcagatctggtctctttaaaaaaaaaaaagtgagattattcacttgggggttgatagctttattgaaatataattcatgtaccctaaaatttactcatgaagtggacaattcaatgtattttagtacatatgctgttttgtaacctttttcaataatagtattgtacacatttttcctatatttatttatttatttatttttttgagacaagagtcttgctctgtcgcccaggctagattgcagtggtgtgatctcggctcactgcaagctccgcctcctaggttcacacgattctcctgcctcagactcccgagtagctgggactacaggcatatgccacaacacctggctaattttttgtatttttagtagagatggggtttcactgtgttagccaggatggtctcaatctcctgacctcgtgatccacctgcctcggcctcccaaagtgctgggattacaggtgtgagccaccgcgcctggcctttcctatgtttttaatacttttctataattttttaatggctgcatactggtgcactgtctagctgctctatagttatttgattgtttccagggatagttattgaaagcatgtggccagtaaggggtttatcgttggaatctgttggttacatataattatatatacttgcatagggccttataatcttttttcctcctgaatatgtgcaccattaaagttttagtatgtgctttttaaaaagttgtattatcaaaatgacattttcttaatatctttcagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaatggctaatgataatttagctttattatatgtgctaagcactctggttttacatgcattatcttcttttgttcttgctacaaccctgtgagatagtagtattatctcattttactgatgaagactgaagcctaggtatattaaatagcttgcccaaggccacacagcaaaagtcaccaactcaaacctacttcttatttactccaaagcctgttgttcttaactgcaacatattatttcgtctcattaatgttgattctataggttgttacttctaaaaattagtattgagtttaatggtgaacacatttttctattttctcttgaatctgcttctataatgtcatggtgatttatgtggcttttttttttttataagttatacatgtatgcatgtatacttatgagacctcccttggaatgagggaggtctcaagagatataatttagattctcattgatgttctgtattcattatcctaacaccatctgtagtgttaaatcaactaaattatttcagcaataggagacaaaacaaccagctttcataatttttaattgtcaaaaccaaaaggaatcagaataaggatcactgagaatttaaaaaaataaaaaaggaagtaaaaattttacaattaggagataattaaaaatagataatttttttttttaatctaaggttgggtgtggtggcttacacctgtaatcccaacacttggggggccaaggtgggtggatcgcttgagcccaggcagttggagaccagtctgggcaacatggtgaaaccccatctctacaaaaaatacaaaaattagctgggtgtggtggtgtacacctatagtcccagctactcggaaggctgaggtgggaggatcacctgacccaggag

SEQ ID NO: 36321 - DNA, 38481 bp, Homo sapiens
ccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggtgagttgtcgggccctcccgattagtctgtccgcctgggcccggggcaccagttcaaagctacaacctgaaagactggtccgagggggagggggttgagaggctcagcagctaacactgggcggcggcggttggcccggggaggcaagcggtgacctagagaaggcctgaccgacggatggcggggaagaagggcccaggagagtaagaaggggccggtaacggggggtggacgccgagggagtaggctgggaggagtgaagcgtggagagggtcagcgtggaaagagtaacttggggaaaacactgaggagtgagcgtaggagggtggtacatgcagattttgggcgccagagacaattaggagagtcttggtttgctgagatcagggaagagttttgaagatggtggaaaaactatggggtgagataggaaattaagagagaagaccatgcctgcctggagtagcttgggagaagtgtgtgggtgggggacagatgggacagataggacagtagagcctgaggggcaggggcagtgacagggttgggcattttgaaggttggaatttgagactgtgaagaaaggatgattcaagagattaggagtgatgctgggtttgagtttggtagtcatagttttaagggcgaaggaacctaaggtagctggggcaatttccaggaaagaaaacttggacccaacctctggagactaaggggttcagggggaactttgatggggagtgcacatctgacttggaggtattgaggatgtcgattttctcccagttttgctacttcctcccagccagacgctgacaaaaaaatccccagacgtttcagttaggagggcctcccagatgtgaggttttgggggtggagtatttgagtttggtagactacctctttgccttcagagtttcttcttttctttcttccccatcacacagctagcctattacctcatattttgggggtgcagggagcaggtagacaaacttgctaaggattgggttgttaccagggcctaagaatggctggatggggccgggcgtggtggctcatgcctgtaatcccagcactttgggaggccgaggtgggtgtatcacctgaggtcaggaattcaagaccagcctggccaacatggtgaaaccccgtctctactaaaaatacaaaaattagccgggcgtcgtggcacatgcctgtaatcccagctgcttgggcggctgaggcaggagaatcgcttgaacccagaaggcggaggttgcagtgagccaagattgcgccattgcactccagcctgggcgacaagagtgaaactctgtctcaaaaaataaaaataaataaatcaataaataaatggctgggtgaatgttcgctgattgtgttgtgccctaataggcagtgggtcgctaacaactttaatgcctaaaagtgaactttgactaaagtgtctcttcctgactttgattcatgctgtgcttgttgctacccacctgctcttgctatttgtgacttaataaaataacataaagaacagacccagatgggagtggggaagaaatagacatattaggggtctgagaaagcagtgagaggtatacattttgtaattcacatttcagtagaatgaaatcaacaccctggaatagtgattctcaaccaggggacatttggcaacatctggagacatttttggttgtaacaactgggggattgcttttagcatctagtgggtagaggccaaggatgctgctaaacatcctaactaagcacagggcagcccctgacaacaaagaatcatctccctgaaaatgtcaatggtgccaacattgataaatcctgctcgaaaaccatagtattggaagggttcttgattatctaattcagtgactctcgaggaccttttcatgcgtctgtgaaatcaaaacttcggaataaggttaagaaggtatttgtccttttctgctgggcacagtggctcacgcctgtaatcccagcactttgggaggctgaggcgggcggatcacctgagatcaggagttcaagaccagcctgaccaacatggtgaaacccagtctctactaaaaatagaaaaattagccggtgtcgtggcacatgcctgtaatcccagctacttgggaggccgaggcaggagaatcgcttgaacccaggaggcggaggttgcggtgagccaagattgcgccactgcattccagcctgggcaacatgagcgaaactctgtctcaaaaaaaaaaaaaaaaaaagaagttatttgtcctttgtccttttcactctcatcctctcaccagtgtacagcagagttttccagtggctacgtaacatgtgatgacctcaccactctgatgttcttatattttattcatttctcagttttaatttctaatactgtaaataccaatacatatgactcacataaacctctgtgaagtcctcagtggataagaaagtaaaggggtcctgacaccaaaactttgggaatccctgatgtagtccaactgttcacagcgcgcaggaaactcttctgtagcacttctgaaaggcggccttgaggcaggctttgcttgaatacttaattggaagccttaactgtaccttggagcacttactgagggccaactgaccctaagaaaggattgtttacaatggaaagtaccttatcagtgactagaacacatctgaccaaggcatctgttaatcagtagttccctgccaattgaatctgtgcacaaatacaacactgttattgttttgggaaagtgaaaaaaataatagttgtcctacttgttggctttcatgtcattaaatttttttttgttttttaatgaaagcttttttgttttgtttttacaaaagcaatgcttactcactgcagaaaataaacatgcaaaaagaagcacataaaagaacccatcagctcatctgctagtttgccatttattgatcaggactaactagattcttcctcttggaaaatttccaagattgattccctccgcctccaagttcagagcaggatttggaaaagtaaatattaataatgtacctagatctgatttttaagaggttccaggatgaaatagaaaccatttttctatacagctgcattttctgatggctcttggttcagtgtggagcccaaagtcctcccatatagctttttctgtcaagaatttagcagttgcttggtgggttttgcacaagttacttttctatatcaaaatggataccaataataggtttttgaaaacttaataaatatttgtaaagtacctaatatgtagctaaatcaataaatatttgtaaagtacctactatgtagctagaactgtgcctgggtactgtacggagtgccaatgaaggaggacctgtcctaaatttatagtcttattagcattagtgctctagctgtgccagtttgactttgtaactttataactctatcccagcttcacccataaccttttaaaaacagcagctttagaataagtacagaaaaggattcttagaggctatatattggtctttttcatagagattaaattatgctggtgtttatttggatgaattgtaactgaccagacaactttccgaagagaagctatatgatttagaggtgttataaagtggatagtgggtgaaaatcctttctttatataattgcctaattatggtccttttgtgatatcatagatttcaggattcttctgtggttattgattcttataactagcttgacttctgttttttggtttgtttgtttgtttttttagggttcagaattttttttttttaggtttgaggcttttctgggtgggaaaaacctcacagaaatattcttagtgtatgttactggtaggagcctctcccttccacacgtttactgaatgcctattgtgtcccagccactatattaggtgaaagggacagaggaatggataagacagatgaggttcctgctctcatggagcttacattttaatgggagaagaaagctcaacagataaataatataatgtcagatagtgataaacactatgaagaggccgggcatggtggctcacgcctgtaatcccagcactttgggaggtcaaggtgggcaaatcacctgaggtcaggagttcgagaccagcctagccaacatggtgaaaccccatctctactaaaaatacaagggcatggtggccagcacctgtagtcccagctactcgggaggctgaggcaggagaattgcttgaatccaggaggtggaagttgcagtgagccgagatcatgccactgtcctccagcctgggggacaagagcaaaactctgtctcaaaacaaaacaaaacaaaaacactatgaagaaaattacacaggtaatgagaaaggagaatgagtagatgataggaatgggtgatggtggatgatccttctttatattatgtggtcagagggccttccgttatcgggtgacatttgggcagagacctgggtgttggcaggaggccagccatgtgaccatctggggaaataggaataaatcttatcatttgcaaaatcttaggttactagcctattttccacgcttttttgtttccccctagttttagtcaagtctctcctatggtagcagtctctaagagcagagacgatcttatgtactgttacttcccattgcctacctagcatagggtctggtacatggttaacccgtagtgaatttttgttgaagatattcattggtgggcactagggatatggtggtaaactagactcatttagtctcctttttcttccatgaattttaaatgatgttttgcaagaagttcttttggattgaaaacttcaagatcagtgctaagcagtacggataattatacagtaatttactaatgtataatcccatataataatgctagtttcttacctgtactccttcagatatacctccgtagtctcgaagggggtaatatggagaattaggagttccttggtgaggagagttaggttttcacaaagttaggttttctctgagagaaaacaagcactaagatttttctataggcttaacacatttcatttaactgataactttgatttcgaggttctgccaaattattctagttataatagagatactgtaaaggactgaaaaattctgaaccctaaaaaaaaacaaaaaaaaaacgaaaaacagaagtcaagctagaagataagaaaggacaggcttgttagtttgttagtcattgattatcacatctgatagggttatagatattcaaatatgtcccaaataccagattagtttgttagtcattgattatcatatctgatagggttatagatattcaaatatgtcccaaatatcagattgtcacatctgatagggttatagatactcaaatatgtcccaaaagaacagctttcttcccctatatctttgggtagattttgtctataaccaagcattatttcgtagcactggagctgatttaaatgacccttgatgcaggaaggctgctcttctttctgtagtgcaaaagtattctgatcataatttcttattaaagtgatcagagatcccctcagacccaaaagtatactttataagtacttgttggtatcctgctgtgcattgtgaaagaattctggaggtgtgccaaacactgctcaacaataagcactttccattagttgagtagtgttgaatcttgtttccttacccactctttggccttaacaaattaagtcattttatagcttaaaaacatatttttattaacttttaatactctttttcatgtgttcaacattcttactttaaaatcatattgcttttctcctttaagaaacttaccaaaagcaagggtataaagtaactgaatgcaatgagtgtacctattattaggaattataaaggagaaacagttaatctgacttaaacttgtaggaaaaccatcactctgaatagaaaacaaagataaataggtaccgtatgcctctgtgtcctgtattttaaaaagaccttttgctcaacatcattctaaattcatgagtttgaggacaagagtccagaatttaatatgatgaaagtaaacataaagctaaaacttgggaaggttccctttaggtgctgtgtttactaaaaaggagacttgtaaattggtatctaacttgtttggcaaatttcttttagctctgaagggtttatatgctttcaaagaacctattggagaaatatgcactataattctaaacaagggtaacttgcccaaagtctcacagctaggaagttggactgccagatttgagttctagctcttccactccaggaatggggactcttaatcacttcattatataatcaatccattgtatcttggatcattgtttggtttctttttattggttttgttttattgctagcattatgttcttcccccacccctaattttgtgtgtttatgttttcagctatactttgggtcaaatagacttgcaaaaacctagccactttttgcagtgtcatacacttggggaagtaaggtctgtgttctctgtgagaggtttttttttttttttttgacagggtcttgttccattcccccagctggagtgcagtggagtgatcttggctcactgcaacctctgcctcatgggctcaagcgatcctcccatgtcagcctcccgagtagttgagaccacaggcatgcaccatcacacccagctattcttttgtatttttagtatagatggggtcttgccatgttgcccaggctggtcttgaactcttgagctcaagtgatctgccccccttggcctcccaaagtgctaggattactggtgtgagccactgcccggtcaaggtctgcattctaaaagaatttacaaatgacctttttggaaaacaggattgagaggatatttgactttgagaacggttgattttgaggcatacctttttcttttatttagagaataaactctcagctctaaaattacacactctagaatatattcatctatggttttttaatgtcataaagccttttaaaaattgggtattgtaaaatcaaacacagcaataaggatggaaattgcttgctagatactttttaataaagtgtaaatatttcaactgtaaacttaccttttgggaaaagctctgttcctagcttgacatccatgtcaaaatttattgaagtgaaacccaacatggggtttgagggaatatccagaagactgatatgttcaagatttggaagagctaaaggactggcctctctgtaattagattaagctatgttttgggtccctattgcagtgtgttttcaccttgatataattaatcagtatttattgaaaatctaatatgcattcagcactacttggaatgataggagatagaggaaaagtaatacacatggtgtcccctaccatgacactcatgatagatgacattcatataaaagacacactgctaggggttgtgggatacatcagatcatctgatcaagggagcatactggagttcaaacgagtgacagaaatgttatctaaagggaatcttgaatctatccatatatatcattcattcacagacttggtactttttttattagtaacaaattacttactgtatactataatttaccatggcacaccagtttgttatgaagtgacagttgaaaactgctgtgttggagcttatgacagtaggagggacaggatttactgctataaaataactgaataattcaggataatgtaaaatatactgaaatgggatgtgcattattactgctccttgagggcttttatagtcagggaaagctttgtggagaaaatggctactgaaaaaacagatagcatatcagcccaggttcttaattgcaaggaagagaaatacaatctgattgattttaagcagaaaagaatttattaaaaagaactgggatataatgcataccctttggccccacagtttcattcctagatatacagccaacatacacgcatacatgtgtttactaatatgtgcaagaatgtttgcagcagtgtttgtaatagaatcacactggaaactaaatgcccattaaaggtagcatagataagtagtttttttgtttgtttgtttttgtttttttttgagacagagtttcattcttgttgcccaggctggtggagtgcattggcatgatcttggctcactgcaacctctgcctcccgggttcaaacgattctcctgtatcagcctcctgagtagctgagattacaggcatgtgccaccatgcccagctaatttttatattttcagtagaggtgggatttggccatggtggccaggctggtctcgaactcctgacctcaagtgatccaccctccttggcctcccaaagtgctgggattacaggcgtgaaccaccccacctggcctgtattcacctgatcatagaaggttatacagcagtgagcacagactgcaattatgcataacatgggtgaatctcacaaaacctaaaattgaggaaagaaagcagacacaaaagagagcatagtgaatgattttatttatatcaagttgaaaaatggataaaattaatctatagtgtcagaaatcaggataatggttacccttgggaagggaatagtaacccttgggaagggaaagggaaataaggagggctttggaagtgtagttgacccttgaacaacacaagtttgaactgtgtgtggatctacttatacatgagtttatttcacctctaccaccctgaagacagcaagaccaacccctcctcttcctcctcctcgttatgattttttttttttgagacggagtctctatctgttgcccaggctggagtgcagtggcgcgatctcagctcactgcaacctctacctcacaggttcaagcgattctcctgcctcagcctcccaagtagctaggattataggtgaccaccaccaagcccagcaaatttttagtggagatggggtttcaccatgttggccaggctggtctcgaactcctgacctcaagtgatccgtctgcctcagcctcccaaagtgctgggattataggtgtgagccaccatgcccagccctccttatgattttcttaacattttcttttctctagctttattttcaaaacacagtatgtaacacatatataacatacaaaatatgtgtgaatcgactgtttatgttgttggtaatgcttccagtcaacagtaggatattagtagttaagttttgggggagtcaaaaataatatgcagattttcaactgtgcagtgggtcaacacctgttaatgttctgtttcttgacacaggtggttttggtttgtgaaattatttgagctgtagacttaatgttacgtgcacttttcccttacatctgttatactgtgcctgtttctgtacatatgttacatatcaaatgtttattaaaggggtatattgggtaactcagaatttctggtgctcctggctatatataccaaatcccagttcaggattcaacaacccagatcatgctgctgaactgcactaccactgccaagtgtgaaattgaagcttgctctgctggccttgttgcctgggagcttgatcctgcttctgttactccacacctgtctccctccctgttccattcctggctccatttgcagccctcctttcaaagtgtggggtggatacctttgttaggcagagcctagcacaagtggtcctccttactgcaagggagtctgggaaagcaagtatccagtgttttcagcttttatagtgggtggtgatttctgccagaaattgtaacaaggggacaaggggtgtttcagatttggggcagccaaaaagcgagcaaaatccatctttgaggtgagcatttaggccaatagaagaaagtagatttcaagtgttaggaacaatagaagcccagggtagaggttgaatagagtatggcatttgagcccagtggaaacaagtttaactggattaaagggtgtgctctgggaaaatagtttgagaaaagttgaaggaataggatgggacaagattaaagattactttgaaagtcaggcagaggaatttaaatttcatatgggaatgttggagccagtaaaagtttttgaacaagaaagtgtcctaaaaggaaatggtacttaaggattattaatctggcagcacttctaggggtatctaggcattttctgtcataatttaggtgtggggtgatagattgggagtagaaataaaagacaaagattgtatttaagagaagatttgaaggaaaaaaatcaataggacttcttgaagagaaagaagtagaggctatttctgaaactgagcttgagtgactgatcccactcttcatttagagctagcaaagctgaggagggacccagtttggaggaagcagaagaatgaattttagtttgggaattgctgagtttgaggtgagagatattgagtaaaagtggtccctgtgcagttagagttggggaccaagaagtggaaagaattgcactcaggcagaaaggctgtgaagggaatggaacagagtgtgccagaaccctcagggtgtttctcagctcttgtttacgggccaccaggtatactatcttgaatttaattttaagtgatacgtttgaaccacaacctctaccttttgtttcataaaacgtcagttctcacaccctaagacacattgatgcaagctatcgatgctattactattttacatggtcttcttcctgttattctaatatatttggaaagaaaatgattaatacatgtgaggcttttcttggtaattttcaatacttttgaatgttttgaatacaaggagaataatatactaaagctagagaccttaaacaagaccgagaaaagactgcatataaaaagcaaacctccagttcattaaaattgtaagttggagctcttggctccatggcagggagccttggatcagtaagtataacagctcccttccgtattgtacttagaaaagaatgatcataaaacctacttaggcctcacaaggtctttttgagccttagccaatgcatttagtcactgtcagtaaccacaagctttagtataatattctggcttgcaaagcagccaggtctccagagcatgacgataggctcttctatacaacttgaaagctgttgctgaggcataccttcttgatattcctcttagcacttttctctagtctatagcaagtctgtacctgtagatgacagtggattgctcagatattattaaagagtatgcaagtatcttaacaggaaacagcttaccctttgggtaatgtgtgatacagtgaagaaaatcccttaaatggttgcccaatatttatgctgctggcatgtttgctgggatattttttctcctctgaattagtattttgagtccttgggctcttcagtttaatagataatgtttctatgtttaagtgtagaagatccaccatgttagctgaaaagttccaaggcttttctgtctctgtaacatttctctgcctaaagaggtagcaggttgaaaatttaggaaataactttgcgtcaaaaaattcatcagcctttctaatcaattcgattttaaagtgaaacagtgatgaactttgcatttatcagaattcatgtttttctcatggatttaacagccctttgcaactctgcttccttggttacatgatagaaagagtatctgatcacatcagaataaaatcgtttgggaagacatccgtgtgtcatagattatgtagcttgcaacaggatttaaagcaaaaagatggtagaatatcggatctatcattatttttgcagtgaatgtttcaccagctggtttgagagaagttttacacccctaccaggcttcctcttacctcatttaccgcaaaaaccacaagtcctaacaggcaaactgtaattgcctaaaacaaaactagtaaggtataaatgcatgtggaaatgattatttgaaggcaaaaggcaaataaatgtcaccagtctgagccatgacctaagcatcctaggtctagtaaccattcttttggtaagggataatgccaacttttttatcaataggattctgttaaaaatacaaagaaaaacagtcagcaggatactgtatctatacacatacatatatgtatatacacatatatgtatatatatgtatgtgtatatatagatataaaatacttttgtttcattttagagctggttgaacttcagtggtgggtagagcttgtttttaatttatataatttttgtagtacaattttaaaatattatttttttaaatgaatccaggagctgtgcggtcttatgcattggaacttaatttgacagattcagaaaatgccacttgcctttatgcaaaatggcagatgaatttcacagtacgctatgaaactacaaataaaacttatgtaagtatatattttaatttttctttgagttttatagtaggaatttaattgactttatcctttagatacacgtatacaaatgaaattccacgttgactgacttaatgctgaaactctgggattttttttaagcatacacactcagaagttattctgtttagtgttagaatgaatatttcttctgattcattggttcttgggagtttttgtaggacttgattaagggcaaatgatctgaagacgactatatggtgttcaggtctaagtatttctgtaaagtgtttaaaatgtactagcaccaaagcttgcccttttaaaaagcagcttcccatctgggcatggtggctcatgcctgtgatcccagcattttggaaggccaaagcaggaggattgcttgaacccagcccgggcaacatggtgagacctcatctctacaaaaaaactttaaaaattagccaggcatggtggcacacacatgtacctccagccactcgctgggccgaggctggaggattgcttgagctcaggaggttgagtctgcagtgagccatgattgtgctactgcactccagcctgggcaacagagcgagactctatctcaaaaaaaaaaaaaatcgcttacttaggttggtacaaaagtaattgccattaaaggaacaaaccacaattacttttgcaccaacctaagtaagcgatttttttttttggcacaaactgcaattacttttgcaccaacctaacactaaaatctccccctttttgacatctcctcttaattcctttgccttcttattttctttttgttaaggtcctcactacttacaacctaattttttaaaaaatcagtttaagaacagcagctcaagccagttttccttttctttttagacatacacgaatttatccagaggagtggtatgtagcagaagaatcagggactggtttacacagcaaaccaggcaaagggcaacctggccatggagaatgtatgatttaggctgaagtggcatgccctacataaatgcttggtgttccttgctgcctgtttgtttctcacccccaaatttctatttcttttagaaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggtaaccttaagaatggatttgtgttatgttctcttgctttttattaatgataaaaatgtaaacaattttaaaattgttatgaatgtctgtcttcctaactagcatggaaacttcatgtctttataaccctcccactgaccccatgcatggcacatatgacaccatccaacatactgatgatatttgctgtcattgcttgagtgacttactgtataccaggtattatcctagtatacagtaagtcaccttactatatatatcctagtatacatatatatgtgtatatatatacatatatatgtatatcctagtatatatgtatatatatatatacacatatatcctagtatatatatacacacatatcctagtatatatgtatatatatatcctagtgtgtgtgtatatatatatatatatatcctagtgtgtgtgtgtgtgtatatatatatatatatctcctagtatacagtaacacacctagtgtgttacctgcagcatctcacttaattcttaacagcaaccctgggaagtagatgttgtttcatttttacaggtaaaggaaatgaggcttgataagattaaatgacttttccaaacatcacacagtctggtaagtgggcgagctggtgtttgaagcagtctattgacctgcagaattcatatacttaactattattgatttcattcagtagtgtgcatgaaacaaaggtttgatgaatgagaaaatgctttactaatagctactttattttcaagatcgggggttggggggggtgtctcactatgttgcctaggctggttttgaactcctggattcaagcgatcctcatgcctcacagcctcctgaatagctgggactacaggcatgcaccactgtgcctggctactaatagctattttaaatgtgtaaaagttaagtaacctgagactaggagaaatgcctcttgttcaaatctttttatcatttaggttggattttgattgaaaagtaaatgatgattagttaaaggtgtagtagtccctcattacactcagggggtatcattctaagatctcccgtagatgcctaaaactgcagttactactaaaccctatacaggaaatgctatgttttttttttttttttgatctgataactgacatggctactaagtgactaacggatggatagtgtagacaacgttgatatactggacaaagggatgattcatgttcctggttgtgcagagcgggacagcaagagatttaatcatgctactcagaatggcgtacattttaaaacctatgaattgattacttttggaattctccattgaatattttcagagctcaattgaccatgggtaactgaaaccagggaaagcaaaaaccgtggataaggggagactaaagtcaacatttgctgttattttaagacaatttcaggtcaaaatgaacttgggaagcattggcaattaggccattctagtaattcccagaactgaaatgcgtgttaaaatattttgaagatatagagtgtagagattttattttattttattattttgagctggagtctcgctctgtcgcccaggctggagtgcagtggcctgatctcggcttactgcaacctccgcctcccaggttcaagcaattctcctgcctcagcctcctgagtaactgagattacaggtgcgtgccaccacgcccggctaatctttgtatttttagtagagacagggtttctccatgttggccaggatggtctcgaaatcctgacctcacgatccacccacctcagcctcccaaagtgctgggattacaggcgtgagccaccgcacgtggtcgagattttaattttgttagggatataattctcttctttctccccctgcccgttgagattgagttaatgtggtatttgtagtagcttagctctttgcagatagtgtttcattctgaccccagaaacaggtagatgggctttagttgcctagacctggggattaataactcatttggacttaaggatgtcaaaagatcctattcgaaagaaccagaagtaaataagctcacgtaaaatttgggaggtattgcagaatgagacttggaaatcaaatcctagtgttctttttactaatctcttagtttgagagtataactaaagcaaatggttattggctatcttatcagtttatctttgtgccctgttttgcctttcagagctagtataagatatgcccctcactttcaagtagcctaagaatgagctggggagacaaagctaaatgctattcccgagttacatggaaaaattggaaaacattgagctcagtctgattttgttgttgttgtttgcgtttttgtttgagggagtagagggttcataaatctcttctgacagtgtgaggaaaactttagactccctctcaaaaaagaaaaagtacacagtaaactttgcatatggaacatagtccctgaacccatatgtagatccctgtggttaagagtgcctgatttaggtcgagaatggtagctcatgcctgtaatcccagcactttgggtggccgaggcaggctgatcacttgagccagggagttcaagactagcctgggcaacatattaagactttgtctctacaaaaaaaaaaaaaaaaaaaaagccaggtgtggtggcgtgtgcctgtggtcccagctacctgggtggctagggtggaggatcgcttgagcccaggaggttgaggctccagtgagctgtgatcccaccactacactcagcctgggtgacagagagagagagaccctgtctcaaaaaaaaaagaaaagaaaaagaaaagactggctgatttaaaagtgttcccgtgttcccacaagtggtcctgattaggaggagtgataaaggaaggctcagtgtgtgttagagtagtgagaaagcttggtagagaagtaggacctgagctgaaactcagctaatggtagaatttgagtaagcggaggattttgagcaggatgtttccagcagggggaagcatagcatatgcggcagtaattggagagctgcctgattaaatcaggctgtgtgtgtagcagaaggaaaataaagttggctaaatgaagtgggcctaaattatagggggccttggaagccaaggaaagacatttagcttgatggggcaggcactggggaatcattttaggtttttaaagcaggagaatgatataacaaaagcagagacagtagcttataaagaatattctgcaggattagttgagaagtgaggaggctacaagcagagatgctggcttaagaagctgttatagtaatcaagggctgatgtaataaatgcctggactacaggggcatcagttgttagcagttattaggaggaggtgtttaatctgacatatttggatagaaaaactatggaccctgaaatgttaacacttctctctttccccttttatttaaaacaaagggaggattactttttaaattactaccttctatataataatatttgaaactatttggaatgttaaatggcttcctgaaatggactattaataattgtttttgatatagttcagtgtttcaagaatactaatttatggctgggcgcagtggctcacacctgtaatcccagcactttgggaggctgaggctggtggatcattggaggtcaggagattgagaccagcctggccaacatggtgaaaccctgtctctactaaaaatacaaaaattagccgggtggtagtggtgcgtgcctgtaatcccagctactcaggaggctaaagcaggagaatcgctttaacctgggaggcggaggttgcggtgagccaagattacgccactgcactctagcctgggcaacagagggagacccttccttacccacccccaacaacaacaaaaaaaactaatttaggccaggtgcagtgactcaacgcctgtaatcccaacactttggaaggccaggcagatcgcttgagctcaggagtgtgagactagcctgggcaacatagcgacattctgtctcaaaaaataaaaataaaaaactactaatttatttttaggcatctgataactgaagtaacattgaagctgcttttttcttttttaaatttttttcgtgattaaaatatagaaatgtactggccaggtgtggtggctcgtgcctgtaatcccagcattttgggaggccaaggcaggcagatcacctgaggtcagaagttcgagaccaacatggtgaaaccccatctctactaaaaatacgaaaattagctgggcgtggtggcgtgcacctgtaattccagctacttgggaggttgaggcatgagaatcgtttgaacctaggaggtggaggttgcagtgagctcatatcatgccactgcactccaacctgggcaacagagcaagactccatctcaaaaaaaaattatatatatataagttacgtatataataagggttttttaaaaggctctacatatacatatatatatataaagattatatatctataaagattatatatgtatacagagaataatatagcagacccatatgtacccattatccagaattaataaatgctgtttttttaatgtttgtgttacttttttgattaaaaagataaaacgttgacaatacagttgatatttcctttgtcttcattccccagacccattttccttcttgcctgctaagaggcaaacactttcacaaatttggggtataaccttcctgtctttatgtttgtcttttactatataagtacgtgttcataaacaatacatagtttaaaaaaagctattcatagtataactccaatatgcctgcaagttgtttttttgctgatttgcttttgaagtccatctatatacagccagtcacgtatctattcatttttgttaacggtgagaagcaattctgggaaaaatgttctagttcattggttttttgttttgttttgttttttaattcctatggccattagggggtgccaaggcagcattatatggctgcttgctacatgatggagaggcacagaaggcagcctatattaaggaccttggatactttcctttcttgctacttctccaaaagaagccaaaccacttgggtgatcatcgtcttttgaagtttcactatacacaggctaataaaaactatatgaaatggctgtaacttactgctttcatactctgaagattccctgaaatggaatcatctttaaatgtaatccaggaagcggttctataagctcattggagttaatataacttacttgggactagtaaaacaaaaataaggatttactatacaaatgtatgattaatccatctctcttgcttctttagttatagtcactaagtcctgatgattctaccatagataagtgttttcagtttggcttctttgctctctttctactgccccacaccatcttagtttaggcaaccctcccttacccttcaccttaaccagaccatcaccctctggtttccctcttaagtggcttccctgaaaagtttttccccctgcttatcccctacaaatttgctatcttccttaaaataaattatatatgtgttattttctgctttaaaaactgaggctagccctcgactgctaaaaagaaaagcccaaacaggccttagatcatagaagatgcttcaaagtatgatcacctgcaacttgtctttccttcttaacccccatttcttttccttttttctttctttttctttttttcttgagacagagttttgctcttgtcatccaggctgtagtgcagtgggcgatcttggctcactgcaacctccgcctcccgggttcaagcaattctcctgccttagcctcccaagtaactgggattacaggcacctgccaccatgcccagctaattattatctttttagtagagacgaggtttcaccatgttggtcaggctggtctcaaactcctgacctcaggtgatccacccacctcggcctcccaaagtgctgggattacaggcatgggccactgtgcccagcccctaacccccatttcttcttcccccttactccttatgttttagccacagtgaactagtcatgcccttaagcatgctatatcctttgtcactttgtgcctggggtagggcaggcagagagaagaagaaagcctatacaaatatatttatattatcacttttctcctaccttcttggaaatagccattgttaatcttgttttataggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatggtgagtaaagtatatatttctctacttggatcctaatttaagagtagagtataccaggtagctttcattgaagtcattatctgaaagcatttatatattaaggtttattcatagcttctactaggctataaagtttttgtaaataatagcaattcttatttttgtgtatcttacaatttaaagtttttgatgtacatgttgtggaatggtattttaaaagacactacctatactgttctcagctgataaaacctaatcattgtttgaacagatcctcagatagcttgattatcagcttttttagcggttccaagaccaaagcttagaaatcagattcatattctaatcttgaatttttaaagttgattttataatttttatatagctttatggaaaggtaataatttctcattcaccagttctggaaaactatgaacacttcccaagaagaggttgaaatgcctatgatttgccatagggctaatgcaaataaatggttcatttgtatttaagtcctttgatgatttctaagcttttttctagtaaacagtatccttccttatggtgattgtatgtgggaataaagaaccaaaaaatttaagacttaactctctgaatttcgtatcagaggcaggcaaagttctttgggaataaaaagatttaagggtctgaaaaagacgagtatgtggccatgtgggagcagataaagcatagggatgtgtcctgagtttgctgtgtcataactcatgtagatattctgtatatgaagcagcagtttaagaacctctgcctaatttagtttcaaatatactaacaagatattctcttcccctaatataacccttttggacttctattatgagaattttttttggttttccctggccttatgaattaagaaaatgtccgctttggtttcttttgtcccttttcgcttgttttagagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggtataggtgtctatctttatcaatacatcctttttgcatttcatttcaaatattgcgtatcctaccttcagcccaaaggtagtgttactagaatgattccgttttctttttgtttgtttgtttgtttttttgagatggagtcacgctctgtcccccaggctggagtgcagtggtgcgatctcagctcactgcaaactccgcctcccgggttcacgccattctcctgcctcagcctcccgagttgctgggactacaggcgcctgccaccatgcccggctaattttttgtatttttttagtagagatagggttttaccgtgttagccaggacggtctcgatctcctgaccttgtgctccgcccgtctcggcctcccaaagtgctgggattacaggcgtgagccaccacacccaggtttttctttcttttttttctgagatggagtgtcacactgtcgcccaggctggagtgcagtggcatgatcttggctcactgcaacctccgcctccagggtttaagtgattcttctgcctcagcctcccgagtagctggggttacaggcgtgcactgccatgcacaactaatttttttgtatttttagtagaaatgggtttttaccatcttggccaggctggtcttgaactcctgacctcaagtgatccacccgcctcagcctctcaaagtgctggaattacaggcgtgagccaccgcgcccagcctgattcagttttaaatggagatttcatgttggcttgttgagctttgattagttaggagttactataaccatgatgtgttaatgtcactttcaggtgttgtgttggccggcagaaaacctagcagtttaaagtactcttgggggtttagattctatttgccatcagtggatcagagtacaaacaattggcctttatttcagtcagtttaaaatataactccttcacactttgatctgaaatgcactgtaggttggcgtacaggagtggcacagctatccgtttctccagctatttgattactcggatcgtgtagacatgcccgagtacatgatggcacttctagttgcaatgttccactcaggctgtagagggattgccaagaaacaaatccgatttccaggatcttgtgacttaaacaagcgaggcagatggctcttgtgctccataaaaatgtgtgttttcatttggctcattactgtagaagcttccctcttgtttttttttttaagttgtctgagtcatagcttgaggacccatgccaactttgtttgaaagtgaagacaccatgaattttaagtatccagacaaaagattttttgttctacgctgaagttgattttgtttggtagagtgtaaggctttgctggccacttttatagctaacctgtaccttttccctttcttcttctcctgaaggttgcttcagttattaacatcaaccccaatacaactcactccacaggcagctgccgttctcacactgctctacttagactcaatagcagcaccattaagtatctagactttgtctttgctgtggtgagtaacagattttttaaagttaggttcattctcttagaaacacatctgaaagtctaaatagttgcatggggggaggggggtatttagctttattttccagttctacagtactcaattataaagtgtagtccattcatccctgttcatccctcagagtctgtgcaatggtctgtggactggactcttgcattaatgttcaccaagagtggccattttaccattagagagactctagggtagaagcaagaattaactcacatcaaaaaaaagaaaaaaacgaaacccacaattgtctaatctatccatacataagtaatttccatgataattttttctctgttattggttaggtagtgctcatgtttttctgtgatactatttgaagccatttggaggctatattatttgtgatagtgtcagtaataaaaataggtaacatctattgagtacttactatgtacaaagctctgtgttaagtgtgtatatgaattcattaaatcaggacaatttataatggcagcattcaggtttttgttgttgatcaagagctgaaacctaaacagaaggttttgggttaagcatacctgttctacttcttgctagcataaattaatcatcggggatctttatttccaccttctcagaagcaactattattcccataatttctgtgaagggatgtatgtgtgaacatgttgtggcaaatgagactggtggaatagaagatagctgtaagtgagggaaaatgttgaaccaccaactattctcaaactaaaaatattgtataattagataaaaaccagttctgtttttaaatcagattactgtgtttggggatggggaaataatctcaacatctgatatataaaaagtaggtatgttgttatttcatatgtgatcttggtattttgagtctaaagcacatttttctctttagaatatatgccgagtaattgaggattacattaggcacttgtattttggaaaggtttacaaaaatgttcctttttccagcattcaaataattcctctgttaaagtaccatgtgaccagtgaattactattgaaaatgtctaattgaatttgtcctctccagtatggtaaaagcaagcctcaggcacattctcttttaaagttacctaataggggttatggtcaataagaacaaggaaagtagtattttgggtttattccctttcaagtgattgagtttgatctttctagctgtggtagactcctaaaaggaacatgatttctcttgactcttatacggcaatgtttagtatttaagaattacaatatttaatttacccagcaggctatcttaaaacgtaatccaaaatagtgacattttaatcatgctacaggcactctgaaaaatcaagagacacctgcaatgtccccagagttcagtggggcccatttttgccttcaaccctgtcatgatagatgctccttaggagaatttatagaattcgagtgcgttatgtgcaggctgctatggtgggttatggagaagaaagccagtattcttaaagtgcccacagtttagtggtaatgggagaaatctgcaaataattaccatttttgtgaaaggcctacatgccatgccaaggcttttgaactcgattctgtaggcagtatagtactgtggaaggtgtatatgaaatgggatgagtgccagaccagagaatagtacaaagtgctgcaggagaatggaggagggagaggttaattccggctggaggagagtcaggaaggtttaatggcagagatggcatttgagctgggccttcaaggatgggtctgatttgtattggtagggagataaggagagtaagtgggaaagtgcaggttatccctggataaagggcataatcaagaccagctgggagaatgaggagtgttatatgtttagtgaaaatgtggaaaagtcattgggacaaattgtggagtcttgaatgcaaagccaagatgtagcctaagtcgaggagggatgtgatgaaggtgtgaagtcctccattatgcttcttcctgaaatttctctgaagtctgtctcctagcttttactccccattgcctttgctctgggtccagtccacattacctcttgcctggaccattcaaacagctcctgcctgattgctcctcttcctcaccttctccattgttctacatcaacttaaccttcctaaagcacatctctccatcagtgtttctctctttcttttctttctttctttcttttcttttttcttttcttttctttccttccttccttccttccttctttcttcttttccttcttttcttttctttctttgacagagtctcgctttgtcgcccaggctggagtgcagtagcgagacctcagctcactacaacctccgcctcccagattcaagcgattctcctgcctcagctgcccaaatagctggaactacaggcatgtgccaccacgcctggctaattttttgtatttttaatagagacgggatttcaccgtgttagccaggatggtctcgatctcctgacctcatggtctgcctgcctcacaatgtttctcttttgccaacaaggtaacatctaaagtccatggctgggtagttcaagccttcttttctcccatgcaatgcagcctgcattttcagccttcactccctctttatgaaccttatgtttcctttagttccttcagggtgcttccctcatcctgtcctctgtgcacttcttgtgaggtaggagaacatagtaataataattacatagactccgcagccatactcccaaaatggggatgataacagcacctattgcataggagtgttgtacttactcagcgaagcatcatatgtaaagttttaagaacagtgctgggcacttagtaagtgctcaaatgctagcataaaaatttgagattatgcttattttctaactaccgttatttatactcttgctctctcaaataccccttttcccacttgtttcctaagagaatcctgcccggttcaaaatgccccatccctaagctggcattactttttctcctcccttatttggaagtgatttctctcctattttcatgacttctcactttcttttttgtaatatggttgtttatgtgtttatcttaccttccctggcagattgcaaacagggtgaaggcaggattgaagtgtggttcattttggtagctcctggagtacttgcactctgaaattattagaatgactggctgatcagatgagtacttcagaaagataatagcagtgaaaaggaaagattaggactggaggggctgaaaggcagggagcccacttaagaggctgctgtgatccaggctagaggtggtgagggctcagcaagtgacaggaggaataaaattgaggccataaatcttcaagtgtctgagatccacatgactacacctgtgctccaaaagttggaaacaaaatacagaggaaagggatttctgtcagattatgagttctcttttacttagttgcagtttattctaccgcatgatttcttcttctgtgtaatagtgttagattgcttttcttctgtgggtattaaccgtatctgttatctgtagacagttgtgaaatgttaattaactggaagctctttttcaaacagaaaaatgaaaaccgattttatctgaaggaagtgaacatcagcatgtatttggttaatggctccggtaagcaaagcactggcctggggaaaaagactgtggattaccctgaaggattagaaattacaatggtcttattaccaaatagtgccttatttaatgaaacagaagatgctatgtaaaaagtgtaccttgatcataccttaaaatcagtaacttagaactatgatgttctgtctttttctgtatcccattttttcaaagtagagtagataataattaaggatatgactgatttttagactatagaaacatctatagaaagataagggaacctagttatggtaagaattgctttttgtgggttgatcttgtcccccaggccttcactgaaaaaccctgaggactgttcctttttttttttttttttttttttgagacagggtctcgctctatgcccaggccagattgcaggggtgtgaccacagctcaatcccaggttcaagccaactacccacctcagcctcctaggtagctgggactacaggtgtgcaccatcatgcccagctaatttttttttgtattttttgtagagacagggtttcaccatgttgcccaggctggtcttgatctcctgggctcacgtgatctgcccaccttggcttcccaaagtgctggaattacaggcgtgagccactgtgcctggccaactttcccatttttgatgttgataggataagaagttactaacctgtttcttttctttgaagttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtaagaatcaagcaaacttcattaataatttatgttcttatgttgacaggtggcttttcctttgaatcatagacatttaaacgttgaaatagaggaatatgaattcatagccttgaccaaattgtgcaactctatatttggctcatcattttgctcaaccgagatgtttttgtgatcttaaaatcatttgcaaaaaaagttcttaaagctaaaactgatagaagctttaagtgagctttatttgaggtatgggttttagtttgtagggaagatggcacttgggagcagcagctttgagcatcttgcatctgcttcctgaggccgtcttctcactggaaacattttcatacctgaatgaaagcagtttggtctgattttgttaagacaaaagataaagagcggtagcaaagcctcaaatatcatgaactatgtttttaccagccaaaacgatctggagagttttcaaagcatgtgccagtgtgaatgacgctttttgaagatcactcagggataatggtggtatttattagatttttaatgaaaccttttgaagggctcattataatgtgttcatacgaatatgaaagacatatttggcattacaagattaaaatttgcatgaagaaaaaaagcacataaaattccttaattgacttgtccttttaagcctattacctaaaattgggggtttgtggatcacaactctgttgagcagagctagctattccaggcatccacatccttttcaaccattaattctatggtttggaaggaaatgtggaagctgtgtttaaaagcgaatatactgtgagccattcgactacttttgcagtggtgttgaatacctagtctgacttggttaggccacaataaattgggctctccaccctaccattcttgcgattaaagacgttagttacactttaaaaatattttcaagaattcattttcccttttgtctgttttgcttatgtacttcaattattttgatcctttagtagctttatttttggactttttatctggctccccttcattattcccctaattttaagtccagatttgtgtttacagtttaaaatcgtttgcagtattagtatcatcacttcaagactgtttatctagtcacctgtaatagagatgagctgtgctctttctcttactttgaaactttggtttttatgtacatagaattaaaaatatcacccaaagagatatacagcatttaatactgatattgaatgtataatctatttgtggaactaggttcttggctgtgggtacctataaatacaacacataggtaatatttgactgtatggggaaagaaatagaattgcaataaggcagaagagtgttgattggattttactggatcagaccactttctagaagtagaaaaaaatagcccccttaggctgccaaccctgaccagataagaaatgcagtaagcacgctcaaattagtaagaggtcccagttttcttgactttgcagccactaaaattgtatgtactaagtcacgatctgcaaactttaaagttccaaacagtgagtgttttaggctttggtgccatatggtctctgtcacaactatttgaccctgctattgtagcacgaaaacagcaacacataaacagatgactgtggctgggttccaataaaaccttatttatggacactggaatttgaattttatatgctctcatgtgtcacaaaatatttttttcaaccatttaaaaatgtaaaggccatttttagctcttggaccagatctggcccatgggctacagcttgctgacccctgaccctaaagacagagccagcctggctattctcatcacatgataccttcctgatcctgtttccactttcccaaaagacattcactctaccactgagaggctaatctggctatgtaaaagtgggctagattagctccctttatttctgataaagtaatatgcctattttggaaaggacttggaatataaacaaacatatatgtgtgtatgtatatgtatatgcacacatatatatcacatataaaatatatatcatatatataatgtgtgcattatatatcatatataatgtgcatatattatatatatgcacacatatacaatgtgcatataatatatgcacattacaatatgagctgtgtttatagatgtaaatgaatatacatgtattcatatatatgaatatctgcatatatacacataaacaaatgaaaggacaaagaaagtcttagaattttaattctagaacagttctccattttctatagctttatcataaaaatatacctgtcttagttacttgaagttgatcttgtaagaacatttctgacttttaaatcaacatctttgacttcgagacattcttttgtgattatactcattatttattacacactttttctcacctacagcccaagagtgttcgctggatgatgacaccattctaatcccaattatagttggtgctggtctttcaggcttgattatcgttatagtgattgcttacgtaattggcagaagaaaaagttatgctggatatcagactctgtaacactaatcaatacgtgatctctgttacaaaagaaaaaagcaagtacaagttccaacatgcaatactggtcaacttaaggtatatttagttgcagtccagctctttagaatgggtggtatgggggatttcaaacttaaacaaaaaactatcaactacaaattagttgcctgactttggtttttccaaccaaggaatttaaaactgttatttttacagcaaaagatgtgcaaaatcactggattataagttctattttactgtcttgaattagtatttcagtgttttcattttagacattcagactaaaaatacaccgtttagaaaaaacaatttttgaaaaagagattttttttccctgcaggtagttgagttggaacaacatgttctaccgtggatttgtacttgctccttttgctctttttgtgtgtgtgtgtgtgtgtgtgtgtgtgtgtgtgtgtgtgatttttgtttgcaggttaacttagctactttggcattgctgcatatttgacctttgagagatataatagtagatttgaacaggggctggtattattatgttcttagcaataaatgcttttctaatgccttttgaatacatttgtatttatgtggctgtaatgacaaaagatacaaaagctttttaaaatttagagtaggtattaatcttattgtttaatcttttttttaaaaaaactggatatttcaatcttttaaattgcaatatataagactattccaactgggcatttcaatccattttttaggtgctttagagataattgcttgccagtgccaattgagggcattagtactttgtgctcataaattggcctctgtatgcagtactaaaattaatgcagatttctctttagccttccaacatttcttgttgatagtgatgtattttattattttctttttcttaagaaatgccagtgtgtcctagaacctagataacgaagtgcacttacacttataaaataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagcctgggcgacaaaaacgaaactccatctcaaaacaaaacaaaacaaaacaaacaaacaaacaaaacttgcatctaaccaaaaagtcttggttttatcttaatccattaaaaagttgttctttgtttccagcttgcattgattgctacaacatcactaatttggctttcacatttaaatggttctgtgctaatcaaaactttcgttgttattattcattatggtagaatcatttttaattcacgtgctttgtgttcagttttgtggtctgagagatgtaccaattgtcaaattaccgtgtaccacctaatgtttataggagaaagcaaaatacatcagcttggtagttaacacatcaaatatttcttgctgcttctaggagaacttttttggtgtgtgttggaatggctgagcaaatattaaaattgttaatatgcagccatatatggaaggttcctgtggggttgttttttcgtgttttttttttttttgtggtgggattatgtgcctcccattcactagaaaatgagaaaattgtctgggttccaaaatattgacattgaatggatcaatacacacacacagacatatatatatatatgcacacatatataggcagttgcatgctagcatgggtatttttataacaatataactgagttatattggaattataaatattttccgtcacttaaatttgttctttgtttagcctgaaaacctttatggctcaagatcagattcctgactaacccctctcttagagctacagcgagctgcattaccagcttaaaacacttcttagggattaaatatagatgtaatttttcaaaatcgtttttaatttaaactgtgttttagtgtaaaattgttaaccttgtaagatggataatgtgtataagaatgtaggccttaactatttcacatgagtcaaaacaaagcagctttaaaaaaataattggaagcacaagtgcatggcactgactgaatgctgttaatatttctaaaagtttctacattcagattatatgcctgattcatagtaaaatacctctaataaacactgttttatagaaaacctgacttcagtgaatatttttgtattttacatgggccagtttatatactgctatttacactattatttcctatagctacatgttctttgtaccttttgtagttttatttgtattactagattcataccttgatggtaacgctctatctggttttgggtgtttttcatgttttagcatttgtataaagaaactggtccatgtaaatactttccatgttttttcttcaaatgtttaaaccactagttgatgtatggtatctttagatatttgcctgtctgtttgctcaaaattgcttctaaaacaataaagattcttttatttcttaaggcaatttgcttaccttttttcccgttggttaaagtcaagattttgtatactacataatggcaatttctttcaaatggaaaaactttagaaatgtttagaagtagaactgaattatttgcaaaatgttctgatgttctgtctgtatattaccatctggaagaatagtcccatacataggcctcgattgatgctaggcaggctacagaataagatcaacctgggaagcgttttataaaaatagattccaggctgcatccttagaggatttaacgtagtaggtctaatgaggagacagagagagagagagacagagagagagagagagagtgtgtgtgtgtgtgtgtgtgtgtgtgtgtgtgtgtgtgtgtaagctcccctgctgaacctgatgcatagtcagttagggaaccagtgatctagaatatttatttcataataaaagctgcggagtatctctttgtacacttttctcaattcctaagttgaggttgatattcaatatctctacatagtagctttacattgcagccatacatattgagctattgatctgaaccaacgtaggattgtgtgcagtctctctcttacttagatcactctaaaatacttgagccttccagtttccatatacggatagttacctagtcaccttactatatcacataagaaaacttagcaatgtagctggtaacttttctctgaattacccagttaagccatgtgaatgccagttagtcatcacggctgcaaactctgcagttaactaccattgtctttggccaagttgtttaacttctagtgtctcaatttcttcatccagtgggtgggggctttaaaatcctgctactcatttctttgagtgataatttgcatttcagaggaatgcatcatagtatttcatacatcttagtattttagaaggaatctgataagctacttgttacgtatcaagaacatactataagttcagtgtaaaatgtaccacttaagtttcctgcagtttttcaggaggaattcttataagacttggacatttttaagatgatagtatttcatctgtttatttaggtagataatgttaaattgtcttgggctcatcttccacccatctccttttcttttaccctggtagctaactttctgcgttaataatcaccatttcttgtatttgaaactggtatagatattcatgaatgatattgagtagcttcacgaatcttttcagatgcatgtgatttacttaacacagtttgattatagatataaaatgtatataacaaaatatcacctaagaatgtgcttcttaatgtggatccttccaaaaagaagttttgactcgtttgtttgtttgttttgttttgtttgagatggagtctcgctctgttgcccaggcttgggtgtgtatagtggtgtgatctcagctcactgcaacctccgcctcccaggttcaagcaattcttatgcctcagcctcccaagtagctgggattacagacgagtgccaccacacctggctacctttttatttttttagtagagatggggttttgccatgttggccaggctggtctcgaattcctgacctcaagtgatctgcctacctcgacctcctgaactgctgttattataggcatgaaacgctgtgcctggcctcaactggtttttaagagaagttttattagtttttgttgtaaatgtatacctcagctttccagttcttgtgttgaaaattgtgtttgaaaaatgtctgaactggcagaaaattgaagattaacagcatttttaatctacatgaaacttcttactgaaattttagtggccatggaactttttaatctttaaaaatctttattgcttctgtggctattaaattcttctgcaaatacacttctcttttccccagaagcattttcaatacagcgttaagtatacattaggcaagtagatcagatcaaaatgacttataggatgagattttcttttcttcagaatgtgatcccattaaagttactgttttaccaacattttttccattaactaaataatttttaaaggttgaattcatacaatcaatagttattataaattaatatttcacatactaattgagagcattttaagtaaatgacagtatctagaaagatctttgtattagcggaattgcctttttgagctactctgagaatatttgtcttacatgaaagccttattggcagtatttatgaaagtcgtttcagtactaggtcaaatacccaatttgggaaagagagaactatgagtctgttgccagaataagaaattaatctactaatgaatttttaaaaaaccaagttatattaaacccacggcataatactttatggtacatgtcacctaatagtttatgggctgggtggtaatttgggaaattgtaggggaggtgctaactggggattcttaacaccatctattcacaggtcacatctggcagcctcagctctctggattcttaacagaaccaagaagcaagtaaaacaaataattgaactggcagcccaagtcaatgtcagaaaagtttataaactccagggttgcattttgttcctagttattgccccagaggctagtgggggcggcggggaaagcttggcacatttcttgaatgcaagcacaatcagaattgccatgcagcctatttgtcctatctttgatacaattctaataagcttagttatctgatttatcagtccctggtagactgcaagctaggcagagaactagggcaacaagacacaggaaatgggaaatagaaatagcagttaacttctttcctgcaagtgtatccatctgtagcattccttcctcctctccagtctcagagtaggttttcttttcctggttaaactgaggcaaacagttatgtcatcaaggcccatttatatctcttttcccattactaagtgaccccagattgttatgtattgagttcttaatgtcttacgcttttggaattcaatctcttaacttgtaggagaacttgtaccattcagcatcttctgtcaattgctaatggctgtttccctcatcctatttaagttcttctaaccttaagctatcctttcttgtccctatgtcccccttctaattacctcccttttgtcctgccttaatcattctaaacttctcaaaatgagtattgtatttgttaccctgcccaagttcttgatgtcctaaccaatcacttcccattccctcttaaacctgcagcaattttactcatatctcccacccttcatattgctagaggcaatggacatgtttcaaagctttctactattatttgctgtctttccaccttaattgaaacgttccatccttagcttctctggcgccattttctatctgcccttttacatctttttcctactccattgtctatcccacaggtattggtgttcccaagggtttttgtctctgatcctctttttattctacttccccttactgagaaatgttcttgcccatgttttaactaccacttaggttcatatagccacttggttaggacatagtgattttttttttttttttgagatgggttctcgatatgctgcccaggctggtcttgaactcctgggctcaaacagttctcccatctcagcttcccaagtagctaggactacaggcgtaagctaccatgctcaactaaggacacagatatcttaaactcacatatctaaaactgagcatctctctcttccacgtatcctttttaccacctgttccatataactacaaaaaactgaaatgcatatattcttcctcttttatagaatggcaccagcatctacataatcagtcaagtgtggaattggaaaccattctattatctcctcctcgtacaccccctacatccgtttggtcaattttgccttctaatttgatctccagtctgtgccttctgcttttcttctgcacttcattaatccagctcaggacaatattattggttacctggactctagtgataaagatatgtcctaccttactacctccatctgccataacttctgaaatgaaatcctgcttaatatcctgctgctgaatttttttttcatcaggataaggccagactacctaagagcatatagtacctttgtgacctgggtccctgcacactttttctgccttctatccagccaaaaataccttttgatccattgttctagctctgccaacctgcttgcgtttcccttgaagtgctatgtctttttactctccatatttttgtctgtgctatttcttatacctggaatgcccttcccccattacttgcatcattaattcctattcattcttaaaatctcagctcaagtgtcaccttttcaaagtgtgtcttatgtaataaggctgaacttgagtgtgcctctgaaatttttccatggcactttgtgttgcctactcctaccacaacacattttgaaattataaccactgatttttcttgtctgactctaacactagactgagcatcttgaggcaaacagttatgtcatcagggcccacttatatctcttatatctcttttcccattagtaaatgatcccagattgtaatgtattgagttcttatgtctgctttgtatagttgttcattcagtgagttaatacttaacagcaatatttgaagcattgtgcttcttcgacatcataacagtttgcctctgaaagctcacggcctgatcatcaaggcaaggctaattagatttgttcattatgttctgtttaagaaatctgggaactatgtgaccatgttatacatttttcatccaaaatgactgcatttttacttggtacttaaaagtgtattatttggttatttggaaaatcacttttgtggaacatctcatttgctgataatgaaatgccaatgacttgttaccttggtataaaaaaccaaaatatgcgtgttaggaagtgctgtcattttactcaaaatacacagatttgaaagtttgtcactgtttctgttctcaattgtcctttctccacatctagctcaagactgcagtgcagatgacgacaacttccttgtgcccatagcggtgggagctgccttggcaggagtacttattctagtgttgctggcttattttattggtctcaagcaccatcatgctggatatgagcaattttagaatctgcaacctgattgattatataaaaatacatgcaaataacaagattttcttacctctcagttgttgaaacactttgcttcttaaaattgatatgttgaaactttaattcttttatcaatcccagcattttgagatcagtctttattaataaaacctgttctctttaatcagcttaaaatccaaagtgtcatatttactggtcctggagacaaacttgttcaaaagaacatcaacgtgcaatgttttaaggtctatcttaagaagccctggccaaattttgatcctaaccttgaagtatgccttgaacttattaacatggccattataagaataaaatatgtagttgtgtcttaatggaattaataaatgtcatttcactactggtgttctgtttcaatgtataaggactatagtgatttaaactcatcaatgtgcctttgcataaagttcattaaataaatattgatgtggtataaatgcccatcagatatgct

SEQ ID NO: 36322 - DNA, 38481 bp, Homo sapiens; identical to SEQ ID NO: 36321

SEQ ID NO: 36323 - DNA, 4349 bp, Homo sapiens
cagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcc

SEQ ID NO: 36324 - DNA, 92222 bp, Homo sapiens
cgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccaggtcagcggggcggggcaggggtcagggctccggggacccgggtgggcgcgggctggctcgggggcgggggcgcgggggctccgcgtgaccttggcgaggcggtggcgctcccggaagtggggctgggcgggggtcgaggtgtggccgggggtggggggggggcggcgtgcgcgctgggacctccccgccccgcgctttccgtccccgccggctcttctgcgcgcctggcccggcccgacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccagggtaagtgaggatgggcccttctccggaggacgtctccagagggggcccagaggcggcttctcgggcactggggagccacggaggtctggtggggagggcaggcccgttaagtggcaactttgtttccttggcctttgtaaacatctctgagtcacagatctccaactttgcaggactcgttcactgtctgaactcatcagtgatgaccgccactgtgttttgtgtatgcagataacttctgttcctagatttgcaggttcagaatttattattattattattttttgtaataggaagtagagatgaagtcttgctctgttgccgaggctactctcgaactcctgggctcaagcagtcctcctgcctcagcctcccaaagtgctggcattacaggcaccagctactgcatccgactaatgttttaaagttttgtagacggggtcttgctatgttgctcaggctggtctcgaactcctgggctcaagcgatcttccttcctttgcctcccaaactgttgggattacaggtgtgagccaccacacctgtctaatgttttaatttttttgtgtagcaatagggtcttgctacgttgcccaggctggtctgaaactcatgggccgaagcaatcctcctacctgggtcccccaaagtgctgggtttacaggcgtgagccaccacgcctggctaatgttttaaattttttgtagagatggcatctcaccatgttgcccaggctggtcttgaacccctggcctgcagcaatcctccagtctgggcctcccaaactgctgggattacagacagagcgccactgtgcccagcccatattctcaatttaaacctagaaacctgtaaacaattatttgtgaactggaataaagggaatgttaattccatgttaggttaaatgatactttgtttcaaaaataacagttttccaaaacagagcgttcagagggtcagtgtggtgggggtgggggtgtacgttgccctgaatgtcttaaatgtccagcctaagaagagagctgttatttctgcctctgtagacagtttcatggcatgtcaggaggcctctggaagacactactgcacgcctctgggagactgggagtcagccaggcgaagcgcttgggtgccttattgtgaaatgacttttgacttccactctgcacccactgaaggaatcccaggggtcccagcgccaccctttgagaagcgtgcctggagtggatgttttaaaatgagcctctctctcccgcctctagccagagaaaaagagctttgagttttctgtgagctaagcttttctttttctgccaaactggccttcagtatttttttttaaacccacttagcataattacaaatgcatagaagaaggagagtaaagggaactgtagtcaggctttcggagggcaggagagcatgtttgtttgaagtaagtaatcagttgcaaggtgaacggtttacagctgctgaacaattgtgtggagtctcgcagaagattatgtttatccgggcagttttgcttacagaaaggtccccttaaacctccttaagggcctgtgtgggccctggcagaagaggccggggttcctgcagcagctcaccaaaatgctggcctttgaaaaacttgctctttgtgcattagaaaaagggctggaatcttttttttttttttttttcccatttactgattaaacaacaacagaaggttgttaaagaggacgagcttctggtgaagtcacgtgtctgccaagggaatctgtacccgggtgtgtatcgaaacagaatggccttctctaaagattaacttaagtggcttgccctcatcgagccccttcctatgtatggattaaaaataattttcgataccagtggaggaatgctgttgtccttggtctgctggtggccagcttcctaaacggcattttttatttgcttctctctggtaggccttcgctgttggtgaggaaacattgaactttgtccagggcatttgagctaagctgtttgaataaccaagagggccaatttccccactgcagattggaagcaagggcagttttttcttagaacttccaaatggagcgtgttcttcttaggtatcgtacaaaggaaatgcctgggttacaccttccacatgagttgacttacatggtatgagaaggaagaaattgtggctggaatccactcctaaatggtgtcttcttacagttcatcatggaaaaacaagataattacaaattaatcatagatgttggtcatgcctttacagagggggtttagaagcaaattgagaattcccataagagggtctgtctctgtgttcttaagactatatccatgcggcccattcagtaagttgtatctgttggttggattttaaaatagatgatttaatcagtgcatttaatatcctaatatggcatcaaaacttgaacattgatatggcctgaaatctgttgaaaatgatcatattgagtaaagaaagtctctacccaccggtattaataacagggtgatctgtttagaaattacattttctctgatacatcaatgagttttgcaaaggagagaaaattgatggtacctgtagtcaagtccagttccaatactgccacagaatttttcttaaaagttctattgtaaataataggccacagaatattccttcactttctgggatgcaaaatggattcgtaaatgctgtaccacaggagtgagtatttacaaaaaatatgccaactggcccacttacaaagctatttatagaagtcctacttttcaaactattttttttttaacctgtaaagggaaagttaattcttgttggttttatgagtagtgaacagtggctattagaaatcaggtagaagtaaaaacagcagttttccaacttcttcttctttttcttgagaccaagtttcgcttttgtttcccaggctggagtgcaatggcgtgatctcagctcaccacaacctctgcctcccgggttcaagcgattctcctgcctcagcctcccgagtagctgggattacaggcatgtgccaccatgcctggctcattttgtatttttagtgagatggggtttctccatgttggtcaggctggtctcaaactcctgacctcaggtgatagtccaccttggcatcccaaattgctgggattacaggggtgagcccctgcccccggcctccaattccttgatcatagaatctctttcaaaaaaaatgaggaccccagacagtttttgtttttgtggattataacagtcaataagtcatcctgttagacattaaaacagaaatttaaaacatatttaacaatctatttaaaagtaatggtaacaggccaattacatgttacatacaaaaatgtatgtaatatatttattgtttttatattttatttttattaaatatatatatttttagaataatttatacttttctataaatataaaatacaaataagttatatttatataatttagatgtaaataaaaacaattgatatttttatataaatatataaatgtgtacacttatggggcacagtgtgatgctttgctgtatgtttgcattgtggaataattaaactaatatctatcacccgctatttttcctttgcggtgggaacatttaaaatctcttttagctatttttgttttttatttccataggttattggggaacaggtggtgtttgattccatgagtaagttttttagtggtgatttgtgagattctggtgcacccatcacccaagcagtatacactgcacgcaagacatttaaaatctctattggcgggccgggtgcggtggctcatgcctataatcccagcactttgggaggctgaggcgggtggattgcctgagctcaggagtttgagaccagtctgggcaatacagtggaaccccatctctactaaaatacaaaaaattagctgggtgtggcagtgtgcgcctgtagtcccagctacttgggaggctgaggcaggagaatggtgtgaacctgggaggtggaggttgcagtcagccaagattgcgccactgcactcaagcctgggcaacagggcgagactccgtctcaaaaaaaccaaaaaaacaaaaaaacaaaaacaaaaataaaaacctcttttagctattttgaaatatgtaatacactattaactatcgccaccacgctgtgcagtaggtcactgaaacggattcctcctgtcgaacagaaacttggtaccctttggccatgtgctgtatgttttttaaaagaaaaatgattgtcatttccaaaataacaaaaacctagggagaagagtggctgagttttagggttttgtcagtctcatccataaagggacggatggcggctggctccttcctctgcttcttcacactggtctcttgcgacgtgtcgttctggtaagagtcatgtgaggcacatccactggcctctcatggatgtgcaattggaaacgtgaaatcgccggccccctgagagcgttttggggagtgtcccccccaaacccccctccccccgcactggggatgctgcaccagtcttgaagaatgaggcagtgagaggctggtttacagcaacctttattcgtggccttgtgtgctcggaagcgctgcaagggaggaggaaggaggaaggagggtactcactgcagaaggtcagctctgctgtggctgttacgtgggttcaggtggaacccacctactgtgtggacggttctttacctgggaatcccatggaattctgacagcaggagacgtgggagggagcttcttgtttctccttccaggagtcacttggttaggggtttgggaattttggctcttagtacaaaacttcactccaggtactagacctgtttcagccaaatgatgatcatcataatagaatagaaacctttgttcacctaaataataacaataatattaataataatagaatataaacctttgttcatggtactggggcgtctttcagcccaataataataacaacaataggaataatgataataatgataaaatataaacctttgcttcacgtcctggaacgtctttcagccaaataataataataatattaatgataatagaatataaacctttgttcagggtactgtgacttctttcagcccagtaataataataataatagtaataatgataataatgatagaatataaacctttgcttcatctcctggaacgtctttcagccaaataataacaataataataataatgacaatagaatataaacctttgttcagggtactgtgacctctttcagcccagtaataataataacagtagtaataatgataataatgatagaatataaacctttgctccaggtcctgggagctctttcagccaaataagaataataatagaatataaacctttgttcacagtaccaggacctctttcagaccaacaataatgacagtaataataattataatgataatagaatataaacttttcttctaggtactgggacctctttcaaccaaataataatagtggaatataaaacttggctctaggtaccagaaccttttttcagccaaatagtaataataagaatagtattaatagaaaacagacctttggtccaggtactgggacacctgtgagccaaataataataataatgataataatagaacataaacctttgactgaagtgccagaacctttttcagctaaataataataataaaatataaacttttgttccaggtacccggacttctttcagcctaataataatcatagaatataaacctttactacaggtcctggcacctttctcagccaaatagtaataaaatagaatataaacttttgttctgttactgggacctctttcagcctaataacaaaagtaataataatagaataaaaacctttgctccaggttctagaacctctttcagcctaataataataataatgatagaatgaaaatttttgttccaggtgtcgagacctcttccagcctaataataataataatgtaataatataagcctttgctacaggtaccaggacctgtttcagccaaataataataacagcaatgataatagaatataaaccttggccccaggcactgggacttctttcagtcaaacaatcacaataataataataataatagaatatggatgtttgctccagctttcaggacctctttcagacagataataataaccgagtacaaacttttcttccaggtatcgggacctcttccagcctaaaaacaatagtaataatagcatatatatctttttttttgttttcttctttctttgagacggagttttgcgcttgttgcccaggctacagtgcaatggcgccatctcggctcactgcaacctctgcttcccgggttcaaacgattctcgtgcctcagcctcccgagtagctgggactacaggcatgtgccactaccacgcccggctaattttgtatttttagtagaggaggggtttcaccatgttgtccagggtggtctcaaactcctgacctcagatgatccacccaccttggcctcccaaagtgctgagagtacaggcgtgagccgctgtgcctggtgccagcataaaaatctttgctacaggtactgagacctttttcagcctaataataataacaaccgtaacaataataattagaatataaacctttgttactggtactgggacctcttccagcctaatcttcataataataaaaataataataataatggaattgaaacctttccttcaggttccagaaccgctttcagccacataataataataataatgataataataataataaatagaatttaaacttttgtttgaggactgggacctctttcagcccaatagcacaaataataataatggaatgtaaaccttttcctcccaattaccaaaacctgtttcagccaaataataatatgatgatgatgatgatggaggatctgatacagctgtgtcctgtcactcaggtcggacttaggaggcctcttgagattcttttccccctccgttgactgtgtaatccaggggccccaccctaactcggctgcagaagatgcagtttgggggttcctcgttttgtggaagtcccggtcatgttattcattctctcagcaccttagaacaaaccagggtgctggcattggccacaggacccccctccttgcaccccagtcttgggaagtggcactgctgggctctggcaatgcccagctcacctggcacgtggcggcgtctccctaaaaagcactgggcgggcaccgttgacggaaagccagcaacgcaggccgcgactgcccgtgaagacggggggcctttctaagacctccactcattatttcgggcaaaattaaccttcagaataccttgctttaataaagtaccagaaaccggagggcttaaaaccatagcttattctctcccagttctggaggccagaagtctgtaatcaaagtgtctcagggctgcgctccctccggaggcttacgcggagggtgcttcctgcctctcccagctcctgggggctcctggcgtccctgggcttcaggccagccacatcatcactctagtctctgcctctgtctccatgtggccttctctgtgtctgtgtctcctcttctgtcttttataaggacatctgtcactgcatttagggctcactcaaatcccggatgatctcatctccagatccttaactcatgagatctacaaaatttctaataaccaagtaagatctcattccacatcctgggctttaggctgtggacagatctttctgcgggccactgttcaatccaccatgattttatccagttcattgtggaggctctagaggaggatccttcctgcctctcccagctcctgggggctccaggcgttctgggtttgtggccgcatcactccagtctcggcctctgtctccatgtggtcttctcctgtgtgtccgtgtctcctcatctgtcttctattaaggacactggtcactgcatttaggaccacctcaattgagaataatctcatctaaagatccttaccttcattattaatacatctgcaaagaccctttttccaaacaaggtcccatacacaagtaccaggtggatacagattttctttggtaggggaggacgcttttcaacccactatagtcatcattgaaatatgcctccttgcactgactgtatcccaacactctgaacgtgcctgggtggtgcattttgatatttaccctcctgagcactgtactggacacttggagacacaattacaccttttaacaaagcccagctgtcattttgggcaacccagtcacagaggtggcctcctgagtggcagctggaagggcctgtatgtgtgagcattcaacctcaacaggaaccctggggactggcttctgggtcatctaagcctccacaccgactgcctgatgtttgcacaggtgtgtgatatttgcccagttgggcctttctgcccacaggtgtgactggacacaatgggcattttgagaagttccagggattgagaaatccatgcttcttcagacgtgcttacagatcacggatgcacctgtgacgttccacatggcttcattttaaaccataaagtttgagaagagtgtgcagtgcctcttagccataggaaagctggctttagtcagatggaggtcctgtttggcttctttaatgcagtgaatgaagctcaggtggcattcagagagtcctgctgtgatggttggcagtggggggtctgcctggccacttgtggattcttctatgtaggcttcatccccagaaaagatctacgcagctttcccacgtggcaggtgcttgggaaactcttaggacaggaacaacaagcccctgcgatgacagaggcattgtcaggctgggcgcggtgactcacgcctgtcatcccagcactttgggaggccaaggcgggtggatcacctgaagtcaggagttcgagaccagcctgaccaacatggtgaaaccctgtctctactaaaaatacaaaaattagccaggcgtgatggcaggtgcctgtgatcccagctactgaggaagctgaggcaggaagatcgcttgaacccgggaggcggaggttgcagtgagctgagatcacgccattgcactgcagcctgggtgacagagcgaaactctgtctcaaaaaaaaaaaaaaaaaaaaactaaaggcacttgtcaggtacagccctgcaaaaatgccgtgctcactcgcaaacctgtatgttgacacgtgcggcatcgctgcagtcggattaacgtggaagaaagagcgtattcctgcgctaggttccctcctccactctgcaaaagtgacccgcaaggaaggtccagccgtccggccccagtgccctttggttgaaagcggagctgccccggcaccctgtctgtctccccggcagggctcccgtgcgtgcctgggtcccttctcatgctgtgtttgtcttggcccttctcagcaggtccccacgcatgagcagccgtccagcaggcaggctccggtggagaagcaatggagaataaaagcctggagagctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggacgcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgcgcctacgtcacgctggccgcccacttcctgggcctgggcgcccccaactgcctgtccatgggctcccgctgcctgaagaccttcgaggtgcccgaagagaacacggcggagaccatcacgcgagtgctctatgaggtcttcatcgagtggggcatcagcgccaaggtcttcggggccaccaccaactatggcaaggacatcgtgaaggcgtgctccctgctggacgtcgcagtgcacatgccctgcctgggccacaccttcaatgccggcatccagcaggccttccagctcccgaagctgggggcgctgctgtcgcgctgccgcaaactggtggagtacttccagcagtctgccgtggccatgtacatgctctatgagaagcagaagcagcagaacgtggcccactgcatgctggtgagcaaccgcgtctcctggtgggggagcacgctggccatgctgcagcgcctcaaggagcagcagttcgtcatcgccggggtcttggtggaggacagcaacaaccaccacctcatgctggaggccagcgagtgggccaccatcgaggggctggtggagctcctgcagcccttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcgcgtcgcccctgagcgtctcttcggatccgccgccaacgtggtcagcgccaagaggaaccggctggctcccgcgcacgtggacgagcaggtgtttctgtatgagaacgcccggagtggggcagaggcggaacccgaggaccaggacgagggggagtggggcctggaccaggagcaggtgttctccttgggggatggcgtcagcggcggtttctttggcattagggacagcagcttcctgtagcgaggaagcgtgttgtcttacaagtcatccccgcagcagcccattggatgctttgctgtaaatacttacccggtcagcttggttttgaacctcagagaccatccactgtctttgacacctagaaggtggaaaaaggaaagagatttgagaagtgagagagggtcgggggcggtggctcctgtctataatcgcagcactttgggaggccgaggtgggcagatcagctgaggtcaggagatcgagaccagcctggccaacatggcgaaaccccgtctctactaaaaatacaaaaattagccaggactgatggcatgtgcctgtaatcccagcttctggaggctgaggccagagaatcgcttgaacctgggaggtggaggttgcagtaagctgagatcgctgcactccagcctgggcgacaagagcgagactctctcaaaaagaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaatgttcggttaaaaatgtgacagatgagtacaaaaatgcagacacttaacaaaaagcaaacagaaaaaaaagtgtggaatgtgttgtattttcgacaggttgctgccagagagcctgcttcctgctgcctgccgaaatttcactttgcggagttggtccttaaaactgggcggtggccgggcgtggtggctcacgctgaggtcaggagttcgagaccagcctggccaaccaacatggtgaaacctcgtgtctactaaaaatacaagaaactagccagatgcggtggcacccgcctgtaatcccagctactcgggaggctgaggcggaagattcgcttgagcccaggaggtggaggttgcagtgagccaagactacgccactgcactccagcctggaggccagagtgagactccgtctcaaaacaaaacaaaagtgggtggctcacgggtccggaggttatgtcttcggtgtctcagccctaaaagtccagttcccccgtgcggccagcttttccacataaggtgtttttgatttgattaccggaaaggactcttgattcttctcttttaaactgaataccataggggaaatgaattttaaaatattgcccccggaggggttttccgtggctggattcctgcgagttgctttcagtcattcagggaaacagaaagacgttttccaacatgtagaactgctttttaactggaggaaaaatacttcaggaggcttagcatattgcttggattctacgtgcagcgggttctctgcctccgtgaagacaagctgggctggggagaacggtgtctaggagggatgaccccactcagctccaggcagtgttctgccgagaccccaagaactcggggtgtcagagggcaaaggaactacctgcctttcacggctgctgacttctcagggctgcaagcagcacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggacacagtggggcaggctttggggttgctccctgttctgccccgaggccggggacgcagggcagcccacgcctccgtgggctccattctgtagcattgccagcgttctcttcacgtctctaacaatccttcgcttttcctcactcacgtggaaatgtgaactgtcccggctctgtcttcatttttatttttaagccatcgttcccctcctgaacggttgccccttatttaatgctgtaaagttggactgttgttcaataaaccagagcaatgcattagctcctcattcatttgtctgccgcgtgtccgtctggactgcagtttgtctgaaccccttgatcctgggagtggagggaggtttatcattattattatttttatttttgttgtggtccttgttgaaagcaactttttccagggcacccacggtcagttctgtgctcctctttcttgtctgtaaatcctcaagttatgatgtactttcgggtgttttggcatcaaaatttctgagtgaataaagccggcagctggtgaaagtgttccccgggagcagagatttttgccggttccttcacttagtggatagttgtataaacggaggccccatggacgaggcagcctggatggatccggatggcatcagcgccttccctctccccccagcctccttatcacccctctcttcctgtcttcctcacctcctctcacatggtctcttccttccctcctccttccgtccaaccctccctctcttcttcagccaacaaatccttcctttcttccttctttccttccttccttccctcccatccttgtctcttcttctctcccttccttccctcccttcccttctttctttctctcccttccttccttctctcccttccttccttctctcccttccttccttctctcccttctctcccttttctcccttccttccttctctcccttccttccctcccttctctcccttttctcccttccttctctccgttccctccctcccctccctctctgcctccctttcctcccctccctccttcccccatccctccctccctccttccctctcctccctccctccttccttccctctgtccctccctgtctccctcccttcctccttccttcctttcctccctccctctgtccctccctcccttttctccctccctcccttcctctttcgttttccttccatccctttttccttcctccctccctcttttcctccctcctgagaaaacaatggcccccaagaaacacaggaaggccgggatgtgcacctctgcccagacttgccctttccaagtgctgttggttgactgcctgtccttgggcatcattaaaatgccgaaatttctctttcttgcacgttttgggttgaaaggggttcattttcagtcctcataactaagcatttgcatcgtgatgttcatttaagtgggacatgtttacacgtttttcccattaggagtaattctagtccttgagggtttcttacagagacatttccctaaccccgacggttctcatcccagcctgtgtggcactccttccgcacagtggtgggatttttcggttcggttttgttttcacgcttgcatctggctgcacagccctaactctgagctggttgtttttgtttcccccccactttgcagaattgcctgcttcgaactgttttcccagcaggcctctgaagggtgaggaaaacagcttggggaaagtgagaaaaaggtttcggatgttttagtaaagaggcagctggtgggaaggagccggttgggctgtttctggggtgccgaaatctcggtggtgacgttcatttgctcgtgagtgcagaggaggcccagagaccgggttcctggcgcagccagctcctgcttttgttccgaccatcttcctgcgccttctgcgagtctcagatgtgcttgggcagcagttctactgttttcccctctgtgatctcaggcccgccgccccgtcctttcccagtgatttctgctccgtcaaatcgtggggctcacctgagagttttataaaatgaactcgccatgcccctgcctggtgaacagagaatgcaaactctcacaggaccgtctgcagcaaaacggcagtgttttgctcatttcttcagacgacgaaaacagcagggtttggctcgtttcttccagattttctcaaactgcatgagttcctttctgagcaacttctgggaagctttcgggtttcagggctttgcagccaggctccttcctagctgcggctgcctgtccttttgtgttgcagtcagatgcgggaggtccttggcatgagtaccctgatggtgtcaactttaaggggtcagagaggaaatatttttggctccgcggaccatgcattctctgtctctcaacaacttagttttgccgttgtgtctaaaagcatccattgctgggtgtggtggctcacatctgtcatcccagcactttgggaggccgaggcgggtggatcgcctgaggtcaggagttcaagaccagcctggccaacatggtgaaaccccatctctactaaaaatacaaacattagctgggcatggtggtgggcacctgtaatcccaggtactgaggctgaggcaggagaatcgcgtgaaccagggaggcggaggttgtagtgagctaagatcgtgccactgcgctccatcctgggcgacaagagcgagactccgtgtattccactcccacttcgtgggcactaaattttatataaatgttgtgtcaagaaatattattgctctgttgacttctttttttcccccaaccattaagaaattcagaaaaaaaatgtacgaatgtaaacactgttcttggtgagtgggccttccaaaaataaccgctggactttgttgaaactacttttttttttttttttttttgccactttttcccttttttttctcgaggcaccaattggaatccacttatttgtcctggtttgagaaacagctcagatcgcacactctgggctctgtgtttctttaggtaacacacgtgaggtttttgtcactggaattcagtaatctgtgttaatattatcacaaaagaaccggggggcatttgtgtcttctcagaattgctgattaaaacagctgcatggccaggtgcagtggctctcatgcctgtgatcccagcactttgggaggccgaggcaggcggatcgcttgagcccaggagtttgagaccagcctgggcaacatggccaaacctcatccctactaaaaatacaaaaaattagccaggcatggaggcgcatgtctgtagtcagtcccagctactcaggaggcgaaggtgggaggatcacttgagcttgggagttggaggctgcagtgagctgtgaacataccactgcactccagcctggaaaataaagcaagagatgctgcctctaaaaataataataataataataaaaattagccaaacatggtggcacgcatgtgtgatcacagctacttgggagactgaggtgggaggatcgctggagcccggaaagtcgaggctgcagtgagctgagattgcatcactgtcgtgcagcctgggcaaaagagtgagaccctgtctctaaataaataaataaatgagttcacgattaagcagaagttgtgcttgttctgccaggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaatgattgccttttcacattcaggctccaactggcttttagcttgtgcgttcttaccctggggtgttcgaggtcaccggactcctattttatttgtgtttaactggaaaggcaggaactctgagaacgtatcaaataggcagttactgcaggatttctagaatttaaattgcttccaaaactgtatccacaagctaagaattatgtttaggttttaaaaggtgttggtttgcttcttacatgtttaaattcttgagggaaagaaatgcaaagaataataaagtttcatgatacaaaaatggtatgagaccgggcacaatggctcacacctgtcatcccagcactttgggaggctgaggcaggaggatgatttttgagcctgagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacatactgagaccttgtctctagtaacaataaaaaaattagctggacataaggtgtgcatttgtagtcccagttacacaggaggctgaggtgggaggatcacttgagccagggagttggaggctgcagtgaaatgtgatcgcaccactgcactccagcctgtgcaacaaggagagagatgctgtctctaaaaaaaaaaaaaaagccagacgtggtggcacacgtgtgtggtcacagctacttgggaggctgaggctgaaggatcgcttgagcccaaggaggctgaggctgccataaactacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcagtttgcatgtactcgggaggatgagccctgccatggtgtgtgttaggggacagcctgatctcaccaaccctcctgagcaggcccagccctccgagtaataactgggaacactcgccgctttgtgagacgacctcgtgtgctcactggaaggtcatctcttctggtccatgctgcagtgtggataccattttttttttttaagacagtttcactcttgttgcccaggctggagtgcaatggcacgatctcggctcacagaaacctccgcctcctgggttcaagccattctcctgtctcagcctcctgagtagctgggattacaggtgtctgccaccacagccagctaatttttatatttttcgtagagacggggtttcagtacattggtaaagctggtctggaactcctgacctcaggtgatccacccgcctcagcctcccaaagtgctgggatgacaggcgtgagccaccgcgaccagcccagtgtggatacaccttgagcacataactggaatcctttccttggaaacttggagccccttgtgtcatggtcatataaactgttgaattaagaggagacaccattaaatatgtcacagctgtcctcgaaactgggacttgttttgctttctgcctggaaatgcgagctatctttatagaattattttatagaaaataattgtatacatatataggaggtacgacgtgatgttttaatccgagtacacattgtgcaatgattaaatcaagctggttaccatattattaacctaattaacatatcaataatcaagctaattaacacattaacattcaagctaattaacatattaacaagctaattaacatattcacataatcctaactctgacctatatcacctcacctacttttttttgtggtgagaatgtgtaaaatctacttttagtcattttgaaaaacgcaatgtattattattaatgataatcactgtgtggtgtggtagaactttgaatttatttcttctatctaactggaaaaatttaattttaatgtaatttattttttttgagacagtctcaccctatcacccaggctggagtgcagcatcatgttcatagctcatggcagcctccaactcctggctcaggtgaccctcccaccacagcctcccaggtagctgggactacaggtgcacaccaccacacctggttaattttttaagttttttgcagagatggggtcttgctatgttgctcaggctggtcttgaattcctgggctgaagcgatcctcctgcctcagcctcccaagtagctgggactgcaggtgcatgctaccatacccagctaatttttttttttttttttaaagatgcggtttcattatgttgcccaggcttgtctcaaactcttggcctccagtgatcctccttcctcagccttccatagcattgtgattccagacatgagccaccgctcctggcctccaactgaaattttatgttctttgacaaacacttcatgaagcattcttccctggcaaccaccattgcactctctgcgtttatgcgttcagcttttttagattctacatacgagatgatacagtatttgtctctctgtgcctggttcatttcacttcacattgtatcttccagtcccatccatgttgctgcaaatggcaggatttcctttttcatggctgcatactattccattgtgtgtctatgccacatttgcttgatacgctcatctgttgattgacacatgggttgattctatatcttggaaactgttagtagtgttggcagtgcacagggggtgcaggtatcccattgatgggctgatttcctttcctttgggcacacaccaagcggtgggatgactggatcctgcacaacattctttcctttggtgtttcgcaggcccgtttctggactttagtgaacgtcttcccagtgtccatggcgtccgtcccttggccacatgcttagggaacatcttcagtgtgtacatggcgacagtcccatagccacattcttagggaatgtcttcagtgtgtacacggtggcagtccctttgctgcatgcttagggaacgtctacagtgtggtccattggccacattcttagagaacgtcttcagtgtgtacactgtggcggtcccttggccacattcttagggaatgtcttcagtgtgtacatggcggcagtcccttagccacatgcttagcgaacatcttcagtgtgcacagggcagtggtcccttgggccacatgcttagggaacgtcttaagtgccgtcccttggccgttttcttagggaatgtcttcagtgtgcacatgtggcggtcccctggtcgcattcttacggaatgtcttcagtgcgtacacggtggtcccgtagccacatgcttagggaatgtcttcagtgtgcacagggccatattcttacggaatgtcgtcagtgtgcacatggtggtggtcccttggccacattcttagggaatgtcttcagtgtgtacgtggcggaggtcccttagccacaagcttagggatcatcttcagtgtgcacagtgcgggagtcccttgggccacatgcttagggaatgtcttcagtgtgtacatggtggtggtcccttagccacatgcttagggatcatcttcagtgtgcacagggtgggagtcccttgggccacatgcttagggaacgtcttcagtgtgtacagggcagcagtcctttggctgcattgttagcgaacatcttcagtatgtacatggctgtggtcccttagccacaagcttagggaacatcttcagtgtgcacacggtggtggtcccttgggctacatgcttagggaatgacttcagtgtgtacatggtggccatcccttggccccatgcctagggaatgtcttcagtgccttgccttggctgcattcttagggaacgtcttcagtgcgtacatggcggtggtcccttagccacatacttagggaacgtcttcagtgtgtacaccgtggtggtcccttggccacattcttagggagcgtcttcacttcttacatggtggtggtccccgggccacattctaagggaacgtcgtcagtgcctacacaatggtggtcccttggccgcacgcttggggaacgtcttcagtcacagccctggttggtcccttggccacattcttagggaatatcttcagtgcatacacggtggcagtcccctggtgtcattcttagggaacgtcttcagtgcggtccctcaaccacatgcttagggaatgtcttcagtgctgtttcttagccatattcttagggaacctcttcaatgtgtacacactggtggtcccttggccgcatgcttagagaacatctttagtgcagtcccttggccacattcttagggaacgtcttcagtgtgatcccttggccacattcttagaaaacgtcttcagtttgtacaaggtgacagtccattggccagaatgtgtccctgccacattcttctgagtgtctgtgtctgtgttctttccaccctgtaagctgcttttgcttcttcactgggtgtctgtgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgtttgataccaagaaatggtctgaatcacagccaaggcttcatttgctttctggaactgcagctccccagccccacccagatcagagattcagaacctgaatcttcggatttctggagatgcccccatcctatcagagacttctagtgtgtttctttatatccgtgtagacttgggaggatgacaggagagaaaccttagaaggtggtctgtgcatttcccgggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgctcggctaattttatatttttagtagagatgggtgttcttcatgttggtcatgttggtctcgaactcctgacctcaggtgatccatccgcctcggcctcccaaagtgttgagatgacaggtgtgagcccccgcgcctggccgcacctttctttcttgatccacctggttttaaactcacagataaactgtttccacctgtgacaaatgagtcatccaccttccatgtggtctggactttgtccctgttacaatattcctgtctcttgtttctggttttttgcatcccacatgttgtccctgtaacagtcctgtctgttgtttctggggtcacccgtgtggcgagctgactgtgccacgttcctgaggctggtgaggatgctgtgggcaccttaatcacggctgtgaacaaactggctagagctaggtgccatggagctttgcagtggacactaagtcgtggtacccattctttgatcagtgacggagccaggtgtcttattaggtcttggggatttgtggaagcccagagcagggaaacagcttctacattgaaaggaatccttctcacactcatgttggcatcgtgaagtccctgatttcctaagacactaccctaatattttaaaagacttacaaaaaatttagtaaaatattcctaatagcagcacatgtggtgtttttttgtttgtttgtttgttttcgagatggagttttgctactgttgccaaggctggagtgcagtggtatgatctcggctcactgcagcctccgtctcccaggttcaagggattctcctgcctcagcctctcaagtagctgggattacaggcatgcactaccacacccggctaattttgtatttttagtagagacgggtttttccatgttggccaggctggtcttgaactcccgacctcaggtaatccgcctgctttggcctcccaaaatgctgggattacaggtgtgagtctccacacctggtcaatcccattctttttcaagaatgcatagtattctgtggtgtatgtacaccaccttttctttatccagtctacgtggcgttgttttgaggaatggatgaaatgatttgcataaaaacagtgaatgctttctattggaatggtgtttgcctcctgggaaactgtggagtcattgcaattgcaatttcctagtagatttgattaattaagagcattgggaatttttggggtgcctgatgcactattacagatatttttttcacagtgtagatatctcagcatgaatatgtctgttttcttttcttttctttcttttttttttttttgagatggagtttctctcttgttgccaaggctggagtgcaatggctcaatcttggctcactgcagccaacatctcctgggcttaagcagttctcctgcgttagcctctggagtagctgggattacaggcatctgccaccatgcctggctaatttttttttgtgtgtgtgtttttagtagagacagggtttcaccatgttggcctggccggtctcaaactcctggcctcaagtgatccacctgccttggactccgaaagtgctgggatgacaggcctgagccatggcggccagctgtctgttttctttccataagaggtgctggtctcaccgtggctctgtgctgtgatgaaatggcattgtccaagttttactcctcacagcctgattttgtatgttaaagacgtcttccttggtgtgaatcaagtgggctgggcagagttaagggagccatttatttagaaggcgattagatcgaattatgtcttggtaattactgcagttacaccaccccattctttccgtggctctcctagctgggtttgtggctagtcatggaggtgccctgaagagcctcattttcccacagctgtaggaagtgtgtggtacacccacaatgtcttagcttttgtattagggaaggtcttcagtgcattcccttggccacattcttagggaacatcttcagtgtgtacatggcggcggtcccttaaccacattcttagggaacgtgttcagtgtgtacacggtggcagtcccttggctgtatgcttagggaacgtcttcagtgagtgtgatcccttggccacatgcctagggaacatcttcattgtgtacctggcggcggtcccttagccacatgcttagggaatgtcttcagtgtgtacacggtggcagtctgttggccccatggttagggaacatcttcagtgtgcacagggcggcggtcccttgtgccacatgcttagggactgtcttcagtgtgtacatggtggcggtcccttggtcgcattcttagggaacctcttcagtgtgtacatgtcggcattcccttagccgcatgcttagggaacgtcttcattgtgttcttggtggcagtcccttagccacatgcttagggaacgtcttcagttgtatacagtggggtcccttggtcattatgcctaggggaacgtcttcagtgccagctgcattcttagggaatgtcttcagtgtgcacatggcggaggtcccttagccacatacttagggagtgtcttcactgcacacagcagtggtcccttggttgcattcttagggaacatcttcagtgtgcacatggtagcagtccctcacccacattcctagggaatgtcttcagtgtatacatggtggcagttctttggctgcatgcttagggaacatcttcagtgcattcccttggccacatgcctagggaacatctttagtgctgtcccttccctgcatttttagggaacgtcttcagtgtgtacatggtggcggtcccttggccgcattcttagggaacgtcttaagtgtgtacatggcggcggtcccttagccacaagcttagggaacgtcttcagtgtgtatatggtggcagtctcttggccacatgcttagggaacgtcttcagtgccatcttttagctgcattcttagggaacgtcttcagtgtgtacatggcagaggtcccttagccacacacttagggaacatcttcagtgtgtgcacagcagtggtcccttggcctcattgttagggaacgtctttggtgtgtagatggccgccgtcccttagccacaagcttagggatcgtcttcagtatgcacagcgtggcagtcccttgggccacatgcttaaggaatggcttcagtgtgtacaccgttgtggtcccttggccacattcttagggagcgtcttcagtgccgtcttttggctgcattcttagggaatgtcttcagtgcgtacatgggggcggtcccttagccacatacttagggaacgtcttcagtgtgtacatggcagtggtcccttggccccattcttagggaacatcttcagtgtgtacatggtggcagtcccttaatcacatgcttagggattgtcttgattgtgtacatggcgatggtcccttggccacatgctttgggaacctcttcagtgcatacggagtggcagtcccttgtccacattcttagaaaacgtcttcagttcgtacacggtggcgatcccttggccacattcttctgagtgtctgtgtctgtgtcctttccaccctgtaagctgcttttgtttcttcattgggtgtctctgactctcatgtggaatccctttcctctgtcaccgcccatcccaggcacagtgagagacgcagccagcctgctcctctctgcacctcgccatcccagacatcctccagccaccgtgctgaccgcattcattccttctcctgccctgtccgcatccttcttcccctacacgcttgataccaagaaatggtctgaatcacagccaaggcttcattatctttctggcactgcagctccccagccccacccagatcagagattcagaacctgaatctttggatttctggagatgcccccatcctatcagagacttctagtgtgtttctctatattcgtgtagacttgggaggatgacaggagagaaaccttagaaggtggtctgtgcatttccggggcccggggtggaaggggcttgtgtcctggctgcctctgtgcacctttcattcttttttttttttttgagacggagtcttgctctgtcaccctgtcacccaggctggagtgcagtggagggatctcggctcactgtaacccctgcctcccaggttcgagcaattctcctgcctcagtctcctgagtagctgggaatacaggcatgtgccaccacgcccggctaattttatatttttagtagagatgggttttcttcatgttggtcatgctggtctcgaactcctgacttcaggtgatccatccgcctcggcctcccaaaatgttaggatgacaggcgtgagcccccgcgcctggcggcgcctttcattcttgatccacctggtttcaaactcgcagataaactgtttccacctgtgacaaatgagtcatccaccttccgtgtggtctggactttgtccctgttacaatattcctgtctcttgtttctggtttttggcgtcccacgtgttgtccctgtaacagtcctgtctcttgtttctggggtcacccctgtggcgagctgactgtgccacgttcctgaggctggtgaggatgctgtgggcaccttaatcacggctgtgaacaaactggctagagctaggtgccatggagctttgcagtggacagtaagttgtggtacccattctttgatcagtgacggagccaggtgccttattaagtctcggggatttctggaagcacagagcaggcaagcaccttctacactgaaaggaatccttctcacactcatgttggcaacgtgaagtcctgcctttggaaatccctgatttcctaagacactaccctaacattttaaaggacttaaaaaaaattcagtaaaatattcccaatagcagcacatgtagtgttttatttatttatttatttttgagatgatttgcactcttgtcgcccaggctggagtgcaatggtatgatctgggttcactgcaacctccgtctcccgggttccaaggattctcccatctcagcctgtaaggtagctgagattataggcatgcgccaccatgctcggctgattttgtatttttagtagtgacagggtttcaccatattggtcagggtggtctcgaactcctggcctcaagtgatccacccatcttggcctcccaaagtgctgggattatgaatcactgctcctggcctactttttaaactttcaggttcaggggcacgtgtgcaggttcattacacgggtaaattgcatgtcctgggggtttagtgtacagattaattcatcaaccaggtagtaagcctactaccatctgataggtagttttttgatcctctcatttgtcccaccctccaccctccagcaggcccctgcagctgttcccttctttatatccaccagtgcccaatgtttagctgtcacttatcagtgggaacaggtggtatttggttttctgttcctgtgtaagtttgctaaggataatggcctccacctccgtgcatgttcctgcaaaggacatcatcccattttttttttttttttgagacagtttcctttttgttgcccaggctggagtgcaatggtgtgatctcggctcaccgctaccaccagctcccgggttcaagcagttgtcctgcctcagccttctgagtaactgagattacagacacatgccaccacgcccggctaattttgtatttttagtagagacggggtttctccatgttgcccaggctggttttgaactcctgacctcagttaatctgccctccacggcctcccaaagtgctgagattataggtgtgagccaccacacccaaccaatcccattctttttcatgggtatgtagtattccatagtgtatatgcaccaccctttgtttatccagtttacatggcgttgttttgagaaatggatgaagcgatgtgcatgaaaacactgaatgcttcctactggaggggtgttcacctttccgggaaactgtggagtgattgcaattgcaatttcctagtagatttgattggttaatagcattgggaatctttggggtgcctgatgccctattgcagatcttttttcacagtgtagaaatctcaacgtaaatgtctttttttttttttgagatggagttttgctcttgttgcccaggctgcagtgcaatggctcaatctcggctcactgcagccaacatctcccgggtttgagcaattctgcctcagtctcctgagtagctgggattgcaggtgcctgccaccacacccggctaatttttgaatttttagtagagaaggggtttcagcctattgttcaggctgctctcgaactcgtgacctcaggtgatccacccacctcggcctcccaaagcgctgggatgacaggcgtgaccgcgcccagcccagtgtggatacaccttgagcacataactggaatcctttccttggcaacttggagccccttgggtcatggtcatataaagggtgttgaattaagaggaaacactgttaaatatgtcacagctgtccttgaaactgggacttgttttgttttctgcctggaaatgcgagtcatttttctggaaaattcatttttcgttaaaaaaagtaattgtatacacgtatatgaggtacaacgtgatgttttaatccacgtacacatcatgcaatgattaaatcaagctagttaccatattaacaatcacattaactaacatattaataatcaggctaattaacatattaacattgaagctaattaacatattaacaatcaagctaatttacatattcacataattctaactctaacctatatcacctcacctacttttttttgtagtgagaatatgtaaaatctacttttagtcattttgaaagacgtgatgtattattaactatcatcactgtgtggtgtgatagaacttggaattcatttgttttatctaactgaaaaaaattaattttaatgtaatttatatgttttttgagacagtctcatcctatagccaggctggagtacagcatcatgttcatagctctcagcagcctccaactcatggctcaggtgaccctcccacctcagcctcccaggtagctgggactacaggtgcacaccaccacacctggttaatttttaaattttttgtagagatggggtcttgctatgttgctcaggctggtcttgaattcctgggctaaagcgatcctcctgcctcagcctcccaagtagctgggactacaggtgcatgccaccatatccagttaattttttcagttttttttttatttgtttagagatagggtttcattacgttacccaggcttgtctcaaactcctggcctccagtgatcctccttcctcagccttccatagcacagtgattccagacatgagccacagcgctcctggcctccaactgaaatgttatgttctttgacaaacacttcagcattcttccctggcaaccaccattgcactctctgcgtttatgcgttcagcttttttagattctacatacgagatgatacagtatttgtctctctgtgcctggttcatttcacttcacattgtatcttccagtcccatccatgttgcgcaaatggcaggatttcctttttcatggctgcatactattccactgtgtgtctatgccacatttgcttgatgtactcatctgttgattgacacatgggttgattgtatatcttggaacctgagtagtgctgcagggcacaggggatgcaggtatcccattgatgggctgatttcctttcctttgggtacacacccagtggtgggatgtctggatcctgcacaccattctttcctctgatgttttgcaggcctatggctggacctttggaacgtcttcactatgtacaaggtggcggtcccttggccacattcttagggaacgttttcagtgtgtacatggtgtcggtcccttggctatatgcttagggaacatcttcagtgggtacatggtggcggtcccttagtcatattcttagtgaatgtcttccgtgtgtacacggtggcagtcccttggctgcatccttaggcaacgtcatcagtgcagtcccttggccacatgcttagggaacgtcttcagtgcatacacggtggcggtcccttggccacattcttagggaatgtcttcagtgtgtacatggtcgcagtctgttagccacatgcttagggagcgtcttcagtgtgtatagggtggcggtcccttggccacatgcctagggagtgtcttcagtgccgtcgcttggctgcattctttgggaacgtcttcaatgtatacatggcggcggtcccttggctgcatttttagggaacgtcttcagtgtgtacatggcggcggtcccttatccacattcttagggaatgtcttcagcgtgtacacggtggcagtcccttggccgcatgcttaggggacttcttcagtgcggtcccttggccacatgcctagggaacgagtcttcagtgccgtcccttggctgcattcttagggaacgtcttcggtgtgtacatggtggtggtcccttgggcgcattgttagggaacgtcttcagtgtgtacatggcagtggtcccttagccacatgcttcggaatgccttcagtgtgtacatggcggaggcccctcagccacgtgcctagggaatgtcttcagtgctgtcttttagcggcattcttagggaacgtcttcagtgtgtacatggtggtggtccctgagccacatacttagggaacgtcttcagtgtgcaacggcagcggtcacttggccttattgctagggaacttcttcagtgtgtacatggcggtggtcccttagccacaagcttagggaacgtcttcagtgtgtacatggcagcagtcctttggaccacatgcttagggaatgtcttcagtgtgtacacggtggtggtcccttggccccatccctagggaaagtcttcagtgccgtcctttggctgcattctttgggagcgtcttcagtgtgtacatggtggaggtcccttggccacattcttagggaatgtcttcagtgtgtacatggcggcggtcccttggccgcatacttagggaacgtcttcagtgtgtacatggcagtagtcccgtggccgcattcttagggaacctcttcagtgcatacacagtggcggtcccttggccacattcttctgagtgtccgtgtctgtgtacttttcatcctgtaaactgcttttgtttcttcattgggtgtctctgactcttatgtggtatccgtttcctctgtcagcgaccatcccaggcacagtgagagacgcagccagcctgctcctctctgcaagtggccatctcagacattctccagccagcgtcctgaccgcattcattccttcccctgcccggtccacatccttcttcccctacacccttgctaccaagaaatggtctgaatcacatcacaggcttcctttgctttctggaactgcagctccccagcccacccagatcagaggttcagaacctgaatcttcggatttctggagatgcccccatcgcatcagagacttctagtgtgattctttatattcgtgtagacttgggaggatgacaggagagaaaccttagaaggtggcctgtgcagttccagggcccagggtggaaggggcttccatccctggctgcatttgtgcacctttcattcttggtccaacattttttttttttttttttgagacggagttttactgtgtcgcccaggctggagtgcagtggtgtgatctcagctccctgcaacctccccgcctcctgggttcaagcgattctcctgagtggctgggagtacgggcatgcaccaccatgcctggctaattttatatttttagtagagatgaggtttctccatgttggtcaggctggtctcaaacccctgacctcaggtgatccatccaccttggcctcccaaagtgctgggattacaggtgtgagccaccacgtccggctgcactttttattcttgatccacctggtttgcaactcacagataaactgtttccacctatgacacatgagtcttccaccttccatgtcctctggactttgtccctgttataatattcctgtctcttgttctggtttttggcatctcacacattgtccctgtttcagtccggtctcctgtttctggtgtttggtgtgccgcacgttgtccctgttacagtcctgtctcttgtttctggggtcacccgtgtggagagctgactgtgccgcgttcctgaggctggtgaggatgctgtgggcaccttaatcacggctgtgaacaaactgactagagctaactgccacggagctttgcagtggacgctaagctgttgtactcattgtttgatcagtgacggagccagatgtcttattaggtctcggggatttgtggaagcctagagcaggcatgcaccttctacgtagaaaggaatccttctcacactcaagttggcgtcgtgaagtcctgcctttggaaatccctgatttcctaagacactaccctaacattttaaagggcttaaaaaatttcaataaaatgttcccagtagctgttacatgtagtcatgtagcgtttttttttttttttttgagatggacttttgctcttgtctcccaggctggagtgcaatggcgcgatctcggctcactgcaatctctgtctcccgcattcaagggattctcccacctcagcctgtcaggtagctaggattataggtgtgcgctaccatgccctgctacttttgtatttttagtagtgacagggtttcagcatgttgatcagggtagtctggaactccttgcctcaggtgatccacccgccttggcctcccaaagggctgggattatgaatcaccgcccccagcctacttttttcactttgatttcaggttgagggggacgtgcgcaggtaaattgcatgtcttgggggcttagtgaacagattatttcatcatgcaggtaataagtccagtaccacctgataggtagtttttcgatcctctcatttctcccaccctccaccctccagcatgcccctgcagctgttcccttctttgtatccatgagtacccaatgtttagctgccgtttatgagtgagaacaggtgatatttggttttcttttcctacgtgagtttgctaaggataatggcctccacctccatgcatgttcctgcaaagggcatcatcccatgttttctttttttctttttcttttgagactgggtttccttcttgttgcccaggctggagtgcagtggtgtgatctcagctcaccacaacctcctgttcctgggttcaagtgattctcctgcctcaggctactgagtcgttgagattacaggcgcataccaccacgctgggctaattttgtatttttagtagagacggggcttctccatgttggccagtctggtcttgagctaccgacctcaggtaatctgcctgcctcggcctcccaaagtgctgggattacaggcatgcgccgccacgcccaaccaatcccattctttttcatgggtccatagtattccatagtgtatatgctccaccctttctttatccagtctacatggcgtcctgttgaggaatggatgtaacaggcgtcgtgttcaggaatggatgtaacaatgtgcataaaagcagtgaatgttttctattggaatggcgtttgcctttctgggaaactgtggagtcattcgaattgcaatttcctggtagatttgattagctaagagcattgggaatttttggggtgcgtgatgccctgttgcagatattttttcacagtgtagaaatctcagcatgaatatgtctgttttcttttctctttttttttttttttttgcgatggagttttgctcttgttgcccaggctagagtgcaatggctgaatctgggctcactgcagccatcatctcctgggttcaagcaattctcctgcctcagcctctggagtagctgggattgtaagtgcctgcccctacaccctgatttttctttttttttgtatttttagtagagacggggtttcacctgttgggcaggctggtttcgaactcctggcctcaagtgatccacctgcctcagcctcccaaagtgctcggatgacaggtgtcagccacggtgcctggccgtctgttttcttttcataagaggtgctggactcacagtggctctgtgctgtgatgaaatgacattgccaaagttttactcctcacagcttgattttgtatgctaaacaggtcttctttggcgtgattgaggagggatggggagacttaagggagccatgtatttagaaagcgattagatcctgttatgtcttggtaattactgcagttacaacacgccattctttccgtggctcacctagctgggttcgtggctagtcatggaggcgccctgaagagcctcattttcccacagctgtaggaagtgtgtggtacacccacaatgtcttagcttttgtattagggaacgtcttcagtttgttcccttggccacatgctttgggaatgtcttcagtgtgtacacggtggctgtccctgggccgcatgcttagggaacgtcttcagtgaggtcccttggccatatgcctagggaacgtcttcggtgccatcctgtgactgcattcttagggaacgtcttcagtgtgtacatggcgggggtcccttagccccattcttagggaatgtcttaagtatttacacagtggcagtctgttggcctatggttagggaacatcttcattgtgcacatggtatcagtcccttgcgccacatgcttagggaattcttcagtgtgtacatggtggccgttccttggctgcattgttacagaacgtcttcagtgtgtacatgtcagcggtcccttagccgtaagcttagggaacgtcttcagtgtgtataaggtggcggtcccttggccacatgcctagggaacgtcttcagtgccctcccttggctgcattcttagggaacgtcttcagtgtgtacatggctgccttcccttagccacatacttagggaacatcttcagtgtgcacacggcagctgtcccctggacgcattcttagggagcgtcttcagtgcgaacatggcgggggtcccttacccacattcttagggaacatcttcagtgtgcacacggcagcagtcccctggacgcattcttagggagcgtcttcagtgcgaacatggcggcggtcccttacccacattcttagggaacatcttcagtgtgtatatggtagcagtcccttagccacacacttagggaacgtcttcagtgtgtgcacatcagcggcccttggccggattgctagggaacctcttcagtgtgtacatggcagcggtcccttaacccaagcttagggatcgtcttcaatgtgcaaagggcaatggtcccttgggccacgtgcttagggaatgtcttaagtgtgtacacggcggtcccttagccacatgcctaggaaacgtctgccatctcttcgctgcattcttagggagcgtcttcagtgcgtacatggcggccgtcccttagccacgtacttagggaacatcttcagtgtgtacatggcggtggtcccttagccacatacttagggaacgtctccagtgtgtacaggtggccgtctcttagccatattcttagcgaatgtcttcagtgtgtacacagcagtggtcctttggccacatgctttccgaacgtcttcagtgcatacagtggcagtcccttggacccattcttagaaaacgtcttcagttcgtactcggtggcgatcccttggccacattcttctgcgtgtctgtgtctgtgtccttttcaccctgtaagctgcttttttttcttcattgggtgtctctgactctcatgtggaatccctttcctctgtcaccgcctgtcccaggcacagtgagagacgcagccagcctgctcctctctgcacgtcaccatcccagacattctccagccagcgtcctgaccgcattcattccttctctttcccttgtccacatccttcttcccctacacgcttgataccaagaaatggtctgaatcacagccaaggcttcctttgctttctggaattgcagctccccacccccacccagatcagaggttgagaacctgaatcttcggatttctggagatgcccccatcgcatcagagacctctagtgtgtttctttatatccgtgtagacttgggaggatgacaggagagcaaccttagaaggtggcctgtgcagttccagagcccagggtggaaggggcttccattcatcactgccttcgtgcacctttcattcttgatccaaccgttgttgttgttgttttgagacggagtcttgctgtgtcgcccaggccggagtgcagtggtgtgatctcaggtcactgcaacctccgcctcccatgttcaagcgattctcctgccacagcctctctgagtagggagctgctaaaataaaataccttcagttgggtaatttataaactagagacatttatcactcacagttctgaaggctggaggttcaagatcatggcagattcagtgtgtggtggggatgcactccctggttcatagacgacgcattttctctgcctgctcacatggtggaaagggcgagggagctctctggggctccttttataaggacagtgatcctattcatgaggcttgatccccatgaagtcatcacctcccaagtctcccacctcctgacaccattgtcttaggggtgaggatttcaatgcaggaatttgggggaggaacacaaactttcagattgtagcaaataccattctttaaaaaaatgcagtaatagttaagctttttttttttaatttgataaattttccaagaaggaggagacacagaaaccctccgtgttttgaaggttaatattagtgctgtaaaatacacgtgggacttgggcttataaaaaattcctggtcatggcaaaatataggtggtttgcagtacctggggaagcccacctttcctgtttctgacatgtaacttttgtggaaattgcctgaaagttgtttctagttacccttcagtcctgtgtccaacccagcatgtccgatactatctaacattgttttttttttgagatggagttttgctcttgttgcccaggctgcagtacagtggcacgatcttggctcgctgcaacctccacctcccaggttcaagcgattctcctgtctcagcctcctgagtagctgggattactaaattttatataaatgttgtgtcaagaaatattattgctcttttgcctttttttcccttaaccgttgagaaattcagaaaaaaacatttatgaacgtcaacactgtttttgacaagtaaacattgttcttggcaagtgggccttccaaaaataagggctggcgtttgtggaaactgctctactgttctttttttttcttgctacttttttctttttttttttttttgaggcactaattggaatccacttattcgtcctgggtggagaaagagttcagatctaacactgggggctctgtgtttccttaggtaatacatatgaagtttttgtcactgtaattcagtaatctgtgttaatattatcacaaaagagcagagtggcatttgtgtcttctcagaattgcttattaaaacagctgcatggccagccgcggtggctctcatgcctgtgatcccagcactttgggaggccgaggccggtggatcgcttgagcccaggagtttgagaccagcctgggtaacatggccaaacctcatctctactaaaaatacaaaaagtgagagcgtgcctgtagtcccagctactgaggaggcagaggtgggaggatcacttgagcgtgggagttggaggctgcagtgagctgtgatcacagcctgggaaaccaagcgagagatgctgtgtctaaaattataaaaataaaaattagccaaacatggtgccacgcgtgtgtggtcacagctacctgggtggctgaggtgggaggatcactggagcccacaaagtcgaggctgcagtgagctgagattgcatcactgtcgtgcagcctgggcaccagagtgagagacaccctgtctctaaataaataaataagttcatgattaagcagaagttgtgcttgttctgccgggatttcagttgggttctttgtgccctaatttacgtgagctagtaggttgtgcgttatcttagagggcttgcatgaaagaaagagggtagcctttcttttccctgttttggtagcattgctgaggtggcttttggctgacgggtggacccgtgggtgcagatgttttgatgcagaaggaacgattgccttttcacattcaggctccaactggcttttagcttgtgcgttcttaccctggggtgttcgaggtcaccggactcctattttatttgtgtttaactggaaaggcaggaactctgagaacgtatcaaatagccagtttactgcaggctttctagaatttaaatcgcttccaaaactggatccacaagctaggaattatgtttaagttttaaaaggtgttggtttgcttcttacatgtctaaattcttgggggaaaaactgcaaagaataataaagtttcatgattcaaaaatggtatgaggccgggcacaatggctcacacctgtcatcccagcactttgggaggctgaggcaggaggatgatttttgagaccaggagtttgagatcagcctgggcaaacagcgagatcctgtgcctacaaaaataaaataaaaataggctgggtgtggtggctcatgcttgtaatacctgcactttgggaggctaagtcagtaggatcacttgaactcaggggtttgagaccagcctggtcaacataatgagaccttgtctctagtaacaataaaaaaattagctggacataaggtgtgcatttgtagtcccagttacacaggaggctgaggtgggaggatcacttgagcctgggagttggaggctgctgtgaaacgtgatcgcaccactgcactccagcctgtgcaacaaggagagagatgctgtctctaaaaaaaaaaaaaaaagccagacgtggtggcacacgtgtgtggtcacagctacttgggaggctgaggctgaaggatcgcttgagcccaaggaggctgaggctgccataagctacgatcatgccactgcactccaggctgggcaatagcctgggcgactgtctcaaccaaaataaatttaaaaagataggaaatttcaatgtgaaaatcagtgtcccccagaacgttccatttcttcccagctgggctatttttggagttccatggggagccggctcagtgcaccttgcatgtactcaggaggatgagccctgccatggtgtgtgttaggggacagcctgatctcaccaaccctcctgagcaggcccggccctccgagtaataactgggaacactcgccgctttgtgagaggacctcgtgtgctcactggaaggtcatctcttctggtccacgctgcagtgtggatactttttttgtttgtttgtttgtttgagaaggattattgctctttttgcccaggctggagtgcaatggcatgatctcggctcactgcaacctccacctcctgggttcaagccattcttctgtctcaacctcctgagtagctgggattacagtcgcccgccaccacacccggctaatttttgtatttttagtagagacagggtttcagcatattggccttgctgttctcaaactcctgacctcaggtgatccacctgcctcagcctcccaaagtgctgggatgacaggcgtgagccaccgcgcccggcccagtgtagatacaccttgagcacataactggaatcctttccttgacaacttggagccccttggaacatagtcatataaactgtattgaattaagaggagacaccgttaaatatgtcatagctgtcctcaaaactgggtcttgttttgctttctgcctggaaatgggagtcacttttatagaaaatttattgttcgttaacaaaaaataattgtgtgtgtgtgtatatatatattgtatgtgtgtgtatatatatatatatatatatatatatatacacacagacacacattctctctctctctctctctatggtacaatatgatgttttaatccaagtacacattgtgcagtgattaaaccaagctagttaccatattagcaatgaagctaattaacattaataattaagtgaattaacatattaaccattgacctaattaacatattaacaatcaagctaattaacatattaacaagctaatttacatattcagataaccctaactctaacctatatcacctcacttcgtttttttggtgatgagaatatgtaaaatctagttttagtcattttgaaagatgcaatgtattattattaactataatcactgtgtggtatgatagaactttgaatttatttcttttatgtaactgaaaaaatttaattttaatgtaatttatgtttttgagacagtctcaccctctatcacccaggctggagtgcagcgtcatgttcatagctcatggcagcctccaactcctggcacaggtgaccctcccacctgagcctcccaggtagctgggactacaggtgcacaccaccacacctggttaatttttaaagttttgtagagatggggtcttgctatgttgctcaggctggtcttgaattcctgggcagaagtgatccttctgcctcagcctcccaagtagctgggactgcaggtgcatgccaccatatctagctaattttttcatttttttttatttttagagatggggtttcattatgttgcccaggcttctctcaaactcctggccttctgtgatcctccttcctcagccttccatagcattgtgattccagacatgagccaccgctcctggcctccaactgaaatgttatgttctttgccaaacacttcatgaagcattcttccctggcaaccaccattgcactctctgcgtttatgcgttcagcttttttagattctacctatgagatgatacgatatttgtctctctgtgcctggttcatttcacttcacattgtatctttcagtcccacccatgttgctgcaaatggtaggatttcctttttcatggctgcataccattccattgtgtgtctatgccacattcgcttgatgcacttatctgttgattgaacatgggttgattctatatcttggaaactattagtagtgctgcagtgcacagggggtgcaggtatgccattgatgggcagatttcctttcctttgggtacacaccgagcggtgggatgactggatcctgcacaacattctttgctctgatgttttgcaggccaatggctggaccttagggaacgtcttcactttgtacaaggtgggggtcccttggccacattcttagggaacgtctgcagtgtgtacacgatgttggtctcttgaccacatgcttaggaaacatcttcagtgtgtagctggcagcagtcccttagccacattcttcccgaatgtcttcagtgtgtacacggtggcagtccctagtcctaattcttcgggaatgtctttagtgtgtacatggcggcagtcccttggccgcattcttagggaacgtcttcagtgtgcacactgcggtggtcccttagccacaagcttagggaatgtcttcagtttgtacttggtggcggtcccttggctacatgcttacggaacatattccctgccgtctcttggctgctttcttagggaacgtcttcagtgtgtacatggtggtggtcccttagccacaagcttagggaacgtcttcagtgtgcacaccgtggctgtcccttgggccacatgcttagggaacgtcttcagtgtgtacatggtggcagtcccttggccacattcttagggaacgtcttcagtgtgtacagggcggcagtcctttaaccacatgcttaggggaaccatcttcagcatgtccacggtggcggttcttttgcggcattcttaggggatgtcttcagtgtgtacatggcggctgtcccttagccacaggcttagggaacgtcttcagtgtttacatggtggcggtcccttggccacatgcctagggaatgtcttgagtgctgtcccttggctgcatcttagggaatgtcttcagtgtgtaaatggtagcagtcccttagccacatgcttagggaacgtcttcagtgtgcacacagcagaggtcccttgcgccacatacttagggaacgtcttcagtgtgtacatggtggtggtcccttggccacatccttagggaacatcttcagtttctacacagtggccatcccgctgccacattcttagggaacgtcttcagtgcctacatggtggtggtcccttggccacattcttagggatcatcttcagtgtggacccttggccacattcttagaaaacgtcttcagttcatacatggggacgatcccttggccactttcttctgagtgtctgtgtcatttgctccctgtaagctgcttttatttcttcattgggtgtctctatcatgtggaatcccactcatctgtcaccacccatcccaggcacagtgagagacacagccagcctgctcctctctgcacgtggccatctcagacattctccagccactgtcctgaccccattcattccttctcctgcacggtccacatccttctttccctacacccttgctaccaagaaatggtctgaatcacagccaaagtttcatttgctttctggaacagcagctccccagccgcactcagatcagagattcagaacctgaatcttcggatttctggagatgcccccatcccatcagagacttctagtgtgtttctttatattcgtgtagacttgggaggatgacaggagagaaaccttagaaggtggcctgtgcagttccagggcccagggtggaaggggcttgcatccctggctgcctttgtgcacctttcattcttcatccagctgttttttttttttttttttgaagaggagtcttgctgtgtcccccaggctggagtgcagtgctgtgatgtcagctcactgcaacctccgcctcctgtgttcaagccattctcctgccacagcctcccgagtagctgggattacaggcacctgccaccacacatggctaatctttgtatttttagtagagatggggtttcatcatgttggccaggctggtcttgaactcctgacctcaggtgatccacctgcctcagcctcccaaagttctgggataacaggcatgagccactgcgcccggccgcacccttcattcttgattcacctggttacaaactcgcagataaactgtttctacctgtgacaaatgagtcatccatcttccatgtggtgtcgactttgtccctgttataatattcctgtctcttgttctggtttttggcgtcccgcacattgtccctgttacagtcgtgtctcttgtttctggggtcacccctgtggtgagttgactgtgccctgttcctgaggctggtgaggatgctgtggacaccttaatcacggctgtgaacaaactggctaaagctaggcaccatggagctttgcagtggatgctaagtcgtggtacccattctttgatcagtgacggagccaggtgtcttattaagtctcggggatttgtggaagcccagagcaggcatgcaccttctacattgaaaggaatccttttgacactcaacgttggtgtcgtgaagtcctgcctctggaaatccctgatttcctaagacactaatctaacattttaaaagagttaaaaaaaaatcagtaaaatgttccccatagaagcatgcagtgttttgtgtgtgctttttattgttttttttttttttttttttgagacgaagttttgttcttgtcgccaaggctggagtgcagtagcacaatctcggctcactgcaacctccgtctccagggttcacgggattctcccgcatcagcctgtcacgtagctgggattataggtgtgtgccaccatgcccgactaattttgtatttttagtagtgacagggtttcatcatgttggtcagggtggtctcgaactcctggcctcaagtgatccacccgccttgccctcccaaagtgctgggattaggaatcactgctcccggcctacttgtttttacttttatttcaggttgaggggcacatgcgcaggttcgttacacgggtaaattgcatgtcctgggggtttagtgtagagattatttcatcaaccaggtaataagcctactaccacctgataggtaatttttcaatcctctcgtttgtcccaccctccaccttccagcaggccccggagtctgatcccttctttatatccacgggtacccaatgcttacctaccacttatcagtgagaacaggaggtattttgtcttctgttgctgtgtaagtttgctaaggataatggcctccacctccatgcaggttcctgcaaaggacatcatcccgtttttttttttttgagatggggtttccctcttgttgcccaggctggagttcaattgtgtgatcttgactcaccgcaacctctggctcccgggttccagtgattctcctgccttagccttctgagtagctgagattacaggtgcatgccaccacgcccagctaattttgtgtttttagtagagacagggtttctccatgttggacaggctggtcttgaactccggacctcaggtaatccacccgcctcggcctcccaaatttctgagattacaggcgtgagccaccacgcccaaccaatcccattctttttcatgggtgcatagtattccatagtgtatatgctcccacctttctttatccagtctacatgacgtcgttttgaggtatggatgaaatgatttgcataaaaacagtgaatgctttctattagaatggtgttggcctttctgggaaaccgtggagtcattccaattgcaatttcctagtagatttgattggttaatagaattgggaatttttggggtgcctgatgcacactattggagatcttttttcacagtgtagaaatctcaacatgaatatgtctttttttttttttgagacggagtttctctcttgttgcccaggccggagtgcaatagctcaatctcggctcactgcagccaacatctcccgggttgaagcaattctcctgcctcagcctcctgagtagctgggattacaggtgcctgccaccacacctggctaatttttgtatttttagtagacacagcgtttcagcatattggtcaggctggtctggaactcctgacctcaggtgatccacccgcctcagcctcccaaagtgctgggatgacaggcgtgagtcacagcgcccggcccagtgtggatacaccttgagcacataactggaatcctttccttggaaacttggaaccccttgtgtcatggtcatataaactgtgttgaattaagaggagacactgttaaatatatcacagctgtcctcgaaactgggacttgttttgctttctgcctggaaatgcaagtcatttttatagaaaatttatttttcgttaacaaaaaataattgtatacatatatatggtacaatgtaatgttttaatccaagtacacattgtgcaatgattaaatcaagctagttaccatattaacaataaagttaattaacatattaaaataaagctaataacgtattaaccaagctaattaacatattaacaatcaagctaattaacatattcacataatcctaactctgacctatatcacctcacctagttttttttgtggggagaatatgtcaaatctacttttagtcattgtgaaagacgcgatgtattattaactatcatcactgtggtgtgatagatcttggaatttatttgttttatctaactgaaaaaaattaattttaatgtaatttatgtattttttgagacagtctcaccctatagccaggctggagtacagcatcatgttcatagctctcggcagcctccaagtcatggctcaggtgaccctcccacctcagcctcccaggtagctgggagtacaggtgcacaccaccacacctggttaatttttaaattttttgtagagatggtgtcttgctatgttgctcaggctggtcttgaattcctgggctgaagcgatcctcctgcctcagcctcccatgtagctgggagtacaggtgcatgccaccatacccagctaattttttgttttttttttttagagatggggtttcattctgttgcccaggcttatctcaaactcctggcctcaagtgatcctccttcctcagccttccatagcattgtgattccagacatgagccaccgcttttggccagcaactgaaattttgtgttctttgacaaacacttcagcattctttgctggcaacaaccattgtaccctctgcatttatgtgttcagcttttttatattctacatatgcgatgatatggtatttgtctctctgtgcctgtttcatttcacttcaccttgtatcttccagtcccatccatgttgctgcaaatgacaggatttcctttttcatggctccatactattccagtgtgtgtctatgccacatttgtttgatgcactcatctgttgattgacacatgggtttattccgtctcttggaaactgagtagtgctgcagtgcacagtggggcaggtatcccattgatgggtacacacccagtggtgggatgactagatcctgtacaccattctttcctctgatgtttcgcaggcccatgactggacctttggaacgtcttcactgtgtacaaggtggtggtcccttggccacattcttagggaacgtcttcaatgtgtacatgacggccgtcccttggccacatgctcagggaacatattcagtgtgtacttggcagtggtcccttagccacattattagggaatgtcttccgcgcgtacacagtggcagtccgttggccgcatgcgtagggaacgtcatcagtgcggtccattggccacatgcttagggaacatcttcagtgtgtacatggtggtctcttggccacattcttcgggaacgtcttcactgtgtacatggcggaggtcccttgggcgcatggttagggaacgtcttcagtgtgtacatggcggaggtcccttatccacattcgtagggaatgtcttcaatgtgtacacggtggcagtcccttggctacatgcttagggaacatcttcagtgcggtcccttgaccacatgcctagggaacgtcttcagtgccgtcccttggctgcattcttagggaacgtcttcagtgtgtacatggtggtggtcccttagccacctgcttagggaacgtcttcaatgtgcacatggcagcagtcccttggccacattttttgggaacatcttcagtgtgtacatggcggcggtcccttagccacattcttagggaatgtcttcagtgtgtacacggcggcagtcccttggccgtatgcttagtgaacgtcttcagtgagtacatggcggcgatcccttagtcacctgcttagtgaacatcttcagtgtgtatatggcggcagtcccttaaccacatacttagggaacgtcttcagtgtgtacatggcagtggtgccttagccacatacttagggaatgtcttcaatgtgtacatggcagtggtttcttagccacatgcctagggaacgtcttcagtgttgtcttttagttgcattcttagggagcgtcttcagtgtgtacacggcagcagtcccttggccgcattcttagggaaccttttcagttcatacacagtggcggtcccttggcaacattcttctgagtgtcagtgtctgtctgtgtccttttcaccctgtaagctgcttttgtttcttcactgggtgtctctgactctcatgtggaatcccatttctctgtcaccgcctgtcccaggcacagtgagagacgcagccagcctgctcctctctgcacgtggccgtctcagacattctccagccaccgtcctgaccgaattcattccttcccctgccccgtccacattcttcttcccctacacgcttgctaccaagaaatggtctgaatcacagccaaggcttcatttgctttctggaactgcagctcccagccccacccagatcagaggttcagaacctgaatcttcggatttctggagatgcccccatcctatcagaggcttctagtgtgtttctttatattcgtgtagacttgggaggatgacaggaaagaaacctttgaaggtggcctgtgcagttccagggcccagggtggaaggggcttgcatccctggctgcctttgtgcacctttcattcttgatgcaacttttttttttttttttttaaagatggagtcttgctgtattgcccaggctggagtgcagtgctgtgatctcagctcactgcaccctccgcctcccgggttcaagcgattctcctgccacagcctcctgagtagggagctgctaaaataaaataccttcagttgggtaatttataaactacagacatttgtcactcacagttctaaaggttggaggtttaagatcgtggcggattcagtgtctggtggggacccacttcctggttcatagatgatgcattttctctgcgtggaaggggcgagggagctctctggggtcccttttataaggacactgatcccattcatgaggctcgatccccatgatctcatcacctcccaagtctcccacctcctgactccattgtcttaggggtgaggatttcaatgcaggaatttgggggaggaatacaaactttcagactatatatagcaaataccattctttaaaaacatacagtaatagttaagctttttttttttttaatttgataaattttccaagaaggaggagacacagaaaccctccttgctttgaaggtgaatgttagtgctgtaaaatatacgtgggacttgggcttataaaatcttggtcacggtaaaatataggtggtacgcagaacctgggaaagcccacctttcctttttctgacatgtaacttttgtggaaattgcctaaaattgtttatagttagctcttcagtcctgtgtccaacccagcatgtccgatactatctaacattctttttttttgagacagagttttgctcttgttgccaagcctggagtacagtgacgcgatcttggctcgctgcaaccttcacctcccgggttcgagcgattctcctgtctcagcctcctgagtagtttggattactaaattttatataaatgttgtgtcaagaaataatattgctcttttgactttttttccctaagcattgagaaattcagaaaaaacatttataaacataaacactgttcttgacaagtgggccttccaaaaataagggctggagtttgttgaaactgctctactgtgttttatttatttatttatttattggtacttttttccttttttttttgaggcactaattggaatgcacttatttgtcctgggtggagaaacaattcagatctaacactgggggctctgtgtttccttaggtaacgcatgtgaggttttcgtcagtgtaattcggtaatctgtgttagtattattacaaaagagcaggggggcatttgtgtcttctcagaattgcttattaaaacagctgcatggccaggcgtggtggctcacgcccgtaatcccagcactttaggccggtggatcgcttgagtacaggagattgagaccagcctgggcaacatggccaaactccatctctactaaaaatagaaaaaattagtatgtgcttatattcccagctactcaggaggcagaggtgggaggatcacttgagtgtgggagttggaggctgcagtgagctgtgaccacagcctgggcaaccaagcgagaggtgctgtgtctaaaaatacaaacataaaaattagccaaatgtggtggcacgcgtgtgtggtcacagctacttgggaggctgaggctgaaggatcgcctgagcccaaggaggttgaggctgcagtgagctagcatcatgccactgcactccaggttgggcaatcgcctgggtgtgaccctgtctcaaccacaataaatttaaaaagataggaaatttcaatatgaaaatcagtgtcccccagaatgttccatttcttcccagctgggctatttttggagttctatggggagctgtctcagtgcaccttgcatgtactcaggaggatgagccctgccatggtgtgtgttaggggacagcctgatctcaccaaccctcctgagcaggcccggccctccgagtaataactgggaacactcgccgctttgtgagatgacctcgtgtgatcatttgaaggtcgtctcttctggtcagggtgcagagtggacacatttttttttttttttgagacagagttttactcttgttgcccaggctggagtgcagtggtgcgatcttagctcactgcaacctccacctcctgggttcaagccattctcctgtctcagcctcctgagtagctggcattacaggcgcccgccaccacacccagctaatttttgtatttttagtagagatggggtttcagcatattggtcaggccagtctggaactcctgacctcaggtgatccacccgcctcagcctcccaaagtgctgggatgacaggcgtgagccaccgcgcccggcccagtgtggatacaccttgagcacataactggaatcctttccttggaaacttggaaccccttgtgtcatggtcgtgtaaactgtgttgaattaagaagagacaccattaaatatgtcacagctgtcctcaaaactgggacttgttttgctttctgcctggaaatgcgagtcatttttatagaaaatgtattgttcattaacaaaaaataatcgtatacatatatatgaggtacgtgatgttttaatccaagtacacattgtgcggtgattaaatcaagctagatactatattaacaatcaagtcaattaacatattaataatcaagctaataaacacattaacaatcaagctaattaacatattaacaagctaattaacatattcacataaccttaactctaacctatatcacctcacctacttttttttgtggtcagaatatgtaaaatctacttttagtcattttgaaagatgcgatgtattattaactatgatcactgtggtgtgatagatctttgaatttatttcttttatgtaactgaaaaaatttaattttaatgtaatttatatttttttgagacagtctcaccctatcacccacggtggagtgcagcgtcatgttcatagctcactgcagcctccaactcctggctcaggtgaccctcctgagcctcccaggtagctgggactacaggtgcacaccaccacacctggttaatttttaaattttttatgtagatgggatcttgctatgttgctcaggctggtcttgaattcctgggctgaagtgatcctcctgcctcagcctcccaagtagctgggactacaggtgcatgccaccatacccagctaatttttttgtttttgttttttttttagagatggggtttcattacgttgcccaggcttgtctcaaacttctggccttcagtggtcctccttcctcagccttccatagcattgtgattccggacataagccaccgctcctggcctccaactgaaatgttatgttctttgacaaacacttcatgaagcattcttccctggcaaccaccattgcactctctgcttttatgcattcagcttttttagattctacatacgagatgatatggtattctctctgtgcctggtttatttcacttcacattgtattttccagtcccatccatgttgttgcaaatggcaggatttcctttttcatggctgcatactattccactgtgtgtctatgccacatttgcttgaggcactcatgtgttgattgacacatgggttgattctatatcttggaaactgtgagtagtgctgcagtgcacagggggtgcaggtatcccgttgatgggctgatttcctttcctttgggtacacaccttatggtggaataactggatcctgcacatcattctttcctgtgatgtttcacaggcccatgactgaaccttggggaatgtctttactgtgtacaaggtggcggtcccttggtcatattctttggaaacatcttcagtgtgtatacggcgttggtcccttggtcacatgcttgggaacatcttcagtgtgtacatggcagcagtcccttagccacattcttagtgaatgtcttcagtgtgtacacggtggcagtcccttggctgcatgcttagggaacgtcttcagtggtgttccttggccacattcttagggaatatcttcagtgtgtacacggtttgtgtacagggcggtggtcccttagccacaagcttagggaacgtcttcagtgctgttccttggccacattcttagggaatatcttcagtgtgtacacggtttgtgtacagggcggtggtcccttagccacatgcttagggaatgtcttcagtgtgtacccgtggcggtcccttggcctcatgcctagggaatgtcttcagtgccgtcccttggctgcattcttagggaatgtctttagtgcgtacatggcttcagtgcgtacatggcggcggcccctcagccacatacatagctaacatgttcagtgtgtacactgcaacggtcccttggccccattctttgggaacatcttccttgcggtcccttggctgctttcttagggaatgtcttcagtgcctacacagtggcagtcccttgtccacattcttagggaacgtcttcttctgtacatggtgtcgatcccttggccacattcttagggaacatcttcagtgagtacatggcggtggtcccttggccacatttttagggaacttcttcagtgtgtacatggctaccgtcccttagcccatgcttagggaatgtcttcagtgtgtacatggaggtggtcccttggccgcattcttagggaccgtcttcagtgtgtacatggcggtggtctcttggccgcattgttagggaccatcttcagtgtgtacatggcggtggtcccttagccacaagcctcgagaccgtcttcagtgtgtacacagctgtcgtcccttgggccacatgcttagggaacgtctgcagtgtgtacacggtggcggtcccttggccacattcttagggaacgtcttcagtgaggtcccttggccacatgcttagggaatgtcttcagtgcctacacagcggcagtcccctgtccacattcttagggaacgtcttcagtttgtacatggtgtgggtcccttggccacattcttagggaacatttttagtgtgtacatggcggcagtcccttagccacattcttagggaatgtctttagtgtgtacatggtggtagtcccttggccgcacacttctggaacgtcttcagtgcggtccctttgccacgttcttcgggaacatcttcagtgtgtacatgatggcggtcccttagccacaaacttagggaatgtctttagtgaatacacagcagcggtcccttggctgcattcttagggaacgtcttcagtgcggtcccttgaccacattcttaggaaatgtgttcagtgtgtacatggcgtcggtcccttggccacattcttagggaacatcttcagtgtgtacatggcggagtcccttagccacatgcttagggaacgtcctcagtgtgtacacggtggcagtcccttggccacatgcctagagaacatcttcagtgctgttcctttgctgcattcttagggaatgttttcagtgtgtacacggtggcagtcccttggctgcatgcttagggaacgtcttcagggtggtcccttggccacattgttagggaacatcttcagtgtgtacatggcggtggtcccttggccgcattcttagggaacctcttccttgtgtacagggcagcggtcccttggccgcattcttagggaaagtcttcagtgtgcccacggcagcggtcccttgggggtgaggatttcaacgcaggaatttgggggaggaacacaaactttcagatagtagcaaataccattctttaaaaaaatacagtaatggttaagcttttttttttcttgattgataaattttccaagaaggaggagtcaaagaaacgctccttgttttgaaggtgaaggttagtgctgtgaaatacacataggacgtgggcttatataaaaatcctggtcacggcaaaatataggtggtacgcagttcctgggaaagcccacctttcctttttctgacatgcaactttttcggaaattgcctaaaagttgtttatagttagcccttttcggccctgtgtccaacccagcgtgtccggtactatctaatgttctttgtttttgagacggaattccactcttgttgcccaggctggagtgcagtggtgcgatcttggctcactgtaacctctacctcctgggttcaagcaattcccccgcctcagcctcctgagtagctgggattaccggtgtccgccaccaggcccagctaatttttgtatttttagtagagacggggtttctccatgttggccaggctggtctcgaactcctgacctcaggtgatctgcccgcctcggcctcccaaagtgctgggattacaggtgtgagctactccgcccagcctaattttttattatttttaatttttaacattttttttttggagactgggtcttgctgtgtcccacaggctagagtgcagtggcatgatcatggctcactgcagctttgacctcctggactcaagccatgctcccacctcagcctcatgatagctgggactccaggtgtgtgccatcatgcccaggcaagtttttaaaaaaattatttgtagagatggcgtctcactatgtttcccaggttcgtctggaactctgggcctcaatggatcttcccacctgggcctcccagagtgctgggattacaggcatggggcacagtgcccagtccctcatgtgtgtaattgttcaacagctagagaaacccaaacacataccctcagacactgtcccgtctgccgcccaggtctcctcacctgcatggtttgctgttgccacttgatttaatggagggcataatgaatgacccttaaacacggcctctaagagtcctcgtaagtgccttcctcattaaaattcaagaggaatcaaatacctgttactgaatataaatgtttagaggagaaagcctgtgagctgagagtcatatcttaaggggtgtgtgcttgcagaattatcacattttcaatttcatgtgtgaataaattgttgtatttgggatcaccaagaaggcagaaacatgtatcaatgaaatttagtagacggctaaaaacaaacagtagcagcctactgaggggctgtggaataagcagattttagatttttagagggaaaacggtgatggtaggttatttccccaatggcttccaggcctccaactcaggcttggaattggccatggtcattggccctttttttttttttttttctttttgagacggagtctcgctctgtcgcccaggctggagtgcagggtgtgatctcagctcactgcaagctccacctcccgggttcacgccattctcctgcctcagcctcccgagtagctgggactacaggcttccgccaccacacccggctaattttttgtatttttagtagagatggggtttcactgtgttggccaggatggtctcgatatcctgacctcgtgatctgcccgcctcggcctcccaaagtgctgggattacaggcgtgagctaccgtgcccggcccattggctcttttttttaccatctcatcttctctcacacgagttattctcactgttggaaagaacttgtccttaaagcattgcttccaggtgagtgtaacggtgcccagcatgtgatacaagttaaaaataagagcagagcccaaatgctgtcattgcttgatccatcatttcccctgtcatgcagctcatttgagtaacagggtctcgtttcggggtgctgtgtccggagaggcagaactccccttggagaatgggtagagaatgtacatcacttgccaagtatggtggttttgcatgctgccttgactggacttgtttgcctttggttttctgtaagaatcttaggatatctgcccaggagttagacccctgggctaaagtaaggttgagggccagccacggtggctggtgcctgtaatccctggactttcggaggctgatgtgggaaaatcacttgagtccaggagtttaagaggagcatgggcaacgcagtgagacccccgtctatataaaatttaaaaaaaattagctggacatggtggtgtgcatctgctcccagctactttggaggctgaggtgggaggatcactggagcccaggaggtggaggctgcagtgagccatgatcacaccactgcactacagcttgggtgacagagccagaccctgtctctacgaaacacaaataaaaagtaaaatgaggttgagaaactccgcctccctcttgatttcaaggtaatactcagcttctagattgacacacacacaagtcattgtcttatcatagtgacatgtgacggaacacgcacgtgtctggtgacagatggtgcattgaggggaacattccttaagctgtgtttccttggggaaagaggcaatagcattctctgttagtacagaacccttcagtttgtacaaatgtcttcggaaagggaatattcctgagagcttctacgtggcagttaacaagtcacacttttcatctcagatgtctcaatttccagaagatggtacttgattacatttcctggggttcttgtttctaggaaatcgcggctgggtttttctagaaataatgcagtgatttggggacctgtggcactgggaagggtatgatctcaggcacaggactgcaaagacacgttgtttaccggccagcatgataactaggcgtgacgctgatggccagtgtgttgcatacgtactgggctttattatccatacctggatggaactgaatatatatatatacacacacacatagacacccataatatattatacaatgtaattatatatcatcatatatcatatatattataatatatacagttgacctttgaacaacacaggtgtaaactccataggtccatttatatgtggattttctgccacctctgccacccccgagacagcaagaacaaccctttttgttcctcctcctcctcctcagcttcttcagcatggagacgatgaggatggagacctttaggatgatccacttccactcgatgagtagtacatatgttttctcttccttaagattttcttaatagcattttcttttctctagcttactttactgtaagaatgcagtatataatacatagaaacacaaaataaatacaaacatgtgttgagaatgtagtatataatatatataaatacaaaatacatgttgattgacagtggcatgatctcagctcactgcaacctctgccttctgggttcaagcaattcttctgcctcagcctcccaaatagctgggcctacaggcgcacgccaccacacccagctaattttttttgtatttttagtaaagacggagtttcaccatgttggccaggctggtcttgaactcctgacctcgtgatccacctgcctcagcctcccaaagtgctgagattacaggcgtcaaccactgtgcccagccgtgtgagtctttatggtagaacaatttatattcctctgggtgtgtacccaataatgagattttcagtagactttgagtgaagccgatagctgttcataatgtgggtgggccttgcctaatcagtggaaggtcttaagaggtaaaaagagtccctcctccaaggaagagggaattctatctggaatccaccttcagacttgagctgcgacatcatgtctccatgggcatctggcctgctggtctaccctgcacattttggttttgcccctcccccacatcttgggagccagttctttaaaatctctttctctctatatatatatcctactggttgtttctctgcagaactgtcactcatgcagatctgtgtccacagatgacatcattgcaaagccactaagagagacatagcatccagggaatggaaggaccaggttcctttcagacttgaagacacgtcaaaacacattccaccgcgttgccttggagaacccagggaccaggcctcttcccctcctgtcaaatagtccttagcctttgttcttcttgctccttgtgaatttcacaggcttccttgactttgaattctgctccttggatgtctttgttggtgaacgtgatgagatagaattttggaaagctccgaggtgtgatcattgcaccctgggactgacacgtgctccgtcttcactgaagacagccggaagccgtggtgttccagaacttgaatgtggctgtggaaactagagtgtccatgcatcctgggcggtagctactggtgccgtctgcgtcgtctgtagctcctcattgctgattctcattcggctgcctcagtcaggacagggctggttacagcgttgctcttcatgctgttcaagtcagggtgatctacagggacagaacgaataggactgatgtgtatatgaaggggagtttactaggataattgactcacacgatcacaaggtgaagtcccacaataggccgtctgcaagctgaggagccaggaagccagtccaaggcccaaaacctcaaaagtaggcaagctgagagtgcggccttcagtctgtggtcgaaggtccaggagcccctggcaaatcactggtgtaggtccaacggtccaaaacccaaagaccctggggtcttgatgttcgagggcaggaagcatccagcatgggagaaagatgaaggctagagatcccgccactgcactccagcctgggtgacagagcgagactccgtttcaaaaaaaaaaagaaagaaagaaaaacatttaaaaagcagaaatgagctggatgcggcatcttctgcttgtaatcccagcattttgggaggccaaggtgggtggattgcttgagcctaggagctcgaaaccagcctgggcaacatacggagaccctgtctctacaaaaaaacacaaaaattatctggccatgctggtgcacacctgtagtcccagctactcaggaggctgagatgggaggtttggttgagcctgggaagttgaggctgcagtgagccatgattgccccactgcactccagcctgggtgaaagagtgagaccttgtctcaaaaaaaagaaaaagaaaaaagaacaaataagaagacagacacacctctcttctttgtgtgggtacagccgttggcaaactttgctgacagatgctactgaccttgttttcctttctgcattctgttcatttcaaaagtgggtaaatcagaagtgggactcactgtgaccttcagtgactcaatgctgaattcacaagattaattggagagtgtgaagaatgcagggcatccgtggacccattttaatgaattttagcatctcttgcatccttgtatccttgcatccagtaccggtccccagccttttagtaactgggctgtgcagcaggaggtgagtagcgtgtgagtgagcaaagcttcatctgtattgacagctgctccccatagctcatattacctcctgagctctgcctcctatgagatcagtggtggcattagagtctcataggagcatgaaccctactgtgaactgaacatgtgagggacctaggtggcgtgctccgtatgaaaatctaatgcctgatgatctgtcactggctctcatcacccgcacgcagatgggaccgtctagttgcaggaaaacaagctcagggcttccactgattctacacgatggtgagtttcataattacttcattctctattacagtgtaataataatagaaataaagtgcatgataaatagaatgcacttcaatcatccccaaaccatcccccaccccacatcagtggaaaaatggtcttccatgaaactggttcctggtgccaaaaagcttgaggaccactggacaaaggaacttgtcagagtatggattgaaggtctttattgatgctttgctgtcactcttactttaagatgaatgcgtatatatatgtatatacattctgtaatgtgtgaatatatgaagctccagctgctctctccctctctttcctctgcagtccaattctcgtagatcagtcttttcctgaaatgaatgacctcttaaattttattttatattttaagcttttatgttattttactttatttttaagctgtttttattttttaagcttttttttttttgagacaaaaaagtctcgctcttgtcacccaggctggagtgcaatggcatgatctgagctcactgcaacctccacctcctgggttcaaaaaattctcctgccccagcctcctgagtagctgggactacaggcgccagccaccacgctgggctaatttttgtgtttttagtagagacagggttttaccatgttggccaggctggtcttgaactcctgacctcatgatccacccacctcggcctctcaaagtgttgggattacaggtgtgagccaccacaactggccagtttgcaggtctttgttgatgctttgctgtcaatcttactttaagacgaatgcatatatatgtatgtgtatacattctgtaatgtgtgaatatatgaagctccacctgctctctccttccctctcctctgcagtccagtactctcctagatcattctgttcctgaaatgaacgaccattttttttttttttattttgagatggagtcttgctctgtcccccaggctggagtgcagtggcgtgatctcggctcaccgcaatgtccgcctcctgggttcaagcgattctcctgcctcaccctcctgaggcaggattacaggcgccagccatctcgcccggctaattttttaatttttagtagagatggggtttcaccatgttagtcaggctggtctcaaacttctgacctcaggtgatcagcccaccttagcctcccaaagtgctgggattacaggcgtgaagccactgcacgtggccggtttgcagtctttattgatgctttgctgtcaatcttactttaagatgaatgcatatatatgtgtgtgtgtgtgtgtgtgtatgcattctgtaatgtgtaactatatgaagctccagctgctctctccctccctctcctctgcagtccaatactcctagatcattctgttcctaaaatgaatgaccattcaggttttttttttttttttctgagatggagtctcgctctgtcacccaggctagagtgcagtggcatgatctcggctcactgcaatgcccacctcccgggttcaagcgattctcctgcctcggcctcccaaagtgctgggattacaggcatgagccaccgcgcccggccagaattcagttttttttttttccccatggttatccaatagcacacaggctcgtgaagccttcaaggtgcttcatctgaggttcgcttagaatggttgccacatattgttctgccggtgagttttcatgaattggactctgaaggttcttaattatggtggttgagtgacacggtctttcttctataagaacctaagttacactgcatatcaggaaaatgtgttcctgggaccagctttgttgggtttttggctgctggtcatcttcactttactctcccaaatttgaggactgtgacacacacacacacacacacacacacacacacacactctctctctctctctctctctctctctgtctctcttaggaaacaatggtatatcaacaatgaaatgatgcttttttttcttcttcttttttttttgagacagggtcttgctctgtcacctaggctggagtgcactgatatgaacatggctcactgcagccttgctctcccaggctcaagcaatcctcccacctcagcctcctgagtagctgggaccacatgggcacaccatcacacctggataatttttgtatttttagtagagacggggtttcactatgttggtcaggctggtcttgaacttctgacctagtgatttttctacctcggcctcccaaagtgctgggattacagacatgagccaccagactcggctgagcatcttttcaatatgaccttgtgtccgggcatggtggctcacacctgtaatcccagcactttgggaggctgaggtgggcggatcacgaggtcaggagatcgagaccatcctggctaacacggtgaaactccatctctactaaagatgcaaaaaaaattagtcaggtgtggtggcgggcacctgtaatcccagctactcgggaggctgaggcaagagaatggcatgaacccaggaggcagagcttgcagtgagccgagattgcaccactgcactccagcctgggcaacagagcgagactcggtctcaaaaaaagagaaaggattcaaggcagtgtataccaaacatgaaagtaaagttcaggaacctctttgatggaggagatgacggtggggtctgtagcctgttcatgcctataattgcaacacgtcgggaggccaaggtgggaggatcacttgaggccaggagtttgagatcagctcggccaacatagtgagaccccatctctacaaaaataaaaataaattagtggggcatggtggcacacacctgtagttccagctacttgggggactgaggcaggaggatcacttgaaaacaggagtttgagatcagcctgaacaatggagcaagaccctgtctctacaaaagattaaaaaaaaaactggcagatgtgctggcacgtgcctgtagtcccagctgcctaggaggctgaggcaggaggattgcttaagtctgggagtttgaggctgcagtgagctgtgttttcaccactgcactccagccggggtgacagagcaagaccctatcagtagtagtagtagtaataataataataataataataataataataataatatgttgctgcaaaagtaattgctgcttttgccattaacttttgcaccaacctcatgataaaacaacaaaaactcaacacctgtacctgccatgccctgaagctcatgacagtagacaaaactcactgtgtctccagccctcagtgttagatgaagggaccagggtgtgggaagatcagcagttcaaacgggaatcataaaacacatagtttttatttttttagttttgttttattatttatttatttatttttgttgttattatttttctgagatggagtctccctctgtcacccaggctggagtgcagtggtgtgatctcggctcactgctacctctgcctcccgggttcaagtgattctcctgcctcagcttcccgagtagctgggattacaggtgcgtgctaccatgcccggctaatttttgtacttttagtacagacggggtttcaccatgttgattgggctggtctcaaactcctgacctcgtgatccgcctgcctcggcctcccaaagtgctgggattacaggcgtgagccactgcgcccagcccccatgaaacatatagatattttcaaaacaactgtactaggatcaagaaggataggacttttgtttttcctgttttttaagaatgaaatatcatatggcgtaagcatagatttatttatttacttacttatctattcatttatttttagagacaggatcttgctctgttgcccaggctggagtgcagtaatgcaatcatagctcactgcagccttcaagtcctgggctcaaacaatcctcccatctcagcctcccacgtacctgggactacacatgcaagccaccatgcctggctaagttttaaatttctttgtagagatggggtcttgctatgttgcccaagctgatctcaaactcctggcctcaagtgattgtctcaccctgacctcctaaagtgttgggattacaggtgtgacccactgcttcctgcctagactttttttttttttttccaattaaggtttttactttgagatcattgtagatttataagcagttgtaagaaataataggaaagaatcttgtgtctacttcccccagtggtaacatcttggaaagcaataataccatgtcacaaggaggatattcacattcaggcaataatgcattgatcttatgttttactcgtatccgtgtgggtttttgtaccgagttctgtgcaatttcatagtgcgtgcaggtttgtgaagccagcattgtccgcaacacacagagcatttctttcaccaacaacccctcctgtttctctctctgcatcctacctcaacctcctctcccgtcctgaacccctgagaattactagtctgttctctatttctgtaccaacctgcatcctacctcaacctcctctcctgtcctgaacccctgagaattactagtctgttctctatttctgtaccttttctcatgtcaagaatgtcatataaatggagtcatacagagtgtaacccctttcaaatcacgtgtgtctttttttccttcactcaatagaattccctggagagccatccaagttgttgctaagaacaataagatgtttctttttaagtaacacctgcaaaaagtcttttataaaatggcgatgaaactaaatggtttttgattctaaacaaggcagccatgaatggttttctcgtatatcttagcatatgtgtgggagtgtatctgtgcaagtaattcttggaagtggaatagctgagccaaaaagaaaatgcatgtaaattttcttttctttattttaaagagacagcgtcttgctctgtcacccaggctggagtgcagtggtgcaatcatagcttgccgcagcctcgacctcctgggctccagtgatcctcccatttcagcctccagggtagctgggactacaggcgagcatcaccacgtctggctaatttatttttatttttgtagaggtagggtcttgctatgttgcccaggctgggcctcgtgctcctagcctccgctgatcctcccaccttggcctctcaaagtgttgggattacaggcataagctaccaggcctggctgcctgtcacctttcaggagtcattgtcaacttatctcctaagaaaatgcagtcttggtgggtacatttgaactgagtatgtaaacttctaacttctccaaggcatacgcattctggataacaaccctactttttaacctattccatgtgattgatgaaagctcacaattgctttattcattatttcattgtcagcgagactgaactttgtttcatatgcttatgttttatttcatatctccaaattgcatattcatttcctttacccatttgtggagggactggggtttggttagaagagctctttatagaccgggcgcggtggctcacgcctgtaatcccagcactttgggaggccgaggcgggcggatcacgagatcaggagatcgagaccatcctggctaacacagtgaaaccctgtctctactaaaaatacaaaaacaaaattagccgggcgtggtggcgggcgcctgtagtcccagctactcgggaggctgaggtgagagaacggcgtgaacccgggaggtggagcttgcattgagctgatattgcgccactgcattccagcctgggcgacagagcgagactccatctcaaaaaagaaaaggttagaaaaatacaccatggaatactacgcagccataaaaaggatgagttcatgtcctttgcagggacatggatgaagctggaaggcatcattctcagcctaataacgcaggaacagaaaaccaaacaccacatgttctcacttacaagtaggagctgaacagtgagaacacagggacgcagggagggggacatcacacaccagaacctgctgggggctggggaacaaggagagggagcgcattaggacaaatacctaatgcatgcagggcttaaaagctagatgatgggttgatgggtgcagcaaaccaccgtggcacatgtatacctatgtaacaaacctgcgcgttctacacatgtatcccagaactttaaaaaaaaaagaaatagtatttcaatatggtctgaattaggatgtctgttattagatataaaggagaacatatgtgttgagggccatttgagcctgttctgtatataaactcttatttttgcccttttctttgtagcatgtttggggtttttctggagttgaactttttagatatctgaaaaatagctgttaatatttctgatggaagttgcaaattttcttccagctcattatttattttttactttgcttatggagatttgttttgttttttaccatgtgattttttttttgagatagtgtcttgttcctcctggagtgcagtggcacgatcttggctcactgcaacctccatcccttgggctcaagtgatcctcccatctcagcctcccagcttgctggaactacaggcacgcaccgccacacccggttaattttttaaattttttgtagagatgaggcctctctctgtttcccaggctggtcctgagcttttggcctcaagcgatacccccacctcagccctcaaagtgctgggattacaggcatgagccactgcccggcctgttttttaaacaagtagttttttaaatagtgaaatctatctaaccatctttctgaattttcgtttaggaagcattttctttctgtggaggttaaactaatgattcctgctttcttgcaatcttctcatggtttaactttgtttttgccttggagttcactcatgcatgctatgaggtctggcactaattttatctgtttcctaatgtggcttcacgtgccccaacacggtttattaaaacgcccatcttttgccccttttgtcgtgtactcaatttccacatgcagttggcctatttttggaaattgtaccctgttccttcctccattaatgcctgtagtacctcccgtttaattatagaagcttctcaaatgttttaatctcctacagggccattgtgttctcaatctttgtacatatcagaattttcctctttgccgcctcatttggaattcttttccccacagcaattttcgaatcgattcgtccagtttgcctaaaagaaattctgtgaactatctttattggatcacatcaaatttgcatattgacttgggtcattctgacacctttaggattgtatcagtttagattttttttccccctccaacttctattttattttttaaattaaaaaaaattttttttttgagacggagtctggctctgtcgccctggctggagtgcactggcgtgatctcagctcactgcaagctccacctcccgggttcaagcgatcctcctgcctcagcctcccgagtcgctgggattacaggtggcacacaccaccacgcccagctaaattttgtatttttagtagagatgcggtttcaccatgttggccaggctggtcttgaactcctgacctcgtgatccacccgtctcggcctcccaaagtgctgggatgacaggtgtgagccaccgcatctggcctcaacttctattttaggttcgggggtacatgtgcaggtttgttccctgggtatattgtgtgatgttgaggtttggagcacaaggatcccgtcacccaggtagtcagcacagcactcaatagttttccaacccttgccccatcccttccttgccccattgaattgctcagtgtttattgttcccatctttatgtccatctgtacttgatgtttacctcccagtaagaagtgagaacgtctgatatttagtttcctggttctgtgttaattcacataggagaatggcctcctcttgcatctatattgctgcaaaggacatgatttcattctttttaatgggtgcatagtattccatggtatagatgcaccatgtcttcctaagaattgaattaacatttgagccagcaatcccattactgggtatctacccaagggaaagtaagtcattctaccaaaaagacacacgtactgtgtgttcatcgcagcactattcataaaagcaaagacatggaatcaaacttaggtgtctgtcaactccggattggacaaagtttgggggttttttttgtctttttttttttttttgtgagatggagtctagctctgtcgcccaggctggagtgcagtggcacaatctcggctcactgcaagctctacctcccaggttcacgccattctcctgcctcagccttccgagtagctgggactacaggcgcccgccaccacgccaggctaattttttgtatttttagtagagaccgggtttcaccgtgttagccaggatggtgtcgatctcctgacctcgtgatccacccgcctcggcctcccaaagtgctgggattacaggcatgagccaccgtgcccggccgtcttttttttgttttgttttgagacagtcttgctctgtcacccaggctggagtgcagtggtatgatcggagctcactacagcctcaacctcccagtcttgcgtgatcctctgaactcagcctcccgggtagctgagatgacagccgtgtgccaccatgcctggctaatttttttgtacctttttttttgttttgtagcaatggggcttcactatgttgcccaggctggtcttgaactcctgggctcaagcgatctgcctgccttggcttcccaaagtgctgggattacaggcatgagccactgcgcctgacccatttgggtctttggagaagcacacaccaagaaggaacatgatgggccagagatttactaggggaactgtgtgtgaagggtcaaacaggcgctggcagaagagtggaggaaggcttgcaggtgatggtgtaggtgcctcacacctgtgaagaaagagacggcgaggaattgggtagaaggagcgtccagccagttctctggtcatgccgagtcattggctgtgaaaacccaaaaccctgaggaagcccgatcttgcgaaacatgttccccatctgcagaggcaccgggtggctggtgtcaggcgattgttgcaacctgttgtgtgcgggggtgtctgtgtgggtacatacatacttctcagccccaatgccagcttcctggtccgtaaggaaaacactaaactcttctagctaaagttacaaatgcagcaagggtccattctgcaatctgtgatgcttttttttttttttttgagctggggtctcgctaccttgcccaggctgcggtgcagtggcacaatcacggctcactgtgcgttttcagggaagaccccacgggcacctccaaaaccatgtggcatgacatcctcaccgagacccgagggcatctttccatggcctcaactctacttttatgtctttaggtttcctgatataggttttgcacactctcgatgaccaagtctcatttcagtgttgctgttgtttctatattataagcaggactgtctcttcccctacctttttaacctgccaattgtttgtgtatgtatggaagctattgatatttgcttctgagttttctatctgactaccttcctgaattctcttcttggatttatttaatgttgattttgttagttttttcctggcataccatcatatcatctgcaaagtatattttgactctccctctgccgttcttgtgtctgttgtaattatttgtctgaccatgttggataagatctccagtagcatgttaaatgacagggtgcactcctggaatccagctctttgggaggccggggtgggaggatgacttgagccccggagatcaagaccggtctgggcaacacagcaagaccccatctttacaaaaaaaaaatagtaaaaaaaattagccaagtgtggtggctcacacctgtagtcccagctacttgggaggctgaggcaggaggatcatttgagtccaggaggtcgaggcttcagcgagccatgattgcaccactgcactgcagcctgggcaatgtagtaagaccccagctcaaaaaaaaaaaaaagcatcacagagaacaggatggatacttgctgcttttccaagtttagctggaagattttagagatttctttattgactaggaagttggcattggggctgagaaatatgtatgtacacacacagacacacccacacacagacacacatgtatacatacacagtatatatgcatactgtgtgtctgtaattacaatttaataatacattcctatttttaaaataaacttagtaaattaagaacatcaatacatctactgatactacatatagtatttgcaagtccctcagcttgggtcaggaacacgggaatgtcattgtacaggttctatcttcaggttacgagggatacaccagaaaacctaagcatatggaaaacttattcggcaattttctaagtgaacataccttttcatcgattcatgcgtgtatcaagaaaaacaaaatgaaagtcttacacaccaagaggattgttcgcacaatactgacaacgaaatgtacgggctgacaaataacagattatatgttgaagcctcctccacaggccccacctcctgataccatcaccctggcgattgtatgttctcaacataggaattattttggggggagaggagacacaacattttatacttggaaaggtgaaatggaaaagcagcataggctttattgttttattttattttattatactttaagttctggggtacatgtgcagaacgtgcaggtttgttacataggtatacacgtgccatggtggtttgctgcacccatcaacccatcatctacattaggtgtttgtcctaatgctctccctcccctagtccctcacctcctgacaggccctggtgtgtgatgttcccctccctgtttccatgtgttctcattgttcaactcccacttgtgagtgagaacatgtggtgtttggttttctgttcttgtgttagttcgctgagaaggatggtttccagcttcatccatgtccctgcaaaggacatgaacccatccttttttatggctgcatagtattccatggtgtccatgtgccacattttctttattcagtctatcgttgatgggcatttgggttggttccaagtctttactattgtgaacagtgctgcaataaacatacgtgtgtgtgtcgttatagtggaatgatttataaacctatttctatttaaattacctttgtatttttatagattttgtgggtatgagtacacttgtgttacatgaatatattgcatagtggtaatgtttgggctgttagtgaggccatcactcaaataacgtacatggtagccaataggtaatttctcatccctcatcccatcccaccctgtgagacttctgagtcctcgatgtctattttttatgctctatgtcgacgtgtacacattatttaattcccgcttataagggataacatgtggtacttgactttctgtttctgagccatttcacttaggataatggcctccagttcccttcgtgttgctgcaaaagacacaacatcattccttttcatggctgtgtagtattccatggtatatatgtgccatattttaaaaaatcaaattgtctgatggtggacacttaggctttatattttaataaagaacattccaaatatgttgaacaaaataatctcctaacttgaaaaagatcatatgtgcctataataattcacagaaagggactttcctgactacctgcctgcaaaatccacttttccctcagtctttctttctcaagggaattcatggaaattccctccttgaattttctcagcccccagtacaaggagtcattcttgcctcatcatgtccccctctctgtccttgtcttgtgatttctttttattttgaacgcgagaagtctgactcccaccagcacccctgtggccagtacctgtgagacatattctgaatccagcacctctcataccacctgtgctgaactgtggcggagctcccccgtcagtccctgcagctgcttcaggagacccttgatagccttgtcttcctccagctcaagtggattctccatgaatctattccttcctgtgaaacatatcacagattggctcagagccccgtgatgacgccctgtctgccagagagaagctcacgaactctggggtgcccctactccttcttccctcctctcttccctccttccatgtgcttggctccagctagccagccagccgccttcctcttcctggaatatcccaggcctgctagacttttgctctcaccgtcacaacatcagctcaggagcccctccttggaagattgttctctaaccctccgtccagaatcactgcttctccctttcctcttcttcctttgaagttcattcataactggaagatgtgagatctggaaagttctgcattattgccagacacatctgtgtatttagagtggttggtatctttcccaggggaaccaaatgtccttgaggcagacaacatgtttatctttgtctaattcatttccctgtatgctgggcacagagtgtgggctctacacatattttataaaagaaggagggaagggttagaagatggacagaaggaaggaggaagaaaggaaggaaagagggaggaaagaaaggaaagagggagggaaggaaagagggaaagaaggaaggaaagagtgagagaaggaagtaaagaggaaaggaagggaagggaaggaaggaaggaaaaagtgagagaaagaagtgaagaggaaaggatggaaggagaaaggaaggaaagggagggaaggaaaaaggaaaagaagaaagaaggagtgagacaaggaagtaaagaagaaaggagggaaagaggaaaggaaagaaggaaagagggagggaaggaaggaatgaagaaaagaaagagggaaggaaggaaggaaagaaggaaggaggaaggaaggaaaaagggagggaaggaaggaatgaagaaaggaaagagggagggaaggaaggaaggagggagggaaggaaagagggagggaaggaaagaatgaaggaaggaaggaatgaaggaagaaaggaaaaagagaaggaaggaggaaggaaggaaagagggaaggaaggaaggaaagatggagagaaggaagggaggacaagtggaaggaagaaaaagaaatacaaatctccctcaaaatgtggatcactcgtcttaaccagaaattcaagtgagatgctatctgcacgtgtgataccagcagctatgaagcaaactgtattaaccaagtcttttattttctgtgttctgatgcatgactttcatggccttgtcaaccctagagaccctgcccctcccatagctagcgaatccccagaggtggtgaagagcccacctatgaacctgtctttcatatgcaaacccatcaatccagaatccaccccccagccatctcctttattggggttgcatattccacgtcactctccacctgccctaaccaccccaaagccaggtaccagagagtcagggacagcccctatgccccagagcctgctgaaatcattcacactagccaactgtaagcctactcgcctgttccttcccttggaaaccacagtgagagctctggtctcctttgtcttcccacctgaccaaacttggtgcgcccctgtgtggtcctgagtggtgtcaacacgcccctcctcttgggacctgtgagtaacaaaccacttgcttaacggcagtctcctgatctgttggccccaccatacctacatcataataaagtctacattttacaacgcaaacgaacaaaaatgtcctgctcagtgctgccctgagagcagaggttattccaggattcttgctcgcctctgtaaagggtatccgttctgcagacctttctgccggtcacactgacggcatattgcagagcctgccagggactcacaggggatgacaggggatttatcaggtggttttttactgcactgtcattactgggggcgaatccactttaatacattcatgcctcctgagcctgtgggaattcaagaggaacagaaccagaaataaatgaaccataactccctttggcatcttgcctctctggaggcttaattcttacaaatatgtgctctgctttcaaatcttagtttgatgattttctcttcttctttttcagttttccccccacgacctgaccgtgtcgctatagtgacgggagggacagatggcattggctattctacagcgaagcatctggcgagacttggcatgcatgttatcataggtgatgacttttacagttacttgtgttttttgttttttcggtttttttttttttctgagacaggatcgcagtccgtcaacccgtgctggactgcagtggtgcaatcttggctcactgcagcctccacctcctgggttaaagtgattctcctacctcagcctcccgagtagctgggtttacagacatgcaccaccacgcctggataatttttgtatttttagtagagacagagtttccatatgctggccaggctggtcttgaactcctgagctcaagccatccgcctgccgtggcctcccaaagtgctaggattacaggtgtgagccactgcgcctggcagagttagttgtgtcttatacctaatgtgagctacttaggtgtcgattcagacatgtatgcaaatgttgatgtgcatatagaaaattcagtcagatccagaaagctcatgaaggtgatattcacaacctagaaaacacagaaaattgttgtacccttttggaagtagatatatattctgcttaaatattgatcctgtgtttctttcacatggtttactggaaaaaaataaccatatatctttatgactttactagggctgttataacaaagtatctcaaggagactggaggttgcttaaaaagccaaaatttatttttcacaattccagaggctggaagttcaatatcacagtgtaagtagggctggttcctcccaattccagaggctggaggttcaatatcacagtgtgagtaaggctggttcctcccgacacctcactccttggcttgtagacaccatcttctccctgtgtcctcacagggtcgtccctctgtgtgttttcatctcctcttctcctgagatgtcttagtccatttcaggcgctataacagaattaccatagaatgggcagcttatatacaacagacattgagtttcccacagtcctggaggctggatgtctgagatccaggtgtgggcagggctggttcctcctgaggcctctctccttggtttctctctgtgtcctcacagggtcatccctctgtgtgtgtccgtgtcctcatatgctctccttataaggacaccagttcaattagatcggggcccactctggtgacctcattttaccttaatcaccactttaaagaccttatttccaaacacagtcacattctgaggccctgggctttaggacttcaatttatgaattttgttcaaacacaagctcctaacagaatctgaacaatgttgcgggatacttgtttcttctgcaaccatgacctatagacactcacggtttgatttctgctcttctttttgaaaatttctctaaaagcttatcgtgatctctgactcctcttcctctgtgacctcttcaggtctcccttcaactgggaatatgaggacagttcaaattaacccattccactactgccaatggagacggagtggggggcggggaggaggggagagagtctattgcatacctggggaagtctaaatcagctagcttaaatgatgtgtggagacgagcttggaaaaataaaagccttaatgtgtattatgcccactcttgacactatctgcatttaattaattattttcagacaggatcctactctgtcagcccagactgcagtgcagtgacataatcatagctcactgcaacctcaaactcctgggctccagcaatcctcctgactcagcctcatgagtcgctgatatgacaggcgtgcaccaccatgccaagctcattttatttatttatttattattgttttttttgagacagaatcttgctctgtcacccaggtggaatgcagtgacacgacctcggctcacggcatcccctgcctcctgggttcaagcgactctcctgcctcagcctccagagtagctgggattacaggcgcccgccaccatgccctgctaatttttgtatttttagtagagatggggttttgctttgttggccaggctggtcttgaactcctgacctcacgtgatctgcccacctccgcctcccaaagcgctgggattacagtcatgaaccaccgtgcctggccctggctcatttaaaaaagttattttggcggctgggcgtggtggcttatgcctgtaatcccagcactttgggaggtcaaggtgggcagatcacttgaggttaagagttcaagaccagcctggccaacatggtgaagccctgactgtcctaaaaacacaaaaattagctgggcttgggggtgagtgcctgcgtggtggtgggcgcctgtagtcccagctactcgggaggctgaggcaggtgaattgcttgaacctgagaggcggaggttgcagtgagctgagatcacgccactgcactccagcctgggtgacagagcgagactcagtctcaaaaaaataaacaaaatgttttggagatactgggtcttgctatgttgcccaggctggtcttgaactcctgggttgaagtgatcctcccaccttggcctcccaaagtgctgggattacaagtgtgagccactaggcctgggcaccctttgcttttaataacttttatggtgtctgcttttataaacatcatactgtaggtctggtttgagatatgcaggatcgtattgacttaacactttccaggacgggagcagtggctcatgcctgtaatcccagcactttaggaagccgaggcgggcagatcacgaggtcaggagatcgagaccatcctggctaacatggtgaaaccccgtctctactaaaaatacaaaaagtagctcggcatggtggcgtatgcctgtaatcccagctgctcgggaggctgaggcgggagcatcgcttgagccagggagccggaggttgcagtgaaccgagatcgcgccactgcactccagcctgggtgacagagtgagactctgtctcaaaaaaagactttccaaaaccaatgcccattattgattgacttcttcctctccgccattctctgtccttctttcccttgttgtcattatggaaagatgatcatggatcataaacaatgcttagggctggagatttcaacatgaatttgtctcagttcttccttatctttgaggagctctgtccaggacagacacttttctgggccttgaatgcctttgcgatagcccaaaaggctcaagcataagagcatgagtctgatctggtgaccagggctcagcaaagagtctttccaggccttgaacctctggacatctgttggtgctcattggacaggctaaaagtcatcatgttacgaatcgatgaagttgacatgcagataaaaggtataaggaaaaaatgaactctccacatcattgtatgcattacatctatacgataaaaactgtgatatactcatgcgtttaaatagctgctctggtcctgggcctcatgcgtttcaatagctgctagcgttctgagcctcgatggccatccacttggctttgagttagctctctccaaaaatctccatggcagtttctgctggggcaaatgcacggctgctgcccacacctctgtgttttctcatcttcatttacaaaagaagaaaatgctaaccttgctgatgctaacctcctgaatttcatgcaggaatccccaggagtctttgactcagatggggaaaccccatgttcagcccatgtggccttctggtctccctggagatgcgtggtccatgtcagcgcacatggctccttgctccgtccttcacttaagtttgagcctttttggcttttgcaaaacatgaatgcaaaacttgaaatttttctatgtcatggctcttcccaactttcacatttttgagacagcgtctcactctgtcacccaggctggagtgcaatggcgtgatctcagcccactacaacctctgcctcctgggctcaagcgatcctcccacctcagcctcccaagtagctgggaccacaggcgtgcaccaccaggcttggataattttttgtagttttagtagagatggggcctcaccatgttgcttggacttgtctcaaacacctgagttcaagcgatctgcctgcctcggcttcccaaagtgctgggattacaggtgtgagccactgtgcccagagtcttttaaaataataattttgtacacgcagttccattcctcatataaccatctttctctgatgcacttcagggtttgtaaaatagtatacagagatgtgtactgtttcacatgatgaagcttagttgtattagataatgataacatcgtgtttggctatgtcataatgaggcaattgagtagaatataatgaaatcttgttggattagttaatgacttgttgagcttcggaagcaggtgagcactttttggtctatatcagtctctttctttccatcaagcagttattttcctcaaagttgtgcctaactcccacttgagcattttttttatccattctttttttttttactttgacatgaagtctcactctgttgcccaggctggagtgcagtggcgcgatctcagctcacttcaacctccgcctcccgggttcaagcgattctgctgcctcagcctcctgagtagctgggactacaggagcacaccaccacacccagctaatttttgtatttttagtagagacggggtttcaccatgttggccaagatggtctcgatctcttgaccttgtgatccacctgcctcagcctcccaaaatgctggtattacaggcgtgagccactgtgcccggccccattctctttattttattttattattttattattattattattattattttttgagatggagtttcgctgttattgcccaggctggagtgcagtggcgcgatctcagctcaccgcaaactctgcctcccgggttgaagcgattctcctgcctcagcctcccaagtagctgggattacaggcgcgtgccagcacaccaagctaattttttgtatttttagtagagggggggtttcaccatgtaggtcaggatggtcttgatctcttgacctcgtaatttgcctgcctcggcctcccaaagtgctgggattacaggcgtgagccactgcgcccggcctcattctcttaatagactgggacaagttaaaactttatgacaatttcttgaaattgtcaagttcatccatgtccctaactctcctgtcttggtgtgtttgggctgctgtagcctgagtgccttgcaaaccatagaaactttttttttaaaattttattattatactttaagttttagggtacatgtgcacaacgtgcaggtttgttacatatgtatacatgtgccatgctggtgtgctgcacctattaactcgtcatttagcattaggtatatctcctaatgctatccctcccccctccccccaccccacaacagtccccggtgtgtgatgttccccttcctgtgtccatgtgttctcattgttcagttcccacctatgagtgagaacatgcggtgtttggttttttgtccttgcgatagtttgctgagaatgatggtttccagcttcatccatgtccctacgaaggacatgaactcatcatttttgatggctgcatagtattctgtggtgtatatgtgccacattttcttaatccagtctatcgttgttggacatttaggttggttccaagtctttgctattgtgaatagtgctgctataaacatacgtgtgcgtgtgtctttatagcagcatgatttataatcctttgggtatatacccagtaatgggatggctgggtcaaatggtatttctagttctagatccctgaggaatcgccacactgacttccacaataaaccatagaaacttattgtcctacagttctcaaggctggaagtcccaagaccagggggtcagtgtggtcagattctggtgtagtctgtcttctaggttgtggatggccactttctcctgtgtcctcacatggtggaacctggatggggtctcttttataagggtactaattccattcattgtgctccaccctcgtgacctaatcatcccgcaaagcctccgcctcccaacagaatcactggggatgttagaatttcaacataggaactttggagggatacaaacattcagtttattgcgccccctctagatgcaaaaggattgggtttagatgaggagaccccaggggagagggtgcccatctgagagtgtatttctagaacttcttatgaacttgagcacctccatgatctgtttacatctccctgggacctgagtaaattagagacaagatgtagggcagggggggttctgagatttagcttggagactgtgaggtggtgatggatggcaacccttggttttgaccatccatgctaggtggatatctgctgtatcattaacaacatgacaaactttccaggactttctatatctcagacttctgccaatatttgagatgactgggtcaaaatgatgctgattttttgaacagggagagcaataggtattctctgaaggttggctggatgtgagcctagtggcttcaatgatggtggagtaggatgaagagagaccctcaaggttgaacaaagatgggagggctcacatccattactggttatatttgatcttttgtctcctccagtgcaatgatctttttcatcttcttaattcttaatttagctaggcaatgtttaattattagtttaattcttaatcaaactaggaaaggaagaaaacaccccatttctttgtgcttttttgcctcattgtggtggtttaggtcatgatgaggtctagttgggcaggtcatgatgaagtctagttgtattaggttctgatgatgtctggttgagttagatcatgctgaggtacagtttggtttggtcatgatgaagtctagttgtattagatcatgataacgtctcctttggttatgtcatgatgaagtagttgagtagaatgtaatgaagtcttgttcgattagatcatgatgactggttgagttaggtcattatgaggtatggtttgattaggtcttaatgaagtctagttcagtaacagcatgatgagatctagttggattagacttgatgatgtgtgacttatttaggtgatgatgaaatcttgttgggctaggtcactttgagatctaattgggtaggtcatgatgaggtcttgttgagttaggtcctgatgaaatgtagttgagttaggtcacattgaggtctagttgggtaggccatgatgaggtctatttgtattaagtcatgatgaggtttggttgtattagatcatggtaaggtacagtttggttaggtcatgatgaagtctagttgtattagttcatcataatgtttagtttggctatgtcatgatgaggtagttgagtagaatgtgatgaaatcttgttggattagattaggatgactggttgagttagatcattatgaggtgtgatttaattaggtcttaatgaagtctacttcagtaatagcatgatgagatctagctggatcagatcatggtgatgtgtggtttggctaggtcatgatgaagtctagttgggttaagactcaatgagttctagttgggtcaggtcacattgacgtctagttgggtaggtcatgatgacgtctaattgggttagatcatgaggagatctagttaggaaggtcatgatgaggcctagtggatagatcatgatgaggtctagttgggttaggtcatgataaggtctagttggattaggtcatgataaggtccagctgggttatgtcatcatgaggtagttgaatagaacacaataaagtcctcttggattagatcatgatgacaggttgagttagatcatgatgatgtgtggtttggttaggtcacagtgaggtctagttgactgaggactttgtaggcacaaagcaatgaagacatgtgagcaagcttcttgttcatgtgcatgggaatctcaagtgttaccacttcatttagatgatgtttactgagcatcaggagcagtatatgtcagcaccaatgtgccttttttcttgagataaacagaaagtaaacaccacatctgcaccccacctgtgtctcctatcccacagagctcctgatgtcagtgtttaattttcactgtgagttacagttttgacccttcaggtcaatccaatcaattatgcagtcttatttcccctgtgtgactttgaggataattggatatattctgagagaggcattttttcattttgtatggcagtttgattcaaagtcaattaatgaaaaaatatcattgaacacaatgaattttatattaaatacaaaataagagatgggaaatttaacttcaaaattttaattaaaaatttattaatatttaaagaataatcaattacttgtaaaataattcagattataacctgggtccaactgaagcacattaatattactagacacatatatcagttgttcaaattcccatctgtccacaagatcttagttctcattgtttcaaaatattattttggtgggggatcattttttttcataatgctcaatggactgtcatctaagatgaaagtggggtgggtaaactttttctgtaaagagacagataataaatgtgttcatatgtttctctcataactatgagctctgccctagtagtgagtaaccacccataggtaatacttaaaacaacaggaaagtctatgttgctgtaaaactttttgtacaatatccagctgcaggccaggtttagccgcagattggtgactctggtttgggctcaaaatctttttatttagtaagaggaaattatactgcttttttccaatataagaaatctcttgtacagtcctcaggaagggtagataatgatgaggtctagttgggttataatgaagtttagttgggttatgatgaagtctacttgggttggtcatgatgagatctagttgtattagatcctgatgagatccagttgggtaaggttctgatgaggtctagttgattggtcatgatgagacttagttaggctataatgaggactagttgtgttggtcaggatgagatcaagttgtattaggtcatgacgagatctagttgggtcaggttgtgatgagatctggttggttggtcatgacgagatctagttaggttatgaggaggtccggttgggttggtcatgaggagaactaattgtattaggtcttgatgagatctagttgggttaggttatgatgaggtctagttgggttggtcatgatgagaactagttgtattaggtcatgatgagatctagttaggttctgatgaggtctagttagattggtcatgaggagatctagttgtattaggttatgatgtgatctaattgggtgaagttattatgaggtctagttgggttggtcatgatgagatctggttgggttaggttatgatgcgatctagttggttggtcatgatgagatctaattaggttatgatgaggtctatttgggttggttgtgatgagatctagtcatattcagtcatgatgaggtctagttgggttagattatgatgaggtttagttgggttaggtcatgatgaggtctagttgggttagggtatgaggagatttaattgagttaggttatgatgaggtctagttgggctggtctttatgagatctagttgtattaggtcatgatgagatctaattgaattatattacgatgatatctagttggttggtcatgatgagatctagttgtattaggtcatgatgtgatgtagttggggtaagttatgatgaggtctcattgagtttgtcatgatgagagctagttgtactagatcatgatgagttatagttgggttaggttatgatgagatctagttggttggtcatgttgagatccagttaggttatgatgaggtccagatgcggtggtcataatgaaatctagttgtattaggtcatgatgagatctagttgtggtaggatatgatgaggtctagtgcattggtcatgatgagatctagttgtattaggttatgatgagatctagttggattaggtcatgatgagatctagttgtggtaggatatgatgaggtctagtgcattggtcatgatgagatctagttgtattaggttatgatgagatctagttggattaagttataatgggatctgtttggttggtcacgatgtgatctagttaggtcgtgatgagttctagttgggtaggtcgtgatgagatctagttgtctcatgtcatgatgaggtctagttgggttaggttatgatgaagtccagtttggttaggtcatgatgaggtctagtgggattggtcattatgagaattagttgtattaggtcataatgaaatctagttggcctaggctatgatgagctctggtaggttgttcatgatgagatctacttgtattgggtcatgatgagacccaggtgtgttaggttatgataagatctagttcgttgtcataatgagatgtaatttgtttatgatgcagtctagttgtgttgctcatgatgggatctagttgtattaggtcatgatgagacctagttgggttaggttatgatgaggtctagttggtttggttatgatgaaatcttgttggattatgtcatgaggagatctagttggatggtcatgatgagatataattaggtcatgataaggtctagttgggttggtcttgatgagatatagttgtattaggtcgtgatgaggtctagtttggttaggttatgatgaagtctagtttggttaggtcatgatgagttctagttgggttagggtatgaggagatttacttggataaggttgtgatgaggtctatttgggttggtcatgatgagattttgttaggtcatgatgaggactagttttgttggccttgatgagatgtagttgtattaggtcataatgaagtcttgttgagttaggttatgatgtagttaagttgggttaagttatgatgaggtatagttgggttggtcatgatgagagttagttaggtcacgatgaggtagttgggttggtcatgatgaaatctagtcatagtcagtcatgattagttcttgttgggcttgtttataatgagatttagctgtgtcaggtcatgatgaggtctagttgagttggtcatgatgtgatctagttgtattaggtcatgatgaggtctagtttggttaggttatgaggtctagtgtcgttggttgtgatgagattcagttaagttatgatgaggtgtatttgggttggtcataaagatacctgtttgtattaggtcatgttgaggtttatttgggctaggttataatgagatttagttgggttaggtcatgatgaggtctagttgggttagggtataatcagatctatttgggttaagttatgatgaggtgtattttggttagtcctaatgagatttagttgggttagagtatgatgaggtgtagttgcgttggtcatcataaaatctagttttgtaggtcacaggaagtctagttggttaggttatctaaattgcaactgtcttttaaaaatgacttgtgccacatatactttgtattgtccatgaatagtacatgtgaaacgtgtaaaatatttaaacttgtatttaattatctatttacttattttaatagacaaaaacaagttacatatttttatggtgtacaaaatgtggttttgatatatgtttccatctggaatggccaattcaagctaattcacatatccattaccttacatgtttctttttgtgtgtgtttttggaaacacttaaaatctactctctttgcaattttcaaatattaattatagtcactgtgactaattatagtcaggttcaagattatagtcactaatttagtcaccttaagtacaatagatctcttgaacttataccttctgtcaaactgacatttggtgtcatttgaacaaaatctcagcaacccacccccctagcacctggtaatcaccataattctttttcttttctttctttcttttttttgagatggagtctcactctgtcaccaggctggagtgcagtggcgcaatctcggctcactgcaacctccacctcctgggttcaagcgattctcctgcctcagcctcctgagtagctgggactacaggtgcatgccaccgtacccggctaatttttgtatttttagtagagacaggcttttgccaggttggccaggatggtctcgatctcttgaccttgtgatccacctgccttggcctcccaaagtgctgggattacaggcatgagataccacgcctggccaataatcatcataatactttttcttgtgagttcaacttctggagactctacatatgggtgagatcatgtgggatttggttttatgtggcttattttacttaacatgatgtactcctggttgatccatgttgtatcacaggatagggtcctctggttttcaaagactgaatggtattccatggtgtagctatcccacattttatttatctacccatccttagatggacacttaggttggtttcatatcttggctcttgtgaatcatgctgcaacgaacatgggggtgtagatatctctataaggggctgatttcatttcctttggatctatacagaggagtgagattgctagatcctatggtaggcataatgatcattttttgaggaactcttaaaaaaaaaaaggccacccctttagacacaccttaaaatccaacctttctggtcaaagacatttgaaaaaaatgacgacaacatcaaactatagtctcctgtccaagcacgttcacttcctaagatgtgaaaaaaaccaggccgggtgcagtggctcatgtctgtcatcccagcactttgggaggcaaaggcaaacgggtcacccgaggtcaggcgttcaagaccagcctggccaacatagtgaaaccccatctccactgttttccataatggctataccaatttccattgcacatataacatgtaacgccctcccctgcccccccaaatacaaaggatgaagcagaaggcagatgcactgtgtttgggacgtgtgcggtgtttctgcatatgcagtacttgctcagcaaatgtaggaaccactccagcaaatgcatatgaggccaaatgtcccacgtccagttccttaaagcagctccctccaggtctgaggagacaattgctgaaggtgacattggccaaagaagataccgcacgtgccacctcaccttctccattcctccagtgtggtgcttctgtcctatgccagcgttgacggtgccaccatggaaaatggcctgcccatgaaggtggtcttcccaaataatcacttcacctggctttttttgatgctcccagctttttctggtcacttttgtctttcttgagaaggtggaggctcccatcttacttcgtcccagcttccggcatgtttccctttgtttttttttgttttgttttgttttgttttctttttgagatggagtctcgctgtgttgcccaggctggagtgcagtggcgcaatctcatctcactgcaacctctgcctactgggttcaagcaattcttctgccttagcctccagagtagctgggattacaggtgcctgctaccatgtctggctaacttttttttttttttttttttttgggacagagttgggctctgtcgcccaggctggagtgcagtggtgtgatctcagttcatggcaacctctgcttcccgggtcctggttcaagcaattctcctgcctccgcttccctagtagctgggattacaggcacacatcaccatgcccatctaatttttgtgtttttagtagagatggggtttcctcatgttggccaggctggtcttgaactcctgacctcgtgatccgcttgcctcggcttcccaaatcccaaagggctgagattacaggcatgagccaccgcacccggccgcaccctttgatcttgagatggctgatacggcagagcagcccagcagtggatgagtgcttacatttaaaaagttcatgggatttcataaataagctcatgaatgtacaagtccccagtgtaaaggttaccttgactttgaatttttttatcctttctttttttgttttgtgtttgatgcataggacatttatagatggaatatacctttcaggctatttcttcctctccctcccgtcgaaacccacctccctgaaatgcctgctgcctcctcagtgccaaaggactgtcaaagcaaaaatgtaataatggtatcatgttctgtttctttaaggaagtcaaaggtgcaaattacctttgcagcttcagtcttctgatgtctgcaactttgaattccttcaaggaagtgacaatttagatattccatttactctgccccaaaggatggactttgcactatttatcttagccgtctcccactggagccaaaaacatttccaacttcataagtttcactgcttctcctcttttatatattttttcactctttgctgaaaacattttcattgttttttgaaaagtgcattctaatagttaatttgggagcccatggccttaacacagaagaaagaataccgaatacaatgataggatatcaaacagcatggtctcttccttgtgttagagtgtgtaaattcaatacgccgtgttgactcagtattcaggaatgccaaagagagggattatttggtaatgtattttcatggagacccggggacggtgctgtactacagaacacctcactggcccgggctgggtgcaggtaggatggagatagaccggccccacccccttggtaactgctccttgcagatcagctgtttgaagctctccgggcacccaagacgttcttgttcaagcctgtgcgcttcccctgctagttctcatctcccttctctcaacactttttccgtgaccctccctgaaagggagttttgggcttggctcaccctggaaagcagctaatcccacatgttgccaacaggttaatgaaggatgaggctgaaggaggaaaaatttgccaaactcctttcccctaaagagccgccccttcagaaacaccttaaaatccaacctcccgggtcaaagacatttgaaaaaatgacgaagacaacatcaaactatagtctcctgttcaacgcatgttcacttcctaagacattaaagaaaccaggccgggtgtggtggctcatacctgtcatcccagcactgtggaggccgaggcgggaggatcacctgagatcaggagttcaagaccagccttgccaacatggtgaaaccccctctctactaaagatacgaaaaaattagctgggcatagtggcagtcacctctaatcccagctactcaggaggctgaggcagcagaatcacttgaatcagagaggtggaggttgcagtgagctgagatcgcaccactgcactccagcctgggcaacagagcaagattctgtctcaaaaaaaaaacaaaacaaaaaaacaaaacaaaaaaacccaattaacattctttcaccccggatttcctagtctttattttagctataacaagcaaaacacctctttccatccttctaaaggcgtgttcctgaaacctcacttggagagttttacggaagtgcagtgagaggagtaagaaatcctgagcacacagccaactaacgcaggaacagaaaaccaaagaccccatgttctccttcataagtgggagttgaacaatgagaacgcatggacacagggaggggaacatcccacaccagggcctgtcgaggggttgagggggcagggcagggagagcattaggagaaatacctaatgtagatgatgggttgatgggtgcagcaaactgccatggcacgtgtatacctatgtaaccaacctgcacattccgcacatgtgccccagaacttaaagtagaattaaaaaaaagaaacagaaagaaatcctgagcacgtagtaggaaccacggtctgtgatcacgtgcatcgtgcagtctgtgtgtgcacactgggatgtttccagcataaaagctccttcgaaaattcgtttccatcctgacattttaatgcacattttttatgcttatgctattctcagctctcacgtgcaaattacaccagcaggtgccccgggtccctgtcactattgaaaagtagaatgtcaaatgcatttgtactttttgccaatgcaggctaaagaaaatgactcttaaatggatagctttagtctgccaaaatggctgtcaagttagacgctaggataaagggaaagtccatcaaaggcacatttcagatttgtgttatacttctcttaaaacctctttttttttttgcagttaatagtttctggataatcctacaagtcaccgtatcttttttttctttttccttttagctggaaataatgacagcaaagccaaacaagttgtaagcaaaataaaagaagaaaccttgaacgacaaa

SEQ ID NO: 36325 - DNA, 86535 bp, Homo sapiens
gtccggcagccgctgctgctgctgctgctgctgctgccgccgccgccgccgccgtccctgcgtccttcggtctctgctcccgggacccgggctccgccgcagccagccagcatgtcggggatcaagaagcaaaagacggtaggcttccaggcgccggcttccctccccgccaccgcactgcacgcgccgacccccaacccccaattccccggcacttgggtcccaccctccccgggagggggcgtcgggaggaggagtaagagtggggcacggagggaagcaagagaaagaggctctgtgtggaattcccggggcagtcctcgccccgcagcccctctccaccccgcgactctgggaatctgcgctccttggggtcgccgcgcccgcgagagacctcccgagcttctcaagtgggtccggatctagatccaggaccagggacaggaaatcccctttctttcccaagagctcttccagacccgccttttcttctgtagggtctcggagcagatcgagctgactcccgttctgccaggtctggtcgctggggttttgtctatgggaacttccttggagtgggctttaatgacggactttcatagaggaaactgcaattatcaaagcaaactggaggaaattgcatttctacactggcgggatttagccctctagcttgatttcggcattgggtggcatctcgagttcagtaatgaggggtgagggtgcccctcggtttggtggagtaagatgaggggactgtgttgaggaggcacacttttacccagaattaataatctgagctgtcctcctttaatgggaaatatgagggcgtgtcaaagagaaaagtttctttcccagcaacatgggcacctataaattttgcattcttaaaaatggcagcagttctatttgtcaattataccccaataaactgaaaaaaaaaaaaaaaaaaaaaaaaaaaaaaccgggagcagtaatcatagactcttagagttggatggcgccttctagacagcactggggccacgtcagatgtggtcagcaagccttgataaaatcctactcagcagtttggccgctgaacattctatcttcagccaccaccctgcaagcctcagatgattgtactggttactgaatgggttgacctctctctagtagatagacgtgcaatggacacatagtaggtgcctgataaatgtttattcttatataatgtgtattaccgaaatatctttgaggtgtatttgtggtgggccggggagaggtttaaaaaaaaaaacaaaatataaagccaagaagtggggaaggagtgtggaggggccatgcagggctagaagggtcatttgagcagcaagagaacagggtgggggctctgtggctccagggaccatactggaccagcaggagggtccagggtgtaggtggcatcaatttgggaagggacatttatcaaaatccagctgcctttctcaggagtaatttttaagtgggggactctcagcgttgtaacatatttttgaaataataaatgaaaatcacttgtattttgttcctatttaatgcgattaatttctgtaaaatcctaaatagtgtcttctaaatggcaagccgctgtgccagtagctttttatatcagtggggttttaattcccaccttcctgcttgcatcaagaattccttctcagttgtgatgggggactttgtcaagcattagaaagggacgaggtggtctctcctcttgatgcctccagtcggcaggagcccaggaagaggagggtttgagaacagggtcattacaaatcaattgcgggggctctgcacagtcagaagcagtgagaaatttgagggccggagggtttggtttttgtatttacacattctgaaccttctattttttgttaggtgggtgtatgtgtgtgtctgttttatacagcattaaattaactcctgaaacagctaactgaaatagaacttttctgaattttgatttagtctaacgcagttataacccaggcaccaacccaagttcccaaaagggctagataggtactatcggtactatttacagcaagccagctgtaaatgcatgtggaatctctcaagctttgaatgttcattcaaaatgtgttttgaaaccttgcaggccaaagcaaaatctgtccgcttgtgtgacctctgaactaatcaattgtttgataagtattgctgacctcacaagctagcctaggagtgagactgagctgatcttttacggtcttataggaatcatcacattgtttactgcactgtcaacagaggacagttaattcacacagcagccactacagtaacttcaaatatttgttgagcacctactgtatgccaggtggtatactgggtgggggaggcggaaaaggagatacctcttttccaggtttttttggccacactctctggatgaatattgcctttcagttcagaccactctaggaagaggagatagttttggtttaaatgagagagtgtaggatgactttttcataagctttagaaaaaataaattaagtgttcttttataaaggaaggtagcacattccttctgttttatgcatctttaccatggaaaccaaagaaacagctaccagtcacattcatcccttcatcatttccacccctcacttacctccaaccctggctaccctcccacccccaccccctatacacacacatagacacctaggagagggaaagggacagactgcctctaggggactggaaagaagggaaggcaaaggcctgggcctttcctcttacatcatttcctggattaacatttttcaaggcccacagacagtgctgttatgttctggagacacccaatctgaaaacattgactgagatattaagttatttccgaaggatcaaataggaaaacaattggaaaggagtgaaaagatactgaaaaccacagcgctctccatagatgtaagggattatcaaccttttccttatttattttctttctttctttttttttttgagacagagtctcactctgtcacccaggctggagtgcagtagcgtggcatgatctcagctcactgcaacctccgcctcccgggttcaagccattctcttgccccagcctcccaagtagctgggattacaggcaccaccatcatgccctgctaattaccttttccttattttcagaattgtgcacagtataacattatttttctagaagtagccactttttttttttttttttttttttgagatggagtctcgctctgtcacccaggctggagtgcagagaagcgatctcgtctcactgcaacctccgcctcccgagttcaagcaattctcctgcctcagcctcccgagtagctggcactactggtgtgtaccaccacgcccagctaatttttgtatttttagtagagacggggttttgccacgttggtcaggctggtctcgaactcctgacctcaggtgattcacccaccttgaccttccaaagtgctgggattgcaggcttgagccactgcccccagccagaagtaattacttttaaaactatataaagacactaccgaaggcaagacatgaattctagatgagcaactactggaaggagggacaaaaagcatttcctagaggccagacactcagacatctcatccccacagtagctctcatctcaggaaacagctttgtcttcaggggaggagaaataccaggggcagggcactactgaaattcaggtctgtccagcttcaaaactcatgctcttgaccccctccgtacttctgtttcaggatgtaactgctctggcccaaagttttctcatctgtaaaatgtgggtaataataactttccccttacaattgtcgtgaaaagtaagtaactcctaaaaattgtcttgctcagtgccagacccagagttagtgcttcatatgcagtagctatttcatttgtattaaactatactgtcatggtttggcatacataaaaagaaaaaacagcacacatcatactgttttgaagactcagtaaatgacaacagccagaatatttttgttttgttttgagacaggctggagtgcagtgctgctataatgggtcactgcagtctcgacctcctgggctcaagtgatcctcctgcctcagcctcccaagtacctagtactacaggtgcacaccatcatgcctggctaacttttaaagtttttgttgttgttgttttggtagagatgaggtctcactctgttgctctggccagtcttgaactcctgagctgaagagatcctcctgccttggcctcccgaagtattaggattgcaggcttgagccactgtgcttggccagccagaatatttaataaggaaaaacaaatgcagaaatatagaggtgacaatttgaattcttattgtgataggctggatagaagacactggttgacctctggtagaggtaccagagtatcagtgagtttttgccaacaactttggccaagaaagataatccatgcatagagtaaatattggactaacttctctccacccttcctgtgccttcaactattcctatgtgcaccttaaaattagtgtttcccaattcatgccatcgccatttattagatcatctgtttggactttggtgcggttaaaagataaatgtggttaactcagttatatgtctctttgagatagttatctttgtcttttatcacttttctgttgatgcatgtggctctgtggtttgctgaggggataattaggcttacctctaacatggaacttttagggaattagagtctgggaaaggcatcaatgatgtcaatctcagtcctaggagatttctgtttatttcaaaatctatcactaaatagtaatgggcactcattagtctttgtgtttggaagtcttaggaaaatgcagaaactaaaggtaaataaacataaatataacactagttcaactgttctattagcccctaggtgatttgttcatatgacacttggaacagcttatatgcccagcacctgacagtgatcctggcacagattaggtgttcaatattcattgaataaatgaatgagtaaatggctagagaattcattagaggatgtatttgctcttaggatccacattttttcctagattcctcactctcccctcttctctttgtgtgcttggttatttttgactgggtatttgtcattactgctgaaaaattgcttgtagagattccttcaggcctaggatgaatgactttgttttcagagaggatttgcttttgtttctgccaggtgtctggccccactcctagcctaggactcctttaattgaatttaccactttttttttttttggagacagagtctcgcactgtcacccaggctggagtgcagtggcgtgatctcagctcactgcaagttccgccttccgggttcacgccattcttctgcctcagcctcccgagtagctggaactacaggtgcctgccaccacgcccggctaactttttgtatttttagtagagacggggtttcaccgcgttaaccaggatggttttgatctcctgacctcgtgatctgcccgcctcggcctcccaaagtgctgggattacaggcgtgagccaccgtgcccggcctgaatttaccactttttaaagacttaggtgatgtgaatttggattgctattttgcacatgagagccagcttgtgaatacaacttcccagggaccaccctccccttttatactcactttctatgccaagacaattgtccttgccgtctctctgagtgggaggtaggtttattctggttcacccttatttttagagtgtagggtttaggagcccagcttaacttgaggaagacctttttttattttcacttgagtgggttctgggctttaatttctgttccacctctctcagtgaagctgtcaaaatcagttcatgtatgctcctctcagcaaatatgccccataaggataaaagtgcctctctgcttacttatctctttgagttcttgctttcttccagattttggcctagtagtttcttcctattttgtcagctatttgttgttttaatttttttttctttttttttttttagatggagtcttgctctgtcacccaggctcaagtgctgttggcgtgatcttggctcattgcaacctccacctcccaagttcaagcgattctcacgcctcggcctccctagtagctggggttacaggtgtgcaccaccacacccggctaatttttgtatttttagttgagacgggttttcaccatgttggccagactggtcttgaactcctgacctcaagtgatctgtctgccttggcctcccagagtgctgggattacaggcatgagccaccatgctcatcctgttgttttaaatttgattattttatgttattactagcatttatagttattttcagtggaagcatcaatctgaataacctacccatcactgctggaaacagagacctctaccctttctagattcctgtgaatcattaacatctcctatcataccttaccagacctgtgtcgctgtcataaaaggagtactttttaaacatgaactctagtcagatagctagtcaaaaatctttgatttaatcctttttccctaggatgtgctacagtgtggagtggggagtgctcaccttgtcttggtggtctcttcctatgcagacatccttagagatgtgcattgtcctgtccaatccttagtgttggtccaatttcaagtgcgttcttgtctgaaaggccccttcaatttaaacaactctccttacttctttcatgctctcctgggtaccctgaggccgttttgttgctccagcacaactctgaggtcgtggggtatgaatttggtgggactagttaaggtccttgacatgtccccactactcccaggagtgtaggaactaggttcctactttgctgtgaccatgcagggacttggaggagctctgggggctgctgaaacccaccctcttttcctctgagatcagaagcacatccaatgccctctgctttcagagcccccagggctatttggcctccctcttccccaagctcagcaccaggggcaggacactactccctgtttcagactcagactggtacccaagcttgctttgcttctcttttaataaagattaaagctttcccaaaaggttaattggtttatcataagcattgaatttgttataaattttgtcttcttgttcctttttcctgtctttttgatcaccacatttttgaaaaatttacaataaattggctgggtgtggtggctcatgcctgtaatcccagcactttgagaggctgaggtgggcggatcacttgagcgcaggagtttgagaccagcctgggcaacatggcaaaaccttgtctctacaaaaatgcaaaaaattagccaagtgtggtggcgcgggcctgtagtcccagctatctaggaggctgaggtgggatcgccccagtactggaggtcaaggctgcagtcagccatgatcatgccattacactccagcctgggtgacagagtgagaccctgtctcaaaaaacctcaacaaaacaaacaaacaataaattggtgcacaagatgaaaatattttttctctgtacaaaagagccactgtattaaaacttgaaatataagttgcctctgatgacacgtggtgtataaaatggattccatcagttgactgatgtgacttcctttaaaatcttatcagcatccctttctgcatttcaaatttactactgaagttgattttgctgtaattgatattgtgcaagcacgactgtaatataaacatgacaaactcaatctgtataccatcaaatattaacttttggcaataaatgcatatagcctgtgacaataaagattttttaaaacagttacataaatatattatgtcaaatgctgcatcattcatagtgataatttctctgctagtcaatatttggtttaaatgtctagttaacacctgctttatgttttattattgatttattatgaaaagtattgatttttatccaccaagcatctatatccagtctcataccacaattacttttttaaaacaattttatgttgggtgtgtgcttttaaagacatttgtagactttatggatttaaactacctggaagaaaatccgagattctatccctataaactttattcttctacaccctcctccagtcattattaatttatgaataattcatgccttcccaatttccagcaaagtaagcaactcaagcattagtgatgattttattttcatacatttgctagtgttaaaaacctgaattaactttttggccctctgctgggggtcccatgtgtattactttgtttccttaagctctctaaaatcctttcctttttcagttcctgtcaaaatcctcacgtatatatttgtttacctcactcactcaacaatatttattgaatgaccaaaccaggatctctatttgtcataattaacaatagctaccaaagccttatattctttaattatagtttttagtctattcactgtctttaagtctattctaaacacagcatttgccttttctaattgaagcactccacccgcacctttatattatcaacgttctgcccagtaagtcttgcagtggccttgagctaaaagcaataaaattcccaattgacttttcttacatttcctcattcatttttctactaagttgaacattatttactctatattaaggctgtctctactttaaaaatgtgtgtgtgtgtgtgtgtgtgtgtgtgtgtgtttaaaaataattctagtattttacttctggaaggaaaattaggaggtcacctttaagctctttatatgacagttgatatacagcgttaagagctgtgccaggatctatggccattctttggcttgactgggtggggatacttccactaagctagaactctgatcaccctaccacacgcttaccacttctctctttatcacgtgctctttgaaagtgaccctgcctattttctacagctttatttcctctttcattcaacaagaaatattttccataaacaaaacttcctcccagttggtttattacattctgacttagctttagcattttgttgtggcattctggggacagaaaatacagaccaaaaagcagtatttgaaagatgtaacttgaccgttttgaaatatttttgattggccggactgtttctctttagaaaattcaaccctttcccacctcactcagtcttccttaaaccttctcaagtggtttaattgttttattaaaaaaagggatgccattgattagatagcatgcaatgcagaaaaagttgtatttggtaaaggctggaccaagttcagttatacgccaaagcctcagttcagttttacctctaaatctatccatttccattgcttcctcagttcgcaaagtactatgaagtcgattacagtaaccatgtgtggtcttcccaggacctaaattgctgactcccaatagagagtgttttcctaaagtatatgagtaattatggctcttgggccattgggtcactagtacaacaatgttttgagtagttactaaaaaataaccaaatcataactaaaataatttttcatttgacctttaagttagccaacagaataagaagacatcaaataaagcctagacattaaaattccgattgtggaatgtgcgttatttatctgaagtttctttttttagagcatgtgttgttagaaaattcctactctgttgtattctgttcattgccacgatttattgagcactgacctgtaggttaactcattgactcttcaccatctcgcgaagcaagtttgtgaataaatagtccaaagggaactcatttaactgaaatgggtctttaaagagttacccaaaggagaagttagaatcttattagcttctctgtagttaataagatgtttatttcatagaggcaatgacacttcatgccatgtagccaacacagctagattaggtaactagtaatgtattactgcttcatttgtaaaatattctggcagctgtctactgctagtatctcaagataataataatgaattctattgagaagcattccccagcacttttattaaaaaagagtaagtggcataaattggcaaatacatgttaccctcactatcacacgcatttctttctttatggtaacataaggtgaataattggaaaataaattttatttgttctcagactcaacctgtatgggtaatagtttttattgcctagccttacggctatgtcagtattcagcaaacgtgaacagaataatttgtttccactagctgcaatacttgaaccaagttgtaatattaatatgatttgtagataataaaaaagaaagtagaacaccagtgcatttttcacataaaaatttgacccagttcaaggtcgacgcttaaggatgttgtcaaccgatcaatgaggagtgcctagaaatcatgggattgtaaaaggtatgttccttggtgtttggaagaaaaattagggagcgttgtctccttctaacacataggtaagggaagtccaagtttttcagcaatcctgggctagtgtttcagcgataggtactaggaaggttcatattcccattctcaggagatgattgcataaaaagatggagcacacacacacacacacacacacactcatgctgaggagagcagcattggctgggtgtatttcaggggatgaaattgaagtcttttactggagaggagctgcattatttaaataaaaagaatcatggtgactgcatagaagttgaatcacagaatttgtgtcttcacagtgggatacaaaattctgtctaaaggatgtgttgtctctgcacagttagtcacatttagggaatggaaaaatctgggtcatcaaaaatacccagtttcttccattttcttctcagtgttgaggctgtgactcaaaaagtctcttacacatcacactgtgttattaatccttgttgtcataataacatcccttgggattcaggaaggcaccttgtgtacccaacagggttccccaaatagaagaagggaacaagcatttatccagggactatccatacagtatcccatctcatcctcacaataacctatgaagtagttcttatccctgctttacagtagggaactctgagcttgtagagactaagtaacttgcctcaggatgcataaccctaagtggcagagctggaacacaagtgccatgttttcaatcattcttttttttttcttcagttaaaataacatataatggatactatgactgtgagaatgcaaaaggatcttttgattatttaaacatgcattttaattttgtctttgcagactaaaaggatgatgcaggcgctttgaaagggatttccttaggggctttttgtaatgttgtgtaatctttagaagatgtagattttagcaaatgctgttaaaaggcaataaatgttagtttggatgaggctctgtggccagttttaggaacagtagtctttggaattgaacccaacatttcaccttaagaatacaaggcttcagtgttctagtgggtgaatgcatacactcaagaataagtgattttagaaataattgcagtgacttacacataactctacacccagccttgtccattatgtgagtgctgcacagtcgagcattcatgagttacaagttcccaaagccccacaggctatgggcctgttctctggatgtactagaggtttcatcagcatttccattgctcagcacagaatgttaatatttcgtggttcagggagattgttttatatacacagcctaataaccagaaccaattgagaaaaaaatataaagaaaatacagataggtagcaaagtacagcctacagtggaacaccaacagggctagtgttaggaggggcagctgagacctgggttgaacactgtaattgtgtggctttgagcatcttctgattgaagttacacatttcaggagactcaattttatgcacgtggtattgccataagggtaattgctacctccctgtattatagcggagttcctctgggcatgcataatacctttctttcatcatgctcatcaagacttattcatactttgttatcaattatcctagtagctctacatattaggtagttacaagtattacaaatcatagattaggccactaacataaagaaatgaggtaaattccctgcagtcttcttgtggggccatgtaacagtagagaccacttgagtttgccaagtttggtggccaagtcccatgttttgtctgagaacagacagaggctcagggatattgggatgatatttggtatgaagggtttcttatttggactgcaccaagttaactgtgtgctgtgaaacattatatggcttcattttcattgggagaactagtgatataaatgatgtaacgtgaactaagtgatttagctaattacacatatttttggatgcttctaaaaaactaatatgtgatccttggagtagaggaagttgtacattcaaggttttctaccctttttgtgtgtgtttattttaatgaggacaatgggaactacaccatttctttcctgttagttcatcctggattacctttttatatccattaaacatagaaattctgaagccatgtctgcctacatgtcatcctgattgcctttgtgtataattgcagatcaaatgtagaagcagtgactacttaaaaaaaaagttgttatagaccaaggcttgaggaaagagaaaggtacagtgacaatgagatatcttgggggaaatttggtcccgtagaccaggggttagcaaatcatatcctgtgggccaaaccacagtcacctgcctgttttggtaggcctataagctaggaatggtttttacatttttttaaaagactgatggggagaagtgaaaggaaaaattatattttgtgttatgacaagtatatgaaattaaaattttagtgtctataaataaagctttcgaaacgtaccatgcttattcgtttacacattgtggcttcttttacagcaaggatgggtatttctgtgtggcctgaaaggctgagaatgtgtactgtctgatcctttaagaaaaatttgccacctcctgttatatatagtgggggccagtgttcagttggaagatgcttaggcccatggcctgtcagcgtgtaactctatgtgtctgaattcagagagctgagtactagctgtacttcatgagccccattgaattgtgtttgttgtattgtcattgttttgttaaaacattatttttttaaagttctgtggaacactagtgtgtctactgtaatgatattattcagattatttattaattagaacattccctttataaatatctctggaattttctttgtttttgtttttgtagagatgggtctccctatgttgcccaggctggtcttgtactcctggcctcaagcgatcctcccaccttgccctcctaaagtgctggggattgcaggtgtgagccactgtgccagcctgggattttcttcatattctctttataaaaattcatagagagacatttctgtctagttttactaccagaagggttatatttttcttagctgtgtgtgtgtttgtgtgtgtatgtattcatgtgtgtgtgtgtgtgtgtgtgtgtctaattcctttgcgaattttgggaccatccaggttttccccctcaagatgcctgccagaaagctcagaagtgaatttttggcttactttttttttttttttttttttttttgcaccagctttatgcttggtaccacttcgttttatgcccctgggttgttctttcctttttcttgtccacttctgattcatgagtttttgctatgctttatgaatcttctaagtcactgaatacttttaggaactctacagaacattaaaatataaaattaatagtaagacatatctgaatttttgttctagaaggtcccagagctctcctttaccattctacctcagagagcccttttccttctgcatgttatcttgggactgtccagggctctatgcctgcagggcctagagccagtccatgaagtgctcattgagtgctttgtggtctaatgttctacccttcctgcaagcttacaaatcaaccccttcaagactgataaagacagagcagaggttctttagtatctagagtccccagaagtcaggaaggttgtgaacttggatgggtaaaaaaaatttctgttttgagatgaagtcttgctctgtctcccaggctggagtgcagtggcacgatctcggctcactgcaacctccacctcctgtgtccaagcgattctcctgcctcagctctctgagtagctgggattacaggcacgtgccaccacacccggctaattttttatatttttggtagagatgggttttcaccatgttggccaggctggtcttgaactcctggcctcaggtgatcctcctgcctaggcctcccaaagtgctgggattacagatatgagccactgctcccagcagtaattttttttttataacttgtaacagaaatttggcattttcttcaattatgaagacaggcaacaaaccacagcaatattagcaatacttgtgactatgtcaccagtagaaaccacagatactttaatatcagattatatcgttgcagatattgcaaaatatctgtgctttttataactagaaaattaagatctataaaaagatctataaaagagttataaaaatacttcaaaattaagattataactgtctacctagacagatagttcttgttatttaatacattgctaaagaagcatatttattaccgtgctataatttttaaaaagcattttgttaccgtaattctttttcttttattggcaatcctttgtgttttatgcatttaaaaacacttttctgagaggggatccataggcgaccataggggtttttgactccaaaaagggtaagaaacctccatgcatgggtgtgcccacatgcatgtatgcacacacagacacagatacacaatttttacatatggtttcaaggagttacagactcctcttacaagacccatatctaggaactgcagtttaagatcttatgccctgttggctaaaattcaaaatagcaggccctaagagggacggcctttattttgtctttttaaaacactattcaaatgaatcttttctagtaatgacttacaacaccctcttagtcatagcattagcactggctgttatcatttagtattacctctttcttctataaaacaaggaatgtgtatgtagttatgaaatcattctcttggtttataccatatcaactagatatttgtcagtgaaaaattgaaaatctacctcttcaccctctttgaattgtagtttgcattaaaaagattcgcatatttgaattttcaaaacttggtatgtgtgtattttgtaagtttggaattggataaaaattacaaatattataataagttaatgacataatcccttttgtattcttctgtgtcttgagtggttttgttgctgtaagtcaagcacatttattattcatgtataggggggccaagtttcatctgagaatgtaatttcatgctaataggttgcgttgtaagtccctggttaggatttacttatacctgcatgggttttatgcttccctgtgttccattcattacgctgctattctgaatgcatctcctaatttagtgagatctgagagccaccttagagattacgtagtccagtttttctccaccctgctaagcttcacaaaatattgatgcctggacctcactcctagtgaatatgattgaatggatctgtgttggggaatggaggcagtcttcaaaaactggctacaaggtttcttggttcagccaggcttgagaacctcagcctagcctaattccttccccatgcaaatgaaagcattgtaacatgcctgagggccaccggctcagatgagttttctctacttcagaaagctattttccctttccacatttcttttttttttttttttttttttaatgtaaagccatttcccagccagtgcagtcttctgtggtcactacattcctcatggaatatttaaaattaaatattccatgaggaatgtagctggaacgtttaaaagcttactatccttgtcctgttttaccgttacctaatgggaagacagctttctggaaaaacctgaagaccattctttcttagtgagctgttcttgacggtggtgactttatctttggaaatttgcccgattcccatatcacaattaaggaagtggcttaagaaagtagcttgtaattctctagagtgtaagtctccagatctcactgttgaactttgtatgttccagtaggactaaatctaaaataatttccttgtcacatttgatagacatgagtattagggacccacattggaagaaccctccaaaaacggacctgtctttcctttgtgagttttcagtgtaattctagcatttctgggagaaatatgtaagtacctcaagggcagaaatcctgcccacttaaatgtttcataattatcacctaaaacttagaatggatcaaattaactaattagctttgtaccttttcaacacaagctaatagattgcctgacttcgtttatctgatcatgaattttgatcaactttatctcattaggtttaaaaattaatatgttgcgttatatagcacttatctttacagagattattcatcttcaatgcaataaataaaagaaaagccaagccaggtgtgatggcacatgcctgtagacacagctacttggcaggctgaggtgggaggatcacttgagcccagcggttccaggcctgcagtaagcccagattgtgccattgtactccagtctggatgacagaatgagaccctgtctcaaaaaaaaaaaaaaaaaaaaaaaaaaaaaaaaaaaaaaaggccggatgcagtggctcatgcctataatcccagcactttgggaggccgaggcaggcagatcacttgaggtcaggagttcgagaccaacttggacaacatgatgaaaccccatctctactaaaaataaaaaaattagccgggcatggcagcacactcctgtaatcccagctactccagagattgaggcaggaaaattgcttgaacccgggaggcagaggctgcagtgagctgagatcacgccactacactccagcctgggcaacagagcgagactccatctcaaaaaataagataaaatgaaaagacagatatttaatgcagatatctaagctttaaaagattggatgactcaagccaatggcaattctttttttctgatttacagttgtgtttttttaaagatggcaactttgttttactttcttcttccttctatattattttgaagtgaatttgactgcaaatattttgaaaaatatatgcccctatgtattgaatctaaaaagcaattacaatttgtccttttcctctaattctcctatgcaactatcagaatggaaaataaatttcaggatacttttggatcaaaaatgacagaaatcaaattgcttgacatctagtaaccagagtggacatgaaagaggagtcaattctacagcaagccctgtaaccagctccgtgcaggagaaacatggagaattaagacaatcacctccctctaagaagctttgtgtgcttttcccagatcttcattttcataggcagtatgatttcaaaatgttgtccagtaaaaactctttatcaagttataactggaaagctacccactatctctttatataatgacagcatccactatgtaagatttatattacatgcatgcgtgtggaatgtactttgaaccactctctaactatgatcataggtcagtacctgccagagaatggagatttttaaaaattgtgatcacagatttgagaatataatctttttaaaaaagatatgcttagccttgtaaataaagataagcattttaagaatttattttataaagaaaaggtttgatggagcaaagatttaagcattgagaaacccatagacctacaagaaaaaaacatgaatcttatataatcacagaatggggaagaccacttctaagtataatacacattcagatactataaatttttttgaatataaaaacttttttttcccagaaataaatctgcatctttatagccaactgattttctacaaaggcgccaagactatacactggggaaaggataccctcttcaataaatggtgctgggaaaattgacgatccatacacagaagattgaaactggacccctgtctctcaccatatacaaaaatcaaccgaagatggattaaagatgtgaatataagaccccaaactttaaaactactagaagaaaacacagggaaaacacttcaagatattggtctaggcaaatattttatggttaagaccttaaaagcatagacacctaaaacgaaaatagacaaattgaactatattaaactaaaaagcttctgcacaacaaaggaaacaatcaacagcatgaagaggcaacctgttgaatgagagaaaatattgcatactatcttctgacaagggactaatatccagactatatcagaaacccagcagcgtaaaaaaaaaattccattaaaaagtgggcaaaggacatgaatagacaattctcaaaagaagacatgtaaatggccaacagatatgtgaaaaaatgctccacatcactaattgtcaggaaaattcaaatcaaaaccatgagatattacctcacctcatgtagaagggctaatatgtaaaaagacaaaaaaaaagtaatactggtgaggatgtggaaaaaagggaattcatacactgttggtgggaatgtaaattagtaaagccactgtggaaaacaaatggagatttctcaaaaaactaaaaacagaactatgatacagtccatcagttccactacgggtatctattcaaaggaaaagcaatcagtatatcaaagagatacctacatttacatgtttattgtagcactattcataataggaaagacatggaataaacccaggtgtccatcaacaggcaaatggataaagaaaatgtggtatatgtttacaatggaatactattcagccataaaaaagaatgaaatcatgtcatttgcagcaacatggatgcaactggagatcattatattaaatgatataatccaggcacagaaggacaaacattgcgtgttttcactcatatgcagaagctagaaaacttgatatcatcaaggtagagagtagaatgatacatactagaggccgggaaaattggttagggtggggagatgaacaaagataggttaacaggtacagatacaattagataaaagttataataagttctatcgttctacagcagagcagagtgactatagttagcaacaatgtattgtatatttcaaagtagctggaagtgaggactggaattgttctcaacacataaaaataataaatgcacaaagtgatagactcttcaaataccctgacttaatcattacacattctatgcatgtaacaaactaccacatgcaccctgtaagtatgtaaaatataatatatcaataaaaagccaaatattttaaaaattacatgccaattttttttatgtgtgttaaaacaaaagtcaaaagacaagcgaaaacctaggggataatttgtaactcataggagacataggactgttttccaaaatatatagaactcctataaatcaatatttttaaaaatcagcaggtctgacacagtggctcatgtctgtaatcccggcacttcaggaggctgagacaggtagattgcttgagtccaggggttcgagaccagcctgggcaacatgacaaaaccccatctctacaaaaaatacaaaaattagccaggtatggtggtgcgtgcctgtagtcccaggtacttgggaggctgaggtgggagtatcgcttgagactcgaaggtcaaggctgcagtgagccaccatgatcgtgccactgcgctccagcctgagcaacagtgagaacctatctcaaaaaaaaaaaaaaaaagtcactctcatcacagtctccactgttgtaatggtccactgtctgcaaggacaagttattgatcaggaggatttccaaccaagagcgagaacccaaacaaattagcacaactcatcttctgcttctgtaacaaacaagttgtccagttgtcactttgggcactaaagagggacttactctcagatttgggaactagacccgttactattttctttagcactggagggagccttcctttatttggtctcactctaagttggtttcacactgaagtcaattttaagtctgtgctttgcaagtatgaattgaaaatggtggtgtggggtgctttcttggctttggcacctggataacaaagttccccaggaacaagctttcattcatcaatggaatacactggatttctgtcttacagttcagggtgggccagaaggagccatggtgggtctgtagagggatgaattagcatcctgttagaaaggtgctgggtccctcctcagtcactttgaatgctccctgtttttgcagcagtcatgacccatatttttaaacttttaaagtataaagtccatacagaaaaatatataaattttcagtgtgctactcaatgaatttgtgtgatggtatttcaggtagtattctgttttctaatctgtgtactggaacacactttcataactggcacacagattaggaaacagaatactacctgaatcccacaaatgccttccagtcactacctccttctcctcggtaaccatcctgactaatcttgccggtttttgagcttttagaaatggaattctacgttatacaatcttttgtgtttggtttcttttgctccgagatgtatttgtgagagtcattcatattgtttgtgtgcaattggaatttgttcattctcactgctatatagtgtattccactgctggaataattaaatatgtgtttctcaactgggggtgattttgccctttgagggacattgagcaatgtctggagatctttttctagttgttacaactcacagtaagggaagcgggtgttgctgctattatcctacaatgcacaggaccacaggacagccctccaacacaaagaattctcaggttcaagacatcaatagtgccaaggttgagaaaccctgctgtacatagcgttggatcgtgtgaatataccaccatttatttctctgtgtatttcttagagcctcaacttgagcattcatgagcataatgcagctcagccctggctttgaagttcttgaaaccatgcttaccaccatcagaataaaaagactatcaaacaggaggagttttaaatgtttacaataactgttagagtcaaaatacactgtcatgtatagccttggtcatagacaaaaattgtacattttggaactactacaagaatttgaagaggttttaagtgagaaagtgaaatgggctaagtcaaggttttcatcaaagaatgaaaagacttttcttagaaacagctttattgagaaataatttatatactataaaattcacccattttaactgtacagtttaaagattcctagaaaatttacagagttgtacaaccatgatcacactctaattttagaacattttcattacgctaaaaagatccctggtgcccattcgcagtcattcccattcctactccaagttccgagaagctaccagtctactttctgtctcctgatagtttccttttttggatgtttcttataaatggaatgataaaatatgtggtcttttgtgactggcttctttcacttagcataatgttttaagattcattcatgttgctgcaggtatcagtacttcatactttttatggctgaatacgattccattgtgtgggtataccacattttttatccattaacaggttgatggacatttgggttgcttacagtttggggctattatgaagaatggacatgaagaatttttgaagcgtggctagataaatggttagcacaagtaggcttttgaagaagggacatgattctgggccagatgacttattttgtttagaggaataatttgagtgattgaaaaaatagaatacgaagggaaaaggacaagaatggcacaagaagtattagacttacagggaaaggagatctctgacatttacccatacagaccctagtatttcaaaggcattgtatagccatgccggctaggctatagagcagcaaaggtctacagaggagcaaagggtaacatcccactctcttccccagtcttgcaggcacaaacgcagttggcatagccttgaggctgatttttccagatgaaccaggaagacccttggtttttggcagatttaataaccaacattcaaacaaggcactttaaaaaatctacaattcgagaggatttcctggcactatataaaaccccttccatcaatgggagttgttctcccttcttgaattggagtgttcattaagtccataaaatggaaagcacatgtaggataataacacagatattttgtgttagagaaaagttatgaagcatggcatcgaaagaggttagaaaaaaaaaattcactaaaaacaatcatgaaatggtaaagaaaattcccatcctcaacccatctgcatcaaatgaagatgctgctgacagtagatattaaaagagatgttgaacacataaggtccaggtggccgcaatgctttccttttatcccttcctacatagatagatggaagggactcggcacaataaaaagaaggagcatgtagaaaaacatgggcgatttgagaccttccaaggcagagcaggccagtaaaggtgaagcagctggaagccttttttctccaccaggaaaggaggatagagagcaagggaggttttaagtgggagatgctgcgcgtgctttccccataaattctgagggcagtgcacagtattccaagttgtgtagcttctcacatgcaagctaggcccagaaccacttgagttcacaactatttctttctttttctttttcttttttttctttttttcttttcctttttcttttttcttttttttttttttgagacagagtcttggtttgtcccctaggcactggagtgcagtggcatgatctcagcttaccaccatctccctctcccgggttcaagcaattctcctgcctcagcctcctgagtagctgggactgcaggtgtgcaccacctcacccagtgaatttttgtatttttagtagagacggggtttcaccatgttcgccaggctggtcttgaactcctgacctcaggtgatccacccacctcaggtgatccgcccacctcagcctcccaaagtgttaggattacaggcgtgagccaccgtgcctggcccacagctatttcttgaaaatgagttcaacaatgtggaccttctgtgtgtgcaagggaatatgccttatattcatcctctattctatcacctgacaagaacgaaacagagttcaatggtctaaatttgcattcacgtgcagggttcctagaaatgatgatcctgcataattgttgtggaaatcatttgtcttctattggattcatgaaggcttaaacacatggtcaggggatcagactcactaatagctcttttatgtttcttccacttattgagataaaatctttttttttttttttgaaacaaggtttcactctgtcacccaggctggaatacagtggtgtgatgatggcttgctgcagcctcaacctcctaggttcaagtgatcctctggcctcagcctccagagtagttgggaccacaggtgcaaaccaccacacacacttggctaatttttaaaatttttgtggagatgggggtttcgctatgttgcccaagctggtcttgaactcctggcttcaagcgatcctcccaccttggcctcccaaaatgcttggattacagaagcgtgccaccacacctggcctcagatgaaatatcctgcatttactccatactagagaaaaatagagacgtgacatgtagcctgcatagcttttttgaattcttttacaatcactctgtaccagtacgtgttgtcaacaaaatgcagcaaaataaagagttgcatgataattttaatgcatgaccaatgaagattgaagccagcctgttgggttaatcctgttttgtttcaatcctagtctttcccctcaggagctaggtttttggctggactgactggataattgttgcaggaatctctttccatcttcatgtatgaaagcagtgatggggtatgtgattaaaccatgttagacaatatgattaggccatgccattattctttcacagttgcaaaggtaagctatatttctcaggctgtcatccccacagctaatgctttgtgtaagtcttcagggagcagctcacatgtgctgatgacaagttcagttcacagtgtgacttgtccaacacaggatgtctgccgtgtctttgaacgctatagattatttgctttgctggtttttgtgttttaaatacgtggaaccgtacaatgtgtactcttctgtgtttgtaagatgcatccttagtgttgtgcgtagctgtcctttgttcattctcattgccgtgtggtattccattgtgtaaagacatcacaatttatttacccagactaccactgatgggcagttgggtgtctcaatatttatagcaactgtgtgaggtaggtgctattattccatccattttgctgacggggagattgaagctacgagtggctttagaattgattacctcaagtcacacaggtcatttcgtggttgagccagaccttgagccaaggtagcccaggctccctaccctcacccttttatgcctcagtgtctgactgagctatttagtgaagcacttctttgatctgtctctgtctttcttttctccctctaaaggactgcctctgaaggaaaaatccaggtcaccaggctacacagggactcatctctacccctgggactaaagcttggctctcagatccagttttctgagcttagggtagggctatccccagtgaccccattcattcacctgccatgtctgaatccatgggaaatcctttgtaggctcaagctgagccccccacttcaaaagcatatttaaaagccaaattaaccccagagaggagagttgagcttgtctctgtgttggtatatttttggctttaactgttcaggctctactcttttcaagcagagtatgaggaaacctgaggactacatttttgttttgttttgcttttcctgtattagaatttttattttctgtatggagtcttctctttaatgtttgtaggaaaagaactgccaactcatattttatgttttttagaaaattgtcaggctgagtgcagtggctcatgcctgcaatcctggcacttacggaggacaaggcggcttgagcctgggagtttgagaccagcctgtgcaacatagcaagacctcatccttacaaaaaaataaaaacattagctgggcatgatgatgtatacctgcagtctcagctactcgggaagctggtggtgggaggatcgcttgagcctgggaggttgaggctacagtgagccacaattgtaccactgcactccagcttgagtgacagagtgagaccctgtctcaaaaaaaattttattttttcacaatgcatgtttctttctgttgtttccacagaaacattcaggtagaggctacagatttacatgaaaaggaaagatcagtttcctagccttgtgtcaggagcccatgtgaggccagttcttggcttctccttggctggaaataggagggtacaaatagggtcacctactctcaaattctgcggttcaaattgtggttggagatgagatgttctatttctgcatctctcctggaccatcttagagcagtgcaaagtttactggatcttccagtgcattattggcctttggtgtgatgacgagagagcaggaaggaggtctccagctccttttctgagttcagatgttccctagcccaagaagactaatcatgcacctggtttcctgctctgaaaaataagaagtgattttggcagcctttgaatctggatggaaggtggttttttttttttttcagtaacaaaggtagttgtgtatgtatgtacagagatagattaaaacaattttttttcctagaagcattttacaaaagttaagtgtgcaagctatcctgtcgaactttgtccttttttttctagacactcctttacactgtggaatctgtgagtagtgccagccaggaggagagtggcaactttccaaaaaaaaaaaaaaaaaaagaggcccttttacccattggttaatagagggggagggtgcagctatttaggaacatctgaatcctgtcattctggagtctggaatccccttctcttccccctccaaggtcttcgtatagctcacctcacacccagtacacacacccgctcctgggatactgtatcctattcagccacctcctagccagtggaccacctcataactaatgtcaaggttatgtgtaaaatctgaatgtgcttagatcttgataggaaaattatctaaattttgaaaaattgctatgtctacaatttcagaactggttgtcgactcatgagacgacacttactgttgtcccatgatttaattgtttttaccaactaacaatttggaaccaaggcttttaaaccatcccttctgattaacgtcagagaagaggggcattcctttgaaaagaattcctaaacagaatttttataaatggagtacaaaatagcacgaggaacagtgagaaacatcttcaggattcccatggcctaggcatggaataaatgcaaggttagggcttattttctgagaaataaacccttagtaggatgctagataaaacacaggacatccagctaaatttgaacttcagacaaacaagaaatacttttttgatataagtatgtctcaaatattgcatggggcatcctatgtttttatttgttaaatctggtcattttaactaggtttgcaatatattttcagcacaatttcaacagttcatatttgctgagtactttgggcatgatggttagagtcagaggtgactttaggagctgcaggccttgtgtgtgtccctttcaccactatccccacagccccaagtacaatctttggcatatagttgagctcaataaatatattttgaaaaaattaatcaaaatgataaaataagtatggactatgactaactgatgatgcttatgacgtaggtgggaatacaggctcctatattaaaaaagttattgtggctaatactatcttattttggattttaactggttaatttgcttaatagactagcccacttggttgaaggattcaaattctaaatatacgaaaggttatttccatttcaaaaagtgatgcagaaagacaaatagcatgttctctcactcatatgtggattctaaagatgaccgcatagaaatagagagtagaatagtggttaccagaggctggtaacgatagaagggaagggaggatgaatacagttacataggaggaataagtcctggtgttccattgcacagtgaagtgcctatagtagctagaagagaggatgttgaatgttctcagcatgaagaaatgataagtgtttgaggtgatggaatgcttaccctgatttcatcattacacaaggtatacatgtatcgaaatatcaccttgtacttcatatatatgtacagttatgtctcaattaaaaatttaaaaaactcttaaaaagaaaaaagaatcaagagagaagaatacaaaaaatgatgattaagtggaaattaaaccatagttttatctggatttgatgtaattttttaaatgatttgatttagactgtgctattggacaatgccacctattttctttcatatacacttttattctaatgttctaatcaattaagtcctgtatatttaatattcatttctgtcagggttgaatttgatccaggagaaatggatgtgtactaactagtcaggtgtaactggaatcttactataaagtaaaaattattgtaggccttctaaggaatttataattcattaaaatacatataataacactaaaaagctaattaatatataatattctagttaaaaattaggcatatatgactatatgcaatagtgtggaaaacaattaggcatggaaattattgttagagtttattatttttcaaaagataatgataaaacacacctgtaaatttaatataattataaattcgtcaaatctcaggatggtaaaaccttaaatataccatttgtaactgacattatgtattctctttcttcttcagaggaaaaccctgaagaactatggaaatttcttttttattttatttatttatttatttatttatttatttattgagactaagtctcactctgtcacccaggctggagtgcagtggtgggatctctgctcacctcaagctccgccccccgggttcatgccgttctcctgcctcagcctccccagtagctgggactacaggcgcccgccaccacgcctggctaatttttttgtatttttagtagagacggggtttcactgtgttagccatggtctcgatctcctgacctcatgatcctcccgcctcggcctcccaaagtgctgggattacaggcgtgagccaccaaggccggcagaactatggaaatttctaagaaacaaaaacccaaacagtccttcttattcagacttctttgtaaaaccgaccaaaataactctctctttttcttaattgcttgaagtgatactcacattcagttccactagttgtctctaagcagtggtataaccagaataattggagtcccacctgaaagaaaagatggataaatttaactaccttaaaaaaaaaaactgtatggaaagcaactccataaacaagtcagaaacaacattattcacaaagttaaggaataaagaaccaggggtcagggccggggccagttgcggtggctcacgcctgtaatcccagcactttgggagtccaaggcgggtggattacctgaggtcgggagttggagatcagcctgaccaacatggagaaaccccgtccccactaaaaatacaaaattagccgggcatggtggcacatgcctgcaatcctagctactcgggaggctgaggcaggagaattgcttgaaactgggaggcagaggttgtggtgagccgagatcatgccactgcaccccagcctaggcaacacgagcaaaactccatctcaaaaaaaaaaaaaaacaaaaaaaacccacaaagaacttgtggcctgggggacaggcgcagtggcccaggcctgtaatcccagcactttgggaggccgaggcaggtggatcacctgaagtcaggagttcgagaccagcctaacatggtgaaaccccgtctctactaaatacaaaaaattagccaggcgtggtggcgcatgcctataatcccagctacttgggaggctgaggcaggagaatcgcttgaacctgggaggtggaggtttgcggtgagccgagatcgtgccattgcactccagcctgggcaacaagagcgaaaccttgtctcaaaaaaaaaaaaaaagaaaaaaaaaaagaactgggaagattacataatatcttcagggctcctgcaaattataagaaaagaccaataatggaatagaacaaggggtaaagagtatgaatgagagtccaaaaaagaaaaaggaaaaaatacaaacagtcgtagacataataaaaggtgtaaggtgtacaatatagcttataatagaaatttaaactaaaatcacattgaaataccattgttcattcatcagattggtagaaatccaaaagtcttgatatactctgtggcaatgctgttgggaactgaaactcccatccatcgctggtaggagtatagattggtgtaatattctataatggacaatttagttatatctattgatatgacagatgttcatactgattgacctagtaatccacgtctagcaattaatcccacagatatattttcacatgcaaaaaattaagtataaggttattaattattgcaatgtttgtaataataaaagactggaaatcatccaagtattcatcaaaaaagagctagttaaatatatattcatacaccggaacattatgcaagggtaaaatgaatgagaaaaccctctgtactgatgtggaaagatttgccaagacagatctgaaaaaggtgtgtaatagtgtggaaaggaggattaagcaaataaatgcctattttaaaatttatgcataaaaaactgacagagcatgtaaggaacgaatagaaatgaccatctacttttagaagtgaggaggagggaggctagagagatgggggcggaggcagaagtggcagcatggcttctgcatacctgcttgtgtatatatcttttcagtttttgagccatgtggatgtgacttatgcaataattaaataattaagaagaatatagcatgagctaggtccagaagccagagagaacagggatatctgggggaatttcaggggttagattgataggtgtgcagaatgtgaaggtggagtggtaagagatgagatgaaaagacccattttaattatcattaaaaacaactatttttctttttctaacatttattgagagcttaactaagagccagaccctgtgcttttatgtacatttcctcatttaatcctcataacagttcagtaaggctgcagctgttattacaatcattttataagtgaaggaacagagaggttaagtaatttacttaagggcatacagcagttggccactggtggaatcagtatgcacaacccatcatgaccctgtgttcatgctcttaacttttgtaccattctgcttgttcaagggaacatacatccaactgagggaggtggggtgaggggcaagagtttctatctttctacacagtgaattttattaattctgtagagctcatcttacagtactaccaagtatggctgcccccaaatctgtgactcagccaagattatttttaaatatttcccattcttatgacctatccaccactttggcacctatcctcttccaagactatctcagcatctggctcgctacctttgaccataacaaacatttgaataacaaaccaagtttatgaagtatcatgggcatgacaaattagtttaagaaacattcattcagtaaattttgaacccccatagtattccaggcatacagattcaaagataaacgtgagcaaagcagcctctctggtgttcccatctggtgaagaaggccgacatgtcagcaaaaatccatatttaacctacgttctcttatattggttagtgttacctagatttgcctaagcattaaaatcacttgagacacttaaaaaaaaaaaaaggcaacaacataaaaaccctagtttcttgggccctaccgccgaccacttgaatgagaatttcctggggatggtcctgggaatgtgtatttttaacaagtgcccatgagagtcttaaattaggtaagtttgggaaatgagatatcagtagaaacaggatactgtggggtcagaggaggaagttgctcagtctgtctgtaggtgggaagattagccaaagcctcacagcaatgtttaggccacaccttaatgagtgagtaagcacccaaggagaaaggactttccaagcaaggagaattttaaaaattagccaggtatggtcggtgcacacctgtagtcacagctacttggaaggctgaggtgggaagatcacttgagttcagtgagccatgaacatgccactgcactgcagcctgtgtgacagagtaagcaagaccctgtctctaaaaaaaataaaattaaagggaattttactctactggcaaagaagagaatggcttcatggaagagagggagtccagttcaaaggctgtcaggaagacttctgggagcaattagctaactaacagtgatggaatggcgtttagctgaaatttgcaagacttgatagattaatttttttaatgaaggagacaagcaataggatggctcctagcttacaaaatggggagaagtgtgggtcatcgctagtggtgaggaatatgggaaaaggagcaaagggtgatgataggaagatgaattccatcttgatcctgctgagtttcagtggctctggggggaatcatacctactaggcatttggatatctgaagatagagatttgggagcccgcagcatatggatggtagacaaagccttggaagcaggtacaaatcactgaggggtgtagggaggaagagtagaagagtgctgaaggcagagctatggatccctgaccctaaagagagatggaggaagagaggaatatggcaaggagtctatggaagagcgatgagaagacagaaaagctctgagagagaacattatcttggaagctgaagagagagttttccagaaaaagagtggtcaatgggaagaaatggaagagagatgctgttttagagattattggctgcttgttgtttctgcttctaatgccttggtttgccaaatccagtccagattctacatgaatctccagttaaatggtcaaccatataactgacaggttgtctgattttatacagcttaaattcctaagagaatctaatgggttcatcctgtgtgttgatttcacttgggtcaacctagtgcaataagccattttatagggagggtagcccgcgaggttgagtctgtagctgtggctgagcagatcactgagtgtgcaggggaaagaggataaacactgaagatcttgccaataatcatcataacaacccccaatgttgattaggcactgttttaaacaccttacacgtggtaattcatttaatctgtttgaatataatggtgagcatggaagtcatattacagtgaattgagtcctctactactaataatgacagtaagtctctagaaaggcgttaatctgactcttccaaaaatgccctttgctttgctctcccttaaaagggcagaatccttccctgggtccacttttgatgactgggtgggagactgtgccttctgatcaagtttcctgagttcttttaatggaatcatcagaatatcacacataaaatgaggccttgagccaggctggcatggccacactgaagtcctgtgattctgtttacctgagagcatgatgagtttattggtctttcttagccttaggaatctgcctttccagtgcatggtgtttagacagagtagcagctgaatgaattttgaatttaattgttccccagcagagagtgaacaacctttgcatatgccagctttttgtgtagacttttcagaatggtgatttcaggtcatttccaaccgaaggactctttcagttcataataacacatattttaattagctatctttggattgttcatatttgtggaggaagaagcagtggaataacctacttgagaatgtgctcagagcatgtggcgcgtttgacatacaaaagcactgtattaaataagtgtccagttcggtcgtttatttagatttagttgataacttggatttcagcactaactgaaatgcattggttcacattagcttaatcaattctcatagaatatggagagctcaccagaactataattacaacagcacataattatttgatgctgatttcaaaggatattttacaaatgcatttgtgaatggtagttcgttcttttaaacgtttggactgctttggctttttctgtggtggggcctagaagaagacaggtcacagcaggtctcacttgaagaaatctttaacacagaacataaaagtgactgtaactaaagtttggaacatgtcattttactgagtactgacactagaggagtttgtttaaggatattcacatcagttaacaaatcaacgaaacgtttattaaacttctgttactcattcaacaaatatgtaatgaatacctactataagtccaagtattccacatcatctcttttcatccttgcaaacattagcaggaactataatcccacaattttatgagatgtagagaggtcaggcttagcttgctcaaggttctagtggaggcagaatttgaactgcttccaaactgtccaacattaaaatctatattacttcctcttagctggatcttatcaggaaatcaaagctgtataagctatggccccttctgtgtggggttgacaatgacatctaaaacatcagacttaagtctataaatctagaaaacataaggcataagtctacaccacccaggcaaagtgccacaggatctcatagctacaggagtttaggaaagaagcatcaaggaaggcagccagcacccatggggtttgtgctgcttggagaacaggtggtatgtggatagttgagggcatggagagatgattccagtgggaagagctgaatgagaaaaggtgcaaaaccagaatgaccaagctgtgtccaggaaatcataaacagacctgctgctgagaacaaaagttctgttatctgagagtagaaaatatggctgaaaggtaaatggaaccggcttagcggagggccttaagttccaagctaaggattaggactttgttctgtggtttataggaagtgattacaagttttggatataaaagtaacatgatttaagggtgttttagaaaattaacctgattgtcaactggaaaaagaggtgatagagctggaaatcagtaaaggggctctgggccaggcagggaaatgatgtgatggctgctttacaaccttgaggaaactcagaaggagtagggttcatgggggactgtgttcaggaacaggtccaaaaagttaggccaggccaagggggatatttacgcacagcaatggagggcagggtagctagaaggaaagcatagtcacaaagagaggcaaaggccagggctggagaatcagttcatagcatcaggagggtctaaggagtgaaatgcaacgatgtcttagtccatgcaggctgctatcacaaaataccataccctggtggcttataaaaaacaaagttatttcttgcaggtctggaggctgagaagtccaagagcaaggaacttacagattcagtgtctggtgagggctgccttcttgctataagctcacatggaggaaaaacggccaggtggctctgtggggcctcttcataagagcactaattccattcatcagggctcctccctcatgatctaattacctgccaaaggcccaacccaatcctatcacattaggcattatgtttttcacaagcgaatataaagggcaaagggaacaaaaaataattagaccatagcagcctgtacataaaaaatgagcaggttagggggcaaaaggcaaggggaggacccgcaacaagttctgctacagaatgtgacacaaactgaggcacccgggtcaggaccaaggctgaacatcatttggcagccagcttactgcctactgtgggataagcctgaaggttgaagtggaagtcacaggaaccaagacatgaagggtctaagtcagaatgctgacagtggaaattgcaagaaagttcttatgtgatagagatcatgaagaaagactcaacaggatgtgcggatacataattagatcaatgatacataattagagaggaaggagagcagtaggtcctataagccctcgtcgtcattttaaaagcaagccatgttccaagggtaaatttggaaactagttatttgggctttggaaaagttttatcacaaagagcccttttccataaggagatgctttttaaaaatatcagtctcacaggtcaggagtattgctacacccaggatagccatgaaatctaaacttcccctggcctcactgtctttccacctgctatctccatccaaatctggcttcacgtgatggcttttgggtccagatgtgaagatctgtgagcatctatgggtgtggaaacccctctcctgaggtcctggggaatagctccacatgcatatacactcccaacttcagctatgaaattctctatcttgggtccattcgagggcaggatgcaatttcaggattatttggtccaaaaatatttgctcttttaccctgcaatattctctgtctaattgcttctgttccattgtcctgtttcaaaaaacatagctcttttgagtatttgcccttctgtggagtttcaaacctccttctttctcctcttttctatttcctgggctctctctatatggaaaattaaaggctatgtatgttataataggaggcttgaggacatacaaagggctgaatgaaaattaatctcacctccactttggagagacaaaagggactcagaagagaacactgctaggtctcactggctttctctcaaaacagaatctcacttgtgatatttttaaatgttgtccataaatatcatagatatgcctatacttgttgtatgcacacccagctgctctaccagtgtcttgtccattaatttttctgttttttctgctttatttcatgatatgcttatgaaaggatttctcatataactccaagcaattttaacccttaaattaaaagtaaaataataaagttagctattttaagaaatgtgatcacgaaggataaagaatccagcaatgcagaaactgaagtgattatgaaatgtttaggttttcgtgattttgtttgttgctaaatcttactaaaatgcacttttttaaacaattagactttttatttttttagaagttttggatttacagaaaagttgagaagatggtgcaaggagttcccatggaccctgacacctagtttactctattagtaactttcacattagtgtggtacaatgaatgaaccaaatatacattgtcgttaactgaagtccgtactttctttagatttccttaattttcacctaacatttttctgttcaaggatcctatcccatgttacatttagttttgtctccttaggttcctcttggcagtgacaatttctcagcctttccttggttttgatgaccttgacagttttgaggagtacaggtcagacactttgtagaatgcccttcttggagtttgtgtggtgttttctggtgattagaataggcaaaaaacgaacatggttatggcaaataggaagatcaggcaggctcagggctccagtcaccctagtgtgcgtcctggccgattggcaactcctagcaactgtctcagagcaaggggcaacgaggggtcggggcttccaccctggcacctgggttcactcgatcctgcattgtacccactgcggaagggtgaagttccaactcagccagacacagacccctgacctggagggcaccaaggagggtgccaaggagaggtggctcacctgtgctctgggagtgaggagctgtcgtcagggtgtgtccaaggttgattacatagaattgtaccagctggagactggagccagaggaagagctgcctcaagcaatttcactaagaggcggcagtccaaggaaaataaggcagattccagagcatatgaggagaaccaagatggaaagcacagaacatatgattatgattccaagtgaaagatgcagccaaagctctcctgtgtcataaacctgttccttcctgcaggatatctgaaaaagccagggctgggtggtttatcatccaatggaaactccacagtctcttctcttccagataatgccttgtttgtaaccactgcacagacctctggattgacatctaacatatgtggtagacagaggaccagaagtatacaagacctgtaacagcatgcacagtcccatgaggagaggggcttctttatttttcttggcaaacatctgaatgatgcttgcaaactgtctgaatttgccctctagggttttccaacaatttgcatgtttttcagatgttttgggaaaaaattaaatactgtaaaaagtcatgcggaatttttttaaaaagatgccgtaagtatgacctccatctgtttttttctttgtcatcgttgttgcaatgttttcatactattcaaattcttatctctttgacattagtctgtggtttatttcctactagtggcttcgaaaagtcaaatcaacttggttgtatgtatgttttccccttaaagtgttttctcgttcacagcattaacctatgcaacataaccttctgtagcaggaattgaagaaaatgataatttttggttttaaagaaattctactatagctttttttttggtctgatcacaattttaattcataaatttcagatttgggtaatttttgtgttgcccagtaactttgacaaatgatttaatttgctcttttcaggagtttctcaaatcatttctctcaattttcacaactgatattttgtcactgtctacctgatatggttatttcccttataactcaagagtagtttaacacaaagtataatcctatagtgttggaggcttccgagaggcattgtttgcatgataagtaaatgcatattgtgaaactgtgttcctgggattggatttagcatgatctattgttggctccctttattcacaatctctctttacacaaaatacttacgaacgatattttccttagtgttaaatcccttttaaaacatgttatctcatggaggtgcacatctgtagtcatagctactggggaagctgaggcaggacgattgcttgagcccaagagttcaagtccagcttgggcaacatagcaagacctcgtttctaaaaaataatcaaaaacaacaataaaacccctatgttatgaaattttaatttagtgacacttattcagttaagactttcctatctaccaataaccatagtattggaattgaaccttaaatgtccagtgggtggtgactgcatcaaagttgaatgaaacagccttcttgctgttcagctgtttagataacttatgaatattgttagggcagctttctctgagaggttgccatttgtcatatcaatttccaaaagctgttataccttcatggacatttattctccgaatgatatttaagtgccaacacaaattaccacatgatcaagtgaaatggactatactttaaagattatcagtgtagagctcactgcatttcattatatattttaaagggattcattgccttaaatatttgctctcaagatgtcaaggttaacatatatatttttttgcagtcaaagtttccctctgttacccaggccggagtgcaatggtgcattcatggctcactgcagcctcctgggctcgaggggtccttttacctcagcctctccagttgctgggattataggcatgagttgccatccctggctaatagtattttcttatttgttcacttgatttggttattgttctgttggttgtaacttgttttacaggactcacttgtgtccacacatctgtgatccctttgaaccttaagaatcaaaccattgtctgggagcggtggctcacgcctgtaatcctagcactttgggaggctgaggcgggccaatcacgaggtcaagagagtgagaccatcctggccaacatggtgaaaccccacctctactaaaaatacaaaaattagctgggcgtggtggtgtgcgcctgtaatcccagatactcgggaggctgaggcgggagaatcacttgaacccgggacgcagaggtttcagtgagtcgagatcatgccactaaaaaaaaaaaaaaaagaatcaaactattttggcctctccattttctggttgagaaattctttatattttaaatatatatttatttccaaatttaatattgaaaactagaatatagagaagagaaggaaaatagttacctaaaatgacctaaccttcaagatgattattatcactattagcatttttccatgattttcagacttttttctatatagccttatacatataaatacatatattttaacgagattaatgttaactcactctgtaagctgttttcttacctattaatcatatggatgtgccataatctagttaattgatggacatttttattgtttctgatttcactattttagataatattgctatgaacatccttggataatgattcatttttctgtattataatgttgagatcatttgagaatcagagaaactggcagagaaaattatagtgagtcattttatgttcgcaacaaaacttgcataatttcaattccatgagagaatgtggaatgaactaaaatggaaaattttcttttaaagaatgagctttttgtctgggtgtagtggttcatgcctgtaatcccagcactttgggatgttgaggcaggagaatcacttgagtctaggagttctagaccagcccaggtaatgtggcagttgctctacattacaaaagaatacaaaaattggccagccacagtggcttgtgcctgtagtcccagctactgaggaggctgtgatgggaggatcgcttgagccggagacgtggaggcggcagtgagccaggatcacaccactgcactgcagcctgggtgacagagtgagaccctgtctcaaaaaaaaaaaaaaagaaaaaagaatgaattttatatttttgaaattttaaaacacgttagaaaaacaactatcagaaccatagatgtctacactaaaagtagaaaagttaattataactacataagaattctagaaatagtttcaaactaccaaaagatatccaaagtagaagggaaataaattataatatatttgagattgctggatgtaatgatggaaaagaaataaaatcgatccatgtaagcacataataaattataataatttcatattttaaaaattggtacagtttaattgtatcgaggtagctagaagtttgaagagtatttttggcccaggtatgtatgattaatgatcaaatggaagacaccaacaacaggaatatttctgtatattcataaaatactctttaatatgatataatagatataatgtgatatataataaagtacataccaaaaggggagcaagtgaacaaaaagtatatattattatataattagtaaaaatgttatgatacaaagcatagaaaaaagaagcaccaaaatatgtttttatttatataataattttctttcttttttcttttttctttctttcttcctttcttcctttctcttttttctttctttctttcttttttccttccttccttccttccttccttcctttctttctttctttctttctttctttctttctttctttctttctttctttctttctttctttctttctctttctttctctctctctctctctctctctctctctttctttcagacaaggtctcactccattgccaagactggagttcagtagtatgataagggctcactgcacccttgacctcctgggctcaagcaatctcctcccacctcagttccctgcatagctgggactataggcacgtgccaccacacccagctaatttttaaatttttttctagagatagtatctcactacgttccccaggctggttcctatctcctggactcaagcgattctctcaccttgacctcttaaagtgctgggattataggcatgagtcaccgcacccagcccaaaacatagttttaaaaagtggatgagatcattgtccagattgtagttaattaatatcaaagaggcaaacacacgaatggcctaagtaacttattacacagaaaaaggcatattcttaccaaaataagtacaaatcaacctgggggaaaaaacagtaaaaatacaaacacaaaaaagtcattgaatatttagaagtgggtatatcgtggtagcctggtaacttggttttgtcacttggaaaatgaactggcagtatacaatgagacctacaaaatagtttataagttttgatactcaataatttcactttgggttgtatattcaaaagaactaatcggaaaggaataaatatataattgtgaaacatttgaagctactcatgttaagtaatgaagatgaagtgagaatgatttttaaattgtttacattatagtgtagtatgaaaagccttattatatattatctccttcaatcctcagggaggaagctgtgacaaagagctcacataactgggactggaaactaggagtcctgtctatgcagaaataagacccagacttaaacctggctacatcctgtgtcttctggctgtgggacttcagcccccttcccaatatctctgagcagtagttttcagatctgtaaatggatcacaatgctcagtctctatggctcccaggttttgagcaataaatgagataatgcacgtggaagtggagctcctaccatgggcctgatagggcaatcactggggttgcaactttctgaaaatgggtctttaaatgaatcttcaaactgcacactgaggagcgggaagatttggaacacgtttaatcagcaagggagcaatgaaagcagagaccagtggcaatgagggccaagttaaaacagggcggagtggagttgtaaagagagaagtaaagtggatttgtttgcactgcctgggaaggagtagggtacagaggggattcaagggcacgtgcttgttttttttaattgagacattatgaacatctcagaacaaaagctttgggctttggtaagctccaccagacacctggtttagggctttttcattccccaagactcctcctcccttccatgacactcctccctgggacacatgcttggatttggctctggaaatgccccgccccaccatgaaaccatctagtcttttccccaggttacttctcttgtagtcacgcaaaatcaaggctgaggctccctgtcacgaccctcggcacttcacctgagttctaggagccactttggcagtcctctttctgtgccaccaatgggagtgaggggtgagcctggcagagacacacatgccaccctgggctttgtgacaaggcctggactctaatgggtcaaacccagggcaaaggccatcctccatctaggtaacgaagtgttcatgactctgtgacagccaggacaagggcagtaagtttgcagtagaatgacactgcaaattggtgaaccttagtgtagggtacgtcccagccgggctttaatacagagcagcaataatgacaacaacattgcgtgtgtgtgtgtgtgtgtgtgtgtgtgtgtgtgtgtgtgtaaaactggtgcagtcctatccattgtctgattcgatcatgagtgccacatcctccccagacttgggttagagtagacccagatccccagaacccttttaaacctgggtgatttagaattcaaactaccatcacttctccagactagattaaatgccacctggactgatcagatccaacatcctaccatgagtctggtattttctttgctattttatctagataattcttatttaatcctttcagcaatcctaggaaaaaaatattcttatccccattttacagagaaagataaggaggttcagagatgttaataacttgctccaggtcacagagcaaatcagccgtgaagcaggtttcaaatccaggtctgcttgactccaaaatcgatactcatgctactccgatgcatgctacagagagtttttctgggccagtagtgggaagaaggtagagatttttgcaaaattgtcttagggacccagtatagaagtatgccactaactttggggtttctggaccacttcctgataaggggcagagttagatgggatgccgaggatgtctgtgtgttctctatgtacacacagcaagacagacattttttcctttaacatgtgttttgctttctatagagagaatcctttttctgacagtcactttctttccaaagcttagaacatcataggctctttggcagagagtacagctttcaacaagaaaaagaaaagtttttggccactctgcccccttgcagttcaagtataattcaaaatatctgcttctatttgtttgccttttgcaaaacctcaagggtgattttgaaataaataggaataaaatatttgactgaaccaaaagagcccagtacctggccatccgaaagtatttatttatttgtttaaacattgctggagtaatagaaaatttaaatgcagttatcaaagaccaaaagttcagagattaaatactatgttagagtcattccttctaattaattttgaactgttttcgaaaaacgaagaacttgctggggagacaatgatcaagatcgtaacaaagttcccctagaagattaacagagcttggagtttactgtggatctctgcctgtgtggagaagaaacagtcaaactagaggaaacaaaactgtctctatagacaaattaaattttagtggatgttcatgtgcacaggtgggcagcagcaccttagtctagtatgttgggattgggatcagagtctttttccataaatgcagcagcattgagcaatataattccatctaaaatcttattgtatattttctcatctgcttacttttttttgtttgtttgtttgtttttgagacaaagtctcgctcttttgcccaggatggagtgcagtcacacagtcttggctcactgcaacctccgcttcctgggttcaagtgattctcctgcctcagcctctcaagtagctgggattacaggcatgcgccaccctgcacagctaatttttgtatttttagtagagacagggttttaccgtatcagctaggctgatctcaaactcctgacctcaagtgatccacccacctcagcttctcaaagtgctgggattacaggcgagaaccaccacacacagcctcgtttgcttacttttcaaaacagctctgtgtttgtgtgcgtgtacatggtaaaatttacaacgaaatacacatttagaatacattcagtgagttctaataaatgtatacacgtgagtgcctcaaacccttatcaagacataaagcattgccatcaccccagaagcaacggctgttctgaattagtgcattagttttctgtattttgggacttcatacaaatagaatcatatataatgtgtagtttttttggataaggcttctttgactcagcctaatgttttccattcattatcatccatattccgtgtattaatagtccattccttttgattattgaatagtataaccattatataagtattctacactttgagttgggttattttctattttcctattgatggacacttggctgtttccagttttgagtcaaataaagttgctaagaacattctagtgcaagtctttttgtggacacattttatttctcttgaatagatatctatcaatggaattgctgagtcatggggaaggtaaatgtaaatgtcagggttttttttcccaggatgattgccccacttcatacctccaccatcaaaatatgagagcacatgtttgctgccattagatattatcagtgacctctcattttagttttaatttgcattcttctggatgactaatgacattaagcacttcatggttctttactggccttgtgtatgtcttcctttgtaaagtgactgttcaaatctttttccattttaaaatattgggttttctttcttttttccttatttttttttttgagatggagtctcgctctgtcgcccaggctggagcgtagtggcatgatctcgggtcactgcaacctccgcctcccgggttcaagcgattcttctgcctcagcctcccgagtagctgggattacaggcaagtgccaccacgcccagctaatttttgtatttttagtagtgatggggtttcaccatattggccaggctactcttgaactcctgacctcatgatctgcccgcctcggcctcccagagtgctgggattacaggtgtgagccgccgcgtctggccaggttgtctttttattactgagttgccagtgtgctttacgtttcttcacatggtatatatatatatatatatatatatgtgtgtgtgtgtgtgtgtgtgtgtgtgtgtgtatatatataccctctccctcagagagtggagccccagttacctcatctttttgtctgtctttctccccagaatgatgccagggattcttctttgtttggtactatatttccagtgcttcagattgccactggcactgagtaggagctcaataaacatttgctgaaagaatcaatgaataatcaagtaaactgatttttgggtctgatattcagacacaatgttcttgaacttaatggcattaattaacaaggaaattgaaaaaaaggacatttaaatgctatccttgaggtatcacatatgcttggcaccaaggacacagaataccttcaggggactggacatggtggcttctgcctgtaatcctagtactttggaaggctgaggtgggagtatcacttgggcccaggagttggagatcagcctgggcaacaaggtgagaccctatctgtacaaaaaaaaaaaaaaaattaaccaggtatgatggtgtgcacctgtagtcccagctacttctagggctggggtgggaggatagctggatcctgggagttcaaggctgcagtgaggcctgattgaaccactgaactgcagtcggggtgacagagtaagtccctgtctcaaacaacaacaacaacaacaaagcccaaaacagaataccttcaggggatttgttcacccaggggagatactgctagactatctcatggagtggcctaatttgtccccatttatgagccctctagtgtaagccatcactgctgtctcatctaccgcattctgggactatgcccagccacttccaagtcttggattccgaccagatttgcttaatggatgagcagaacgtctagctttagagagttttaggtaacttcacccagctgatcccactgtgcctttaaccaccttcctcttggccccttctgacactgataatgcctgttccctaaccattggcccctctgcctggctctgtctcactagcaggcccatccccactctgtgctctgcctttcttaacacccctaaagggccacgcaggaaaggatgggacaagttgattatgacatccctttctagctctaaggaattcaataattctgatattcatccctaaagaaatttatcagcagctattaattgggctttcctaatttgacactgaaaggccggtagggtcccctaagtcttgaagccattttcctggtcccgaatccagcagattccagcctatctggtttggggggtgtctacagtgaatcatctgtattcacatttatagagaactttgccatttgcatgttcatatctgtcatcttatgtaaactgccaaacagttctagttgtagccctctttagtttctattttcccgaagtttctatttcccaaagcaaaaagaggtgagttttcatttcttttttttctttttttttttttttttttttttgagacagggtctcgctctgttgcccaggctggagtacagtggtgcaatcatggctcactgcagccttggcctcctgggttcaagtgatcctcccacctcagcctctccagtagctgggactacaggcatatgccaccatgcctggctaatatgtttttatttttcatagagatgaggtctcactatgttgcccaggctgatctcaaactcctgagcttaagcaatcctcccgccttgacctcccaaagtgctgggattacaaaccactgctcctggcagagttttcaaaaatcctctagctcttgctaaaaaaagttggtgctttcttagctctggtgggtatgcaagtgtaatatttaaaaggctcatagatttttacagttcagaaacctggattctgtctgtcattagaaattcaattacacaccgcagacatctatgagtagttcctaaccttttaatttaaccattattatggattttttcccccttggatcacatgttattttcttttaagtccaccaaaaactgtatttattggctcactttaccttttttattcatcagacttgtacctcccagtcagagtttagaatcaggatcagatagtctcttacctcactaagctgattttattacagccaaaataaagacatttgatatttaattagcttccaaacctaataactagtacatttccatttctgctgggctttttgaaagattaaaaagttcatacattaacccttgagaaagtggaaacagtttagttcttgtgaagaagtagccctgtgtgttcagggacttcactcttgccgtgtctctgatgtctgaatgggagcaacggggatattactgactttaacccttttcactgcgatctgggcctttctctggctctatagggactggggatcaaccacccccaccctagtatttcctcagctactggagtatttgggttctcagttcaagcctataggacttggggagaacatgcattcactgaaacgatgacattcctctaaggtgcaaatgttaaaaggtcatgcaaccagaactattacataaaatcaaaaattttccagtttgaattatactctcaaaggaccatgatgagtattctaaaggcagtgtttgtttctaaattaatagaattaataaatgttattctgtttgccaattatagaagatacagttgttgaagactattaatgtaatatgcaattgcattataattgtattatttaacagattgtgttgcatgaatcaatgagatatgatgctgtaatttaaaaataattattttatggaagcaaaactgcttatgaataacattaagtgaatgcagaatgaataacttaggtatgtagactcacagctaagaaaaatatatatacatgtagctaatggctcagggtaatctgcagaaatgaaaaaaactatattagaatggacaaaggtgagtctctttcaaaatattttttatataagttgttacatgtatcagtttcgcaattaaaagtttaagatggatttatattggctccagtgaagaatatgtgttttattaattaatactgtgcttggttttgtcttattttataggagaaccagcagaaatccaccaatgtagtctatcaggcccaccatgtgagcaggaataagagagggcaagtggttggaacaaggggtgggttccgaggatgtaccgtgtggctaacaggtatgtcatgttcatatatatatatatatatacaaattgcaaactgacatgtgacacaattttatggaaattagtgtaacgtattacatgcttgttttatcattagaaggaggctgggagatgtagtagaaagcctgggtgttagtcctaaccctaccatcagtgagaaatagagtcaaggtcaactacagaaataagagtctgatcaagtcaactgtgaaagtctctagttgtcacttttctcctctttggcaggaaaggacgggacaagatgattatgacatcccctttcagtgctaagggattcaataattctcatgttcatccctaaacatatttactggcagttatgaatgaggctttcctaatttgacatcaagcatttggctgtccataaggttttggatatttagagatattcgttattgttgcctaatgttttgacattctaggagactatttcacttactatataaacaacaaacaaacataagaatctgtacaagaaggaaaactagcaatttccatttggctgaggattgcccttgtttacagaaataacttgctgctgctgaagtgactgaatgactctcccttttcttgtgtttttatagccacagaatgtcaaaactgagaattagtgacagaactggaattagaacctgactcccaatagctggccctaggctgttaccttgtactctgagtccaaggtagacaaaattatttctggactcaaaaggaaaaaccaagttcatttcatagacaacagttttcaaatggaatgagcccacctgcaaaactatgtttattcaggttataaaatgataatgttttctaacctggagctcattctaaacaatctggcaggtggggacctgccttgcatcttttcttgctgtcctaaatctttgcccttttctgtcccaactggcctcattcttgtactcttcaagtttttgccttgtgcctttggtttcctggtttcattcatgcctggactgtgcatcgaaacaactttctgcagcctccagtgcaaggacagacagtgagcaaggaacctgctgtgctctaatatgcaccatccttctgtcattactcctgaaatgtttacctcaactccccccaagagacgtaatttgagcagtaggtacagctgtattctagaagatcccctcctgttatatgtttcccttcatgcgaagatcactggtgaaaacaactttcgtgttgggctatacacacaaagtccattttctctaatgtgacaccccttgaaaagaaaaagagaattggtagaagagaaacatatctaaagggtatactttctccttctttactcttaaaatgaattatttcttcattagaggaagaaaagaatatatggcaaattttaaaaaatcaaggccgggcttggtagctcttgcctataatcccagcactttgggaggccaagacaggtggatcacctgacatcaggagttcaagaccagcctggccaacacagcgaaaccctgtctctctactaagaagacaaaaattagccaggcgtggtggtgcacgcctgtaatcccagctgctcgggaagctgaggcaggagaatcacttgaacataggaggcagaagttgcagggagctgagatccgccactgcactccagcctgggtgacagaatgagactccatctcaaaaaataaaaataaaaaattaaattaaattaaaaagtcatctttttctaatttattttttattcttatgttacaaaggtaggctgttgaccaggcagaccagaagaaacaaaatactttaaatccatagactcagattttagccccaactccacctccatgagctgtgtgactttggacaagccagttaggctctctaagcctcagttttcttatttgtacaatgggaataaagatagtacctgacttatggaggtgtcgatagaactaaatcaataaaagacaaatgtgctttgcacagtgcctggcacatagttaagttgtcagtaattgtaattagtgttacctcaatgtatgaaagtacgtgtgccaacaatctggttacatatacttactgtaatttagctctttgtttcctgagagctgaagcaaaatggaaggacattctgttatttctctcattttctgacatgagagaacacaccagagattcaggagtgccacttcccctaccccacaacctgacataaatactaagaagaatttatcacctatgtctttatttaaatgaaaaggaataacagaattacagacaataccttcaaaaatgatttgatgaagttagtgttgacacgttcttcatacagccatttcttctaatggtcctctgtcaaagccaaaggcatgactttaaaatataactaaaagtatggagactattcaccttttgcagatcaccttcccccccacccaaatcctccttcctctgtctgtccttcattcctgctttttctgccctttttcctctttcctcctgttgtcttctctgtatgaacctcttggcttttttcctctgtcatgccaaggtgctgtcggacagaggcttggcaccatgaaatattcttaggttcagagatctttaagacaaagatcctaaaatcctaaaggacccatttttttttttagagtgctagcctttagggtagttcagatttaaactgttaaataattttggcaggttgtgtttctttcccttcttatgttcctcctcatatggaaattacaaagtgtgttcctgatcattgtgctttgaaaccatggtggaagccacatggtaactcttttctcatataaagactctagagaatctttacacctaagagtgtgacatatggcagctctaaatacatctgctccctagctcaggccggcttcctgtctttatgttttgagagtcattttggaaacatctagaagccaaaggacagcctgcgggctctgtaagacggttgttcagtggcatccacgagggaggtggacttaccagtctccaggggctggctgtttccctccattccagctgattgctgactttgaaggggatatgagaccactgtcaccacatcttttgattttttcaagagaatacagaatctggatttgtatacacaacttcctttttgctttggagacaaggcctcgctctgttacacaggttggagtgtagtggtgccatcacggctcactgcatgcagccttgacttcccaggctcaaggggtcttcctacctcagcctcctgagtagctgggaccacaggagtgcaccaccacacccggctaattttttttgttttttgtagatgcagggcctcactatgttccccaggctagtttcgaactcctgggctcaagtgatcctcccaccttggcctcccaaaatgctgggattacaggcatgagccaccaccatgcccagcctgtatgacaactttctaatctttaaaacactctgcagcccaaacagaacacatcgaggaccacatgtagcccccaaatctccctatttatgaagcctgcttgctttgaaaagctataatcctaacacaggacaaatagttatttcaaaatttgagagaaatgtaagtacttgccttgtagtcaactacactgatttctttctttcttttttttttttttaagatttagttatatttaaaattactagattagttcacaatttgtcatcttaaactatccaggccgatgtcagtctgttttatctgttctgaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggtaaaaaaaaaaaaaaaaaaaaaaggcactacacacgattcccacacacagtgcaagtgctctccaactgctaggggaaggaatcggagagggagggcataagaatgtctcctttcaatttcccgactatttcttcccccaataacaggctctctcatttcctctatttaatattggttatataaaggagttccttcctttccagatgccagggcaccagtagacataaacccttccatgttcacaattataaggaacatttggtgagagtcgaagggaagagaaagttaaacaagagaaactctaaacctctgtaattttagttgtcggaaaaaggatctagttaaagaaaagagcagttcatggccaaagcttcgggttctatgtgtttaatgctgacatcactgagatggagtgtcactcttcttttaaatcaggaaatttctgggagccaaacatcagatgtagcttagaacacatcctttgaatgaaatgctcccatatggccagtgctttcctgctaagagggcctattttccatgattttctgtgaaagtccttgagagagctgtgtttaccagagtaaaatttctggactttctctcaagcactctgcaaagcacaaaccccagtgttatctcaaggctattgaaaaccaaagtacacagtgttttgtgatttagaatttcaccgtgaaacctctttttacattcttaatcatattgcttttcaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggtaagagaattggctagtagcgtctaccagttacataggctgtcagtcctcagtccttattctgtcctcagaaatcttccttgagtttcaaactgttttccaaaattgcatataacatgcacaactttttatcagatcatgatatattcagtatgcccagaggcttattaaaaggtagggttttatttttaagaattgtcatctcagccatatgcaataacgttcagagaactagaatggatatttatatgtgagtgtgtgtgtgtagaggagtgtttcagagttcttccttattcttgtcttcctttttgattgtaatcatctatagagggcttcaacttagccagcaggattttgttgacaatttggggctttccatattgaaaatacagctatatattttcttacttatggctagaagtcaaggatggctgtttgaccttttctgttaaagtgtgaattttcagtttaatacattattccaacatgtgttttgccttattgattaaaaagattattctgtcaatacagatgcgatgattgtcacccatatgctttgcaggatttacaggtattgattctgattatgagaaacctgaaactcctgagcgtgtgcttaaaaccaatttgtccacagtgagtgactgtgtccaccaggtagtggaacttctgcaagagcaggtaggtgaaccggttgtctttttttatatgtttaataaaatcatgaaagacaatctatgcctctttactgaagcattctttttacagttttcaagtttttaccaatgctgtttcatttcagaacattgtaccctatactataatcaaagatatccacgaactctttgtgccggaaaacaaacttgaccacgtccgagctgaggctgaaactctcccttcattatcaattactaaggtaagtgggtgcagactggtcaaataattaggcttaatatcagtcattataatttatttacaattactcttaacaataagaaaagtataaataaggtgcacataatgtccataaataaaacactcctttttttccaagttatttttaacctcttctccaaagaaatctctcaccaagaattgccacaaggcagctgatcaatgccatgtatggaggtgactgggaaaataacttctgtatttgcattggacaattttacatagctgtcattgtaccagtaagtacatctggtagaaaaatatagccagaccaggatttttgtggataaaagaaagaaagaataaacagtgaattttcaactcagttgcacattttgggaatagatacaacctaaaaatgttcaaataagtcatctcaatacaaaatcttttcaccactatttcataggaaacttccaaacttaaatatttctggcccttagatcatgggttagcataacaggtggggacacttaaaacatagaaggttctgccctcatcctcctgttaactgaataagaaaggacttccctggggccagatgcctggaaaacagaacttatgaaaatgttcaactactttttgtgttttgcagctggatctccagtgggtccaggttttgagcgaaggctgggccactcccctcaaaggtttcatgcgggagaaggagtacttacaggttatgcactttgacaccctgctagatggtatgtttttgttgttgtttcttactctttgttgttaaggaaaaaaaaaaatctttcccagaagttttgcaggaacaggaagttagtctttagtttgcaaatcttattgcaaaactgtttggatcatttacagtgtgctccattctattatgtttaagcttccatttttaggattttttggttgttctcaaaggttgttcctttaaaactaaggaactgaaaaatggtgtaaagccaagagaaagacaggtctgtttcatctccacttgctctttgctggtgctgatattcagaaggtagcacgcagaagtaccattgccacctgctagggacattcctagggcagccaagatgaggtcagcacatgttgctgacctccatggcaccctccaccctccaggttgctcatgtcaagcattattgcaacaactgctttctttggtgcatgctaaagtgtcaatgttcatgcccacacatgaaatatattaaaatggtttcatccactacactctaacaaaagagcattaaggcagctttctggccacgagctgaatggcttttggaaaaccaatctggtcaagctcagaaacatgtgttattgtgaagacttccggacccttctgtgatcatttccttcctagaactgcctgaacttatcaaataaacttatctatttcaagaccttcggggaatggctgctaagtggggaaggagtaggggtagagtcacgctgaatttgtaatgctgagcagggctccaagccttttaggaagaaaaatcaaataagatgctcttttttgggagaggtgttcatgtcctgtgtttgtgcctttgcctggggaatggggcatgaactcagaatcagaactcaaagactgatcagcatgggccctcttcccttattcttttgctgtgacagataacaccccacaacctgaatccttcacttctcagattaaataatattccccaaagacacttagtttacttctagcttgctttaacaacaaaaataataatgcatatccctataccacgtctctgttttcaaagcattttctcaggcattatttcatttgatcctcacaaaagccctagaaaacaggcagcaattattatcccactttacagatgaggaaactgcctcagattaagtgatttgctcataacattcataagtgaaagcccaagaccagagtccagaatcttaggaatcctggcccagtgctccttacataccagtctgctctcctgatgtcttttccaatagaatctacaaggcctgatggtctacaaggaaggctgacttttatcttggtgtcttgattttgacacatgctgaacaccgactgcctgaagtaaaggtcattggacttagcagctagccatgagcaagaggttgattttgagcatatgaacagagctgtggccaaaagacaagtgaactacattgaaagagggggcctcattacagacaacaaggtgctgttgaccttggacaagtgttcctctcataaagaaaaatactagggtggtggaagtggttgcagaggtcagtgttaatggaaatcagaggtccttagcctgagatctaggacttcagggtgggctaacaaaaaatcttagaggcaaaaatgtttgtgttttgataagggaaggaaggagcattttcctgggttgagaatttatagcttttgatagattctgttttttcctttaattattttttattttttagaaatagggtcttgctccatcacccaggctagagtgcagtggcatgatcatagctcactgaagccttgaactcctgaattcaagcaatccttccacctctgcctcctgggtagctgggactacaggcatgtaccaccatgcctggcagatttctaaatttgttttgtagagataaggtctcactatgttgcccagggataaggtctcacagtgttgcccaggctgatcttgaattcctttcctccagtcatcctcctgccttggccttgcaaagtgctattatagacaacaaattcttaaaagagtctgtgatccaaaaagatgaagaacagctaatgcagataatccatctggatgatttaggcaaaatctctagcctttcttttacactgtctcaatttcattttatgggggtttttcaacttgcaaaacctgttgattttcttttttcttttcttttttttcttttttcttttttttgagacagagtcttgctctgtcacccaggctggagtgcagtggcatgatctcagctcactgcaacctctgcctcccgggttcaagcgattctcctgagtagctaggactacaggtgcatgccaccatgcatggctaagttttgtatttttagtagagacagggtttcactatgttggccaggctggtcttgagctccttgacttcagataatctgcccgcctcagcctcccaaagtgctgagattacaggtgtgagccacggtaccctgccaacccattgattttctatttcttatttgatgctcactaccgtgaggtggatgaagcacttattattgctcccactttccatgtaatccagatgtctgtccccgcaaacccaccagcctggggatatgaatgaggttaccttcccattaatacttgaagcctactagttccaagcccctacctgctcatgcagaaagcccagttctttcaaaagcctacccaagtgtttttgggagtccccaaggggtgcgtttcctgtgttcctgagtcagggccccagccatgtgccacttgctgtgtgattctgtgggtctgtctgtactcagaagtgcagatcatgctgggtcactccagccaccaaagttttggtgccagtagggcttttgcagtttatggactcttcttcaagtgggaaaaattgtttccttcctctgtattaacctcaattgaagactgtctaggaggttgctttagttccacagtgttagagaattgagtgaggcaactcttgtaaggtgtatagatccctttatcctcatgtggctccagtgtggctctgtcaggagggttcaagatcagatgttttgctatttccatatcctttccccttccaagctgcaggacctgtgtctgaaactttctgtaagattcttcttttccctgtgggaattatctgctggttccaccatctacctctgcaaacagagtccactggacatacttatacaaccccagttatgatcaggattctgagctctgcacagcccacagaagcatcctaaatgcctgtgtaaattgataataaaaatagataatcagggatatgatgtgctgcccacccctaccactcgccgtatgttaagttactttgggtctaagtagaggcagaatatcacagtggatgagagtgtgagctgcgaagtcacactgtctaggtttgtatgtcagtgattagctatgaacctgggccaaattacttaaactctctgggctttgttccttcatctgtataatggggatgttaataactgtacctacctacctcattggatgttgaaagtttaaaagaatgcctgattcaatagtcagtatttcatacatattagctattatgaacaaaccactctgcatacagttaaaagaatttgtcaggcatggtggctcatgaccgtagtcccagctactcagagcctaaggcgggaggatcacttgagcccaggagctagagtcccacctgggcaacatagggaaactttgtctctaaaaataaatacataaataaaagaacctggagtcttgaagagactaagtgactttatccctagtcacatcaatttggaagtagcacagatacgatgttcgtcagctagccaacagatatacactgagtgccccccatgtgccagggtttttctagcgtctggagatagaatggtaatgaaggcaggtgagcttgctgagaaatacagtacagtcattttctgagacctagtccagtaagtccttcccgccccccatcagtggttgtgaaactttcttttttattttctttttcttattttattttattttttgagacagagtctcgctctgttgcccaggctggagtgcagtggcgcgatctctgctcactgcaacctctgcctcctgggttcaagcaattcttctgcctcagcctaccaagtagctgagactacaggcgcttgccacgaagcccaggaaatttttgtatttttagtagagatggggtttcaccatattggccaggctggtcttgaactcctgacctcaagtgatccacctgcctcagcctcctaaagtgctaggattagagccatgagccgctgcacgcagccgaaactttcttttttaaaccagataattctttatttcatttcaaaaatcagaggcaatctacacaacaaaatggaactgcctcactcccccagtagaagggagtaggggcttgggctccctttcacctggagagcagcctggagggtatcaggaggaagccatttgaaacgcagcaacagaggctcctgacagtgcctcacctgatggcgtttggactgaggagacagagttaaattgtaaaaagtgatttatttctatgtcagaatgttgggcaagatatcatttatatagatatcatttaattgtaaccaattcatgaaggtttgagtcactgccattgaaaatttgaaatgatctccacagccacagacatgtgcccacttttgtcttccttcaaaccattgcaaatttcttgattacctacaatctgaaagcaacattgtttttattctgaccatgtctcctaaaaatattttgttggttttaattttctcaaaggtttatattttcccctaaatttaaaaataaaatagttctgtctactcagtccaaaagccaaaaaaaaaccccaaaacaaaaaccaaatcacttgttagagtatatgataattgtgtagtatgagtcactccatattattactcaagaatctacttttatatcagtgtatcatatcactttatttctcactagaagtatagttccagggttgtcacagaccctttgatcataaatgtcacatttaaatttaaaaatgcaacctcaagcttgtgttgactgatggcatccaagtaggatcaagacaggggagccttgtgagactccatcatttaatggctattcttccgcagctctgactttccaagggagggtgtgagagtactctgcatatatcaccagcacttattgagcaccaattgtgttctgacactggagtttgacatagattattacatttaatcaggataataccactgtgaagatattttgtccacttgagaaaatatgtattagaaaggttaaataacttatttgaagcctagacttaaatccaggttgtcctggatctaatgttggtgcttgttctgctgagcatattttcatgtcctctaaccatgtgagattctaggatgttctagggcagtttgcttctatacttgctcccaaagcctagtttggaaactattctacagtggttgtgagatcacatgtttgcaagagaaaacttcttggtgaagctggaggggacattaacatatgttataattattttaaaacagatatctcttcccagtggatggaaaaataaataaataaaaaattagaaaaccagataaacatctgaacaatgcttttggattgtattgaacaacattccatacaagttctgatttcaccagctttttgctattatatactctctatttttaaaaatagcatgacaaagctagtatatttgtatgttgtatatgtgaagtgtcataataggaatttgttctttgacattgttgctgtaagattcgtttggtggagagctgaaaatgtttcttaattgtgtttatatttccctaggcatggcccttcctggtatgtactttaactttccaagtagctaaattattataattatatatgttaaattaactggaaatggttaagaacataactaaaagaaaatctacattaaccagttggaatcgctattagttcatgatccaaccagctatagtagaataacactgtatttttctttagactggagtccaaacaacaggaaatttcccaaccagatgtagctattgtgtatgatgtagcatttggctgacaaaagtaaacttgtttctaaattatcattgtacattttgttcctgagtcttttacatttatgatcctcttccaatgactgttggtcctcatttagtttcacaaagctggaaattttttttcctacagtgtttataaaagattttaagttgatgaagaataaatcgatttaaactgaatgtacctggttggattgtgtatgattgtacttcatttgtttgcaatgtatgattatgcatgaacttaatttcaagccattatggttgcttgttatggaactgggagtaaatatacatttgctgtgactgtaaacttctgcattgtacaagaatgaaaaggtagaattctgaatatgtcatctatctttggtgttgctttcatcattgttgtttttcctttaaaaagcccagttaagcaataaaaagtaatttaggttttgcacagaaacagtcccaaacaaccatgaagcagatctataaggctaacacagaaggcttgaaaattattgaaagcaaaagaaaaatcattccattgaacaataagctatctcttggacttactgtggttaaagaaccacaatattctttttcaaaataagatataccacaataaaataatcaaggcagtgcccaccagagccaaatgaagcacatgaaggaaaaggctgaaaactcaagtcagggttgaaagtcatgggtgatgtttcagcacagttcaagtattacatcttagtaatagttggatacgtttatatattagaaaggttgataaagatgatagggaaactacagtaaatctgtgtatacacatgtagtgttgtagctacaggcttataagatcagttggcattattacttggcagaactcctttctataacatcccacagattcacttccttattgagacaacctgccagagtgttatttagtcatttcagattttcactcaaggccaagatgaaggtagattagaggctaaattggtcaggaatctagtggacaagaggaggtggctgcaacagtgaaacatcccttggatttcaagtcagaatacttgatggaaggcaacgttacagacgtgttgcaggcagcgctaggttctttcagcaccctgctccacattttgctttgcattttgctttatttcggccaagtcattctttataagcagaggcaaatatcatggtcttcctttcagcaatgtggtcagtaagcaatccacagaaagcatgatttctagtgacaacgacagcatttctgaaggggttattctttgttagcctctctcccttttcctcaactagactatgcagtggatttaatcatcttccatcagcaacctccattaacatagtgctttacagtttgccccctgcagcaacccatggagatacatgtcatttattagcccatttttccagtgaggaaactgagtttagaaaagttgaatgacacacatagtaaaagggagaactgctgcctttgaatttagtgttctctgcaaaggacttagctgctctaattgcccgagaacgttgaaacaaagagttatttgaatgacacaccattactttctgtatgtacacagtatctagtttgtggtttataaagggtctcaaagtatattgcaggattttatgatagaccggatttgtttattgccggcagttgctgtctatttccggtgacattctttaggttctagtaacctttggagagtgtttaaaaggtgcaaagtgatatgcctggaaagtttagtttcataactactagggggagtcttatgccccgaaggaatagaactctaatctttaactctgtcagaggccttctaaatgttgcattgaaaagttaggtttaaatggcttcattaatcatggcacattccctcaggtccataaataactgcatttgcttcctctggagttaaatgttttctttattcaccttcctttcattctcttctgaatcttgaacttgagaactctcacaaaattgtccctaatattattttgtgttatacgcttaaccatgagccctcattttctcatctgtgagtataattgagagaatagcctatttgtgagggcatcattgtaggaggaacaccgttttgtacatttttttacattatctagaatcatagagaaatgagatgtttttagaaagccaaattttatccctttaagccccagactgaaaaccaactacacattaactatcttatttagaaacatttcaaaatagtcttactaaaaaaaaaaaagtattcactcaaaaaaaaagagaatatgttcaatataaaggaacttttaaaaatgactctgtcattattagttttaccagttattaaactgggcactaatgtaatggtgccctgaagatggggagacctgtgggattgttggctcccacactaaagaacccccataactctgtatttcagtttcagtgttagaaccttgtatagtcagggttctccagagaaacagaacaaacaggatgcatatctgtgtgtctatctatatacagatatgcatctctctatatagacatagatataaaatatatgtaacatatttaaataaatttatatatatgcatgtacatatattaatttatacatatattaattatatatatacattattttaataaattatttattattatggagccttatctctctatgtattatacattgatatctatatataacatatagatattatatctgaattatataatatttctgatatatatctgaatagataacaatatatctgtatgttacatatggatatctatgtattatatataggtatacaataaatctctgtctatacacacacacacacacacacatacacacatagaaagagagagatttattttaaggaattggttcgtgtgattgtggaatctggcaagtccgaaaactgggaggctggggaccccgagaagacctgcggttcaagtccacaggcggtctgctggcataattctctccttttctggggagaagagtcttttgtctaattaggcctttgactgattggatgaggcccactcacattctggagggtactctactttactcaaagtctactgatttaaatgttaatcccatctaaaaagtacctctacagaaacatctagaataatgtttgactaaatatctgagtactgtggcctagctaagttgacatataacatcaaccatcacagtttctatgtgtattttttcagtagttttcctgtctcttcctttgtggtccagctgtcattggacatttcttgctgctgaagatgtagcttctctgaataccacattcgatgccttctaatttgctgtgctgtatactgagaaatcagaacaccctgtttatttaaattcctcttaaagcaagagactcagcataatggtgagaggagctcacactccagagaaagtacatgtgcgttaatgacttgatgtcatttttcactcctctgtggttttggacagatgattctcaactgtggttgcgttagcaagacctgtgattcccagataagtgagattaccagtatcctaaaaaatatttaggaaagagggagcaggagggggaagaaaaggtgattttatgctgaaaccaccatgaataacatcaagaggactgctcgtttgggatcccatagattagtgggttttgttttgttttttgagacaggatcttgctctatcacccaggctggagtacagtggagtgatcagggctcattgcagcctcaaactcctgggctcaggtgaccctcttgcctcagcctcctgagtcgctgggactacaagtgcatgccaacatgtccagctaatttaaaaaaaatatgtgtgtatacacacacacacacacacacacacacacacatattttttggtagagatgaggtcttgctgtgttacccaggctggtcacaaactcttggcctgaagcaatcctcccatcttggcctcccaaaatgctgggattataggtgtaagccactgcacctggctgaaaatacattttttacaagtgcatgagatgggtacagaaaatagaatgaataagatctagtatttgatagcacaacaggatgactatagtcaataataatttaacggctgggcacggtggcttacgcctcttatcccagcattttgggaggctgaggttggcagatcatgaggtcaagagatcgagaccatcctggccaacatggtgaaaccccgtctctactaaaaatacaaaaattagctgggagtggtggcacatgcctgtaatcccagctactccggaggctgaggcaggacaatagcttgaacctgggaggcagaggttgcagtgagccaagatcgtgccagtgaactccagcctggcggcagagcaagactctgtctaaaaataaagtaaaataaaataaattaacagtgcatttaaaaataactaagaggataattggatttttgtaacacaaaggataaatgcttgaggtgatgggtacctcatttaccctgatgtgattattatgcattgtattcctgtatcaaaatatcttatgcaccccataagcatatacactatgtacccaagaaagttaaaaatttaaaattaaagaaaaaggtgaatgaggtattacccagattgtggctgattagtattaaaaaagacaaacacacagctgtcataagtaacttattatacaaaaaatgcatattctcattcccatagattcatatcaattatctgatttttttctttgttttcaattcagtgtattggtatgcagatagagcctaaacaggtaatgaaataagagacttgcttaacgttcttacaagtttcatttccaagaaagactagagagttttgttttggtttgttttgctagcttaattttatttaattgggttttggaaaattttaaactccctactgcattgaggtcaggacttagatatgaaaagggaacccacaaagaggcgtttccaaagttagatcacttatggaggccacctccatgatttaaaactcaacccacttttcacatatgctccacttgctttgggaagcccttcaaggacttgtcattatagaatctagagaaactggtgcagctaacacaactacttggatttgggtcttaatgcttcttgaaggaaatgtttggaaggggcattgtgcacatttgattcatgcttcaaggatggcacaccttatatctagttttcgtgcatcacatggctctttccacagatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaagtaagtcacaaaacctttggaaggactttcttgagctatttaaactgagaagaaaaataactctttttaattcctttgcaaaggacttagaaaaactgggattaggtggaagaatgtatttctaaggtagtgtttgcaggctttgcctcaggagatgtttttagaaaggtgcaaagaaatgtctttctgtttgaggtctggtctcaatgatctcttgagtcctcagattctgcagtggctggcatcctcagctaaatgggaccagataagaaatttagtctgacaacatgagtagagaaacaaaatcatagctgtagctatgcacaaaaccataatcagagcttgcagccctgcccatcttgaaaatgcgcaaggaacataagtatcttcataaagaatggacccaaccaaatgctggaacaagaactcagagttcatgctctgtggctagtgagggggtcaatgatactctcttagtaaatgatactctcttagtaaacaaaaatcagcacagatagtggcagagtttccagaggaaagatattttttcagtggatatttttaagattgaaaaaaatgtgttcatctgataggatcaggtagggtctatcatgcctaaagggaaaatagactaactcctcagattccttcacagcttctaattactgtcggtgatggggtggggtgggattttattaagttgctggctgtggttcatttcccacaaagaaaaatacatgaaattgaatggtaaaaccatccctcatccaagataagagcagtagggtggaaatgaaaaaagtcatatactactaatttgacttctcaaatctcccagcatgtccctttcagcatgttcacaggaagagagagcactgtcagacccaggagactctaaaaagcctgggattagacaaggcatgccctccctctgggcctcagtttctttattataaaaggagaggccaggctgggcgcggtggctcacgcctgtaatcccagtactttgggaggccgaggccagcagatcacctgaggtcgggagttcgagaacagcctggccaacatggtgaaaccccgtctctactaaaaatacagatattagctggacatggtggcgggcacctgtaatcccagctactcaggaggctaaagcacgagagttgcttgaacccaggaggcagcggttgcagtgagccaagctgccagtgtactctagactgggtgacagagcgagactctgtctgaaagaaaaaaaaaagagaggccagactcaaaataactgtaagatctcatccagcctcatgaccctgtcaaaagatatggcttcttttggtcttcatttttgttacaaaatgttccaagataggaaagaccttttaagtcccctgtttgtggcctctgaagaccttctctatctgaacacaaaaggtcaatggcaagcaaagcagctttttcatttatttatttttattttttaaaaatttttatttatgattttttgagatggagtcttgctctgtcataatcatataggtttgggattttatctttactcagtgactgaaagaatagcaacctttggttatggttatgtcagctcagatatttctaccctttgggaatgatattcgcatacacatgactagcactaaaaaaacctgaagagtttcttaagtgattacaggcatacctcattttactatgcttcactttatcgtgcttcacagattttgcttttcttttcttttttttttttaacaaattgaaggtttgtgtcaaccctgcactgagaaagtctgtgagtgccattttcccagcagcgtgtgctcattttgtgtctctgtgtcacattttggtgattcttatgatattttagatttcttcattattattatgacctgttatggtgatctacggttagtgatctttgatgttactattgtaattgttttgggacaccacgaattgcacccatatgatggcagacttaattgataaatgttgtgtgtgttctgccttctccactcactggccattcccgcatctctctccctctccttgggcctccctatttcctgagatccaacaatatttgaattaggccaattaataaccctgcaatggcctctaagtgttcaggtgaaaggaagactcacacatctctcactttaaatcaaaatgattgagcttagtgaggaaggcatgtagaaagctgaaattggacccaggtgcagtggctcacacttgtaatcccagcactttgggaggccagggtgggcggatcacttgaagtcaggagtccgagaccagcctgaccaacatggaggaaccccatctctactaaaaatacaaaattagccgggcatggtggtgcatgcctgtaatcccagctacttgggagcttgaggcaggagaatcgcttgaacccaggaagtggaggttgcactgagccgaggtagcgccattgcactccagcctgcaacaagagcgatactccgtctcaaaaaaaataagaaaaagaaatttgaattaggcctcctgggccagttagccaagttgtaaatgcaaaggaaaagttcttgaaggaaattacacacagtgagctaacaaatgataagaaaacaaagcagccttattgccaatgtaggggtcaagggaaaacttcccctttgccccctgaagttttgctgaaaaggcaactgacaaaaggcagattaatgagaaaaggcatccagatttattactgcacacggggaaaatcacagagtgattactccttaccccgatggggtagagaagcttatataccatcctgagattatagaaaaaatgaaggctcagaggatggccaaaaccaggttatggcaggaaatcaggttacgctggtaagacaggttatgggagggagggaagagaaggcctgtgtagcaaagatggtcttgttatatagatgaaatgaaattttagaggtaaatgtttctttcagacctttaaatgtgtcaaagtctcagttaatgtttcctagatccagcaagagaaggcccttagagaaagcctggctgtatcaatgtagattttctcttcaaatgcaaatgtaccccacaaaaggcagatttttagctatttttgtattttccagcccttttgaatagccatcttgaactatgtcaaagaaatatattttggggtaaaatattttggtttccttaacagatatggagaaggtttgagtggtcttgtccaaccagctacaacattgccttaagccaaaacacctaattcagagcaaagccctaactcccttcaattctatgaaggttgagagaggtgagaaagctgcagaagaaaagttggaagctagcagaggttggttcaaggggtttaaggaaaaaagccatctccataacataaaagtacaaggtgatgcagcaagtgctgatgtaggagctgcagcaagttacccagaagatctagctaagatcattgatgtaggtggctacactaacaacagattttcagtgtagaagaaacagccttctattggaagaagatgccacctaggattttcagagctaaagaagagaagtcaatgcctggcttcaaagcttcaaaggacaggctaactctcctgttaggagctagtatagctggtgactttaagttgaagccagtgctcattggccattctgaaaatcctagggtccttaaggattatgctgaatttattcttcctgtgctctataaatggaaaaacaaagcctggatgatagcacatctgtttacagcgtggtttactgaatattttaagcccactattgagaccgactgctcaaaaaaagattcatttcaaaatatcactgctaattgacagtgcacctagttacccaagaactctgaggaagatgtataaggagattaatttgttttcatgcataacaccatccattctgcagcccacggatcaaagagtaatttcaactttcaggtcttattgtttaagaaatacattttgtaagggtatagctgctctagatggtgattcctcagatgaatgtgggcaaagtaaactgaaaaccttctggaagggattcaccattctggatgccatcaagaacatttgcaattcgtgggaagaggttaaatatcaacactaatgggagtttggaagaagttgatttcatccttcatggatgactttgaggggttcaagacttcagtagaggaagtaactgcagacgtggtggaaatagcaagagaactagaattagaagtggagcctgaagaagtaactgaattgttgcaatctcatgatagaatttgaaaggatgaggagttgcttcctatgaatgagcaaataaatcgtttttttgagatagaatctactcctggtgaagattctcttgaaatggcaacaaagtattcagaatattatgtaagcttagttgataaagcagtggcagcctgtgagaggattgactccaattttgaaggaagttctaccatgcgtaaaatgctatcaaacagcatctcatgctacagagaaatctttcatgaaagaaagagtcaattgatatgaccaacttcattgttgtcttattttaataaattgccacagccaccccagactttagcaaccatcaccctgatttgtcagcagctattaacacaagactctccaccaggagaatgattacaactctctgaaggctcagaggatcattaacatttttagcaaaaaggtatttttaaattaagataggctgggcgcggtggctcaccctgtaatcccaacactttgggaggccgattgtttcagcccaggagtttgagatcagccttggcaacatggcgaaaccctctccctgctaaaaatacaaaaaattagctgggcatagtggtgcacacctgtagtaccagctactcaggaggctgaggtgggaggatcacctgagcctgggaagtcgaggctgcagtgagctgtgattgtatcagtgcactccaacctgggctataggagtgagaccctttctcaaaaaaaaaaaaagtttagataatattacattttaaagacataatgccattgcacacttcatagactacagtatagtgtaaacataacttttaaaatgcactgggaaaccaaaaaatttgtgtgactccgtttattacaatattcactttattgcagtagtctggaactgaacctgcaatgtttctcaggtatgcctgtatttttttcatcatgccttacaatgcatgctggcagatggaactcagaattttagaatttcttagaagccaaggagaatggtggcatgacttgtgtctttgacaatattttcagtgattctatacctttaggttattagggggactcgataaacattcccagggagctaatggtgagaaatgagccttggataaccagagagagaaagccactcaccctgcagacattttgtgcaaaagtgagagagattgatgaagattgttgaagattgtcgcatgtaccaaacacacaagttttattggcaaaataattctttttgctgtgtccttttttagcactctgaaacccacaaaaacactttaacacaggtttttagaaccccacagcttccaaaagtaattacttctgcgggaatcctgggccttattctatttccatgtggcactgggagtgatatttgcaaggaaaatagagtcactaggaaatggtctgcctttgttacagagcttatctccaacgtcattcttgaccttccattcaaggcatccagccctctctttggcatcactaagtatagaaccgtgtgacatgcgctcaaatgaaatcatcaggaggagcaggtgaaacttgtaaaactaatgcttgctggggctttgttgcctttcgtccatggctcccagagatttgtcaagtagtaattatttttcacaatgctcttggtgaggaaagtaagaatcattactcctgttttgcactctacattttcttgtacaaaccaagagaacagaatatgacttctcaatgaaagatgggaatgagagtttatagcctttagctccacaatgaaaaccatatggttagttatatcaacagaatcacctgaggagctttacaaatcacccatgactggatcccatcctcacagattctcatttaattggctttgagtcagatctgattattgaggggtgggtagttaaagctccccgtgattctaatgggctgtgaaggttgagaactattgagttagataattgtttggagctattttctttagggccccacctgcatatatcctgcaagtacctcaaactcaacatgtttaacctccccccaagcctgttccccctactatgtctcctatcttagtgacagcttcaccatccaaatggtggcctgtgaccaaaacctggatgccattcttgcttctctcttctccccttgtccattcagtcaccacgtcctgccaaatgtagctttcagttattgcttgaattcattcactcctcttctattccatcttgggtcaggacatttcaattctttcctctctcttgtcttactcccccataatctcccactctttagctagagtgaattattcaacttttctttggaaacccctttattaagatacaatttaccgcaaagcctcttgccaccaccagccaacacactccctcgtccagtccttccagagctggtcattcgatcatgcgctctctgacttttgcacatactcatccttcaacctggcacactgtttcttccacctctgcctccggaccttattacctcctttcagaagtcagcactgactcctatgacacatgagcataactgagtgccccttctttgtcctcccagagtaatttggacttgcccctttcatacctgtgacaggtgaagctgaaatgtcaatatgggggccactgatgagaggcagtgggtgcagtgatgagaagaatctggtttgcaggagtctgagatttgggtcttggctttggtaagaaagctctgtgcacttgaactctgccacttcccctctgtaaaactgccttctcttctgaaaatgaggacattaaatctacattacctccaggttccttaaagccccagattctgtgactatgactgatagcacagaaatgaatgtgtgtgtatatatatatatatatatatatatatatatatatatatatatgtatgtattctcctcttgtaggcattagtttttcttctctttgattctgttctctgcaccctttcatcatgaccttatcttgctgaatccaccatttccttccttctttctggtttctttcccttctctctgctccctttttgcattctttttcaccttcccaccctcagctgctcctccctttccaattagtgcattccctcatctccagattgtttcttttgagtcttcctctccttggcctctttgagcctatttatcatagctttcttagtctttacgctagtggttgagcttatcctctcctttatgcattcttgtgtgtaattttgagcccaattccctatttgctacttcactgggctcctgaagcctgctccccattccttttggcgcatctagttctgcaaatcctctagctgtggcccccctgctgtctttggcaggaagcttggaagggggtggggacttctaggccacaaagccctgggaaattaagcagagcctctggatctcccttcctgacagctggacacagttctggcgataattggaccaccttagggatagagatgccccttgtccctccccatcccagaaatgccaaacacatagttttaacatctctcttcaaacagacaggtttttaggctggatggtggatgaattcggtttgatgcccccttcaccaatagatagagcaatatacggtggacccctagtgtccagaataaattactgcatcctcaggggtttggaggtcagttctcaaaattgtgctgtgtccaactctaagcaatgaggagaaagtagatgtataggtatggatatttgaaaatgttcttgttgaattatctgactgagcacagagtttagaaaagaggccatgaaaacacaaccgaaaaccttgcataattgccttctgtctaccgcagggtttctcagcctcagcactgttgacatattggactagataattcttcactgagagggcagttctgtgcaatgtaggatatttagtagcatccctagcctctgttcaccagatgccaatagcacttcagtcatcacaatcaaaattatcttcagatattgtcaaatgtcaccaggagtgactaaatcagcctctgtttagagccactgctctatcccaatcccccactccctgaacctctctggaatgcaggtcatggtaaaccccaatatctggccataatggggactgtgaaccaggtccaccatcactatcttcgtgtcttcctactaggtgtttcaaatcagctttctctcactcactcttgcctccctcttctctgctaacatttcaggtaaccaagttgtatttggaaagtggtgaaaggtacttggggtttgattagggggaggattgtaaaaccattacatgtttgactgaggaatgagattggctgtaagtatttgtgtcagtgactaggagagacacagctctgtaattgattatacttcaataccagatggaaaatatttaaacttatagaaaaaaaacaaaggttgccatgtttttcttttctttctttcttttttttttttttttttttttgagacagagtcttactctgttgcccaggctggagtgcagtggcgagaccccggctcactgcaacctccgcctcccaggttcaagtgattctcctgcctcaacctcctgagtagctgggattacaggtgcccgccaccaggcctggctattttttatatttttagtagagacagggtttcaccatattggccaggctggtcttgaactcctgacttcatgatccacccacctcagcctctcaaagtactgggattacaggagtgagccaccatgcccgaccatgtttttctttttcattagtttcaccattcttcaaccctggcttacccctaacatttgtggggcccagagcaagaatacaaatggagagccatacatcatatttaaaagttacatgtgtaactaacaaactgctaaataaaatgtgtttgatccttctactttgacaactatgccttaatcacaaactggaaagccaggttcaaatatagacttctgggttctgcatcagaatatggtagtgtgtggagagttggcccttggcctttcaccaactctcccttctccttctatgcttggcctcttcctatgctatgtgggtcctctggattgatttgtgggcaccccaggctgcatggctgagctctctccacaacctctgcagaccctccctgcttggcccgccctcagaagtagggctgctctgagtgtgtggtccaccctggaaagacaggttgggagatgaagctctcccaggcctagcagcaagctcagagttgattgggcaggaaattctagagttctgggtaccctgattatgatcaaaagagtaggtgatgactctgggtgggtcttcccaccaagggtctccttgcctttatgagatagacacaaccaaagggggccagagttgggccatctaatgtgtgggacactatgaagatggttcttctgcaggtctccaggtgctcttcacacccaccctttcctgaagtcacattttcagctgagactgggaatagaaaagtgattgcttctaacctcagtgaaataaatcctcagtgagttaaaaaacggtggttcctctaaaaaaaaaaattaaggtaaaaaacagaacataaaaattatcatcttaaccttcttgtaagtgtgcaactcagtaatgttaagcatattcacattgttgtgaaccaaatctccagaactttgtcatcttgcaaaatggaaactctacacccattaaacaactcccgcggtcaggcatggtggctcacgcttgtaatcccaacactttggaaggccgaagttggaggattgcttgagcccaggagttgagacctatctggttatcatagtgagaacctgtctctacaaaaaaaaaattttaaaattagccaggtgtggtggcatgcttgtagtcccagctacttgggaggttgaggtgggagaactgcataagccccggaggtagaggctgcagtgagctactgcatgccagcctggtgacagagtgagacctgcctcaaacaaaaacaaaaacaactcccctcttcttctttcctccagctcctggtaactaccatccttcctccagcccgtggtaactaccattgcactctctgtttctatgaattcgactagaattcatagaaatttagatacctcatataagtggaatcatgtaatatttgcttttttgtgactggcttatttcacttagcctaatgtcctcaaggttcagccatgttatagcatgtgacaggatttccttccttttaaaggatgaatgatcttcccttgtatgtgtataccacattttatttacccattcatccatctatgcacatttgggttgcttccacctcttggctatttgaatagtgctgctgtgaacatgaggatacaaatatttcttcaagactctttcatttcctttgaatatacacccataagtaggattgctggatcatatggtagttccatttttaattcactgaggaacctccatactgttttccatagtggttgcaccttttacaatcccactaacagtgtacaagggttccaatttttatttttctacatcctcaccaacaccaacacttgttttttttcttttctgtgtgtgtgtatgtgtgtgtgtgtgtgtgtgtgtctctgtcacccaggctgaagtgcagtgacgcaatcatggctcactgcagcctcaaccttcccaggctcaggtgatcctcccacctcagcctgctgagtagctgggactacaggcatgcaccaccatgccagattaatttttatattttatgaagagatggggttttaccatgttgcccaggctggtctcaaactctgggcttaagcaatccacccaacttggctcatgctgggattacaggcgtgagccactgtgcccagccattttctgttttttaatagtggccatcctaatggatgggagatgatatctcattgtagttttgatttgcatttctcataattaatgatgctgagcatcttacatgcttttggccatttgtagatcatctcaagttatgtctattcaagtcctttgcctatttcttaattgggttaatttttttgtcattgagttgtaggagtttttatatattctggatattaaccccttatcagaaaatatgattttcaaatattttctctttctataggttgctttttcactgttgtgttctttgatgcacatatgtttgaagtagttgcaattttttttgcttttgttgcccatgttttagatgtcatgtctaataaatcatttccaactccaatatcataaagctttttcccttatattttttgtaagagtttaatagttttatgtcttacttttaggtgtttcatccattttgagttaaattttgtatgtggtgtaagataagggtccaacttcattcctttgcatgtggatatccagttttcccaacattatttgttgaagagactgtcctttcccccattgagtggtcctggtacccttgtcaaagattatttttaaaaatagggttttagctaatagtctatgtttagccttagatgtgaatttggctacattttgctgcgctttggagatttccttttgttttaaaatcagatataattgaagaaggctgcttcttttgagaatttccatagaaattgtgcccaacaataattaactggaagaaaacaagttgtccgatttttcccccagggtctctaatttaggtcttcattggaaatagtctaagatacatcagactgtattaggaatgtactagcagcagttctcaagtatggcttacaaaactgagggtccccaagacctttctagagaatccccaagttcaaaactgtgttcataatactaagacattctttgcctttttctctgtgttgacatttgaattgctggtacaaaagcagtagtggttaaaactgctgtaactttagactcgagacaatgacaactatgtccatagtcactgcactattcatcatcatgcacttgcagtaaaagcaatgctagcttcacctaagagtgttcttgatgaagctgtaaaagcgattattaaatcttggcccttgagtccccgtctttttagtattccattacaaaagaggaagtacacattaaagtacttctgctacatataccaatgtacaatggttgtcttaaggaaaagtacttgcacagtggtttgtgctacaagcaatactagccactattttttttcatggatcaccatgtctacttgaaagcatgagtgataaactatggttattcagatatgactattcggcagatatttttcaaaatggacaaagggaacctgataattcaaggaaaacagctgagagtattcattgccaatgataaatcttaaggtttcaagcaaaatatttttggaaaatttttattcaccaccataagcttggcagattcccagtacttagaaaactttttgatgagactagtagtgatattaacacatgtgtgatgagactagtagtgatattaacacatgtgtgtgtttaaaaatcctgtaatgaaatatgtcaacacttggaagacttacaaactcagtgaactagtagtttctaattggccaatatacaatattgcaaaatcattcatgggtaaatgattcatccaaagcacagtgaactaatagtttctaattggccaatatgtaatattgcaaaatcattcatgggtaaatgattcatccaaagcacaatggatttttaatgtaacagagtatgagaagtgcattaatatggctgcccattccacagtccaacttaaacctttaagaaactgacacttgttgagttttggtgtagtatcagataagaatatccataattgtgcaaaaaggctatccaaatcctcttctcttttccagctacctacctatagttggacttcctttttatacttcagccaaaacaatgtattactacagattaaatgtagacatagatatgagaatccagctgtcttctattaagtcagatattaaaaagattgcaaatatgtaaaacaataccatacttccctacatttggggaggaaaatgcttatttttcactaaaaatgttatatatgttaacaggcaataggtttattaatgttagctttagatggattgataaacatttttaaaggttctcagtttaaatttctaatatgaaaagtaatgatagctataacccacaaaaatgaaagctcatggtggggggtactcaataattttttaagagcataacgggttctagagaccaaaaagtttgagaaatactgtgccagaaatactaaagaactgaaggcagttctttaactgtaacccgagattggtctaaaaggagaaaacttttcagataaaatagaaatcacaattaatcattagcaatcataacaatgttctttctagatggtgatggaaagtggggactggctggttggtggagaccttcaggtgctggagaaaataagatggaatgatgggctggaccaataccgtctgacacctctggagctcaaacagaaatgtaaagaaatgaatgctggtatgtaaactgttcttagtgcattttatttatttatttattgagatggtgtcttgttctgtcacccaggctggagtgcaatggcacgatctcagctcactgcaacctctgcctcccaggttcaagtaattctcctgcctcagcctcctgagtagcttggattacaggtgcccaccactacgcccagctaatttttgtatttttagtagagacagggtttcaacatgttggtcaggctggtctcaaactcctgacctcaggtgatccccctaccttggcctcccaaagtgctgggattacagatgtgagccactgcacccggcccctagtacatttattaatattcccttaccaccctctgattaaagaattaaggataccaggagtcagcattttcttttttaagagacaggtctcaccctgtcacccaggctggagtgcagtggcatgaccatagctcactgcagcctcaacctcctgggctcaagtaattctccaaccttaacctcacaagtagctgggactacaaggcacatgccaccatactctgctaatttttatatttttttgtagaaatgggtctcactatgttttccaggctggtcttgaactcctgggctcaagcaatctccccgcctcagcctcccaaagtgctgggattacaggcatgagccaccatcatgcctggcttcagcatttttatagttaaaaataacctgaaaacatcttctattggtatgtctataatatggaaacagttttataaagttgtactatatattagaaccatatattagaacgctattcaacagtttaaaatattcactgatagagatagctgaagtgtatttatgaagtgaaaaagcaaattgcagaacaatatgtagagcataatcatgttctggaaaacaaaataaaatatcatcataattctaaaatccctaacctacttctgtgcatagtggcagaaaagtctctggcagcacatgccccaaactgcagattacagtggctacctcttggggatggagtttggactaagagatttttactctttattgtatacattttgaaaaagagggagaaaaagtaataataggattggtgatttttatattctattttgggcttttctgtatttctcaagtttttcattataatattgaaagtattcattttcaatactatagacataaaaattatttcattatcagaaaaaaaaattaaggctctcaggagtccaccactaagtggagtagttttggagatttctttaaagcgaaagcaaaatttttttatatctttagattgttgccccttgcacaggccccagaaaacatttgttacaattattcacctccctctaggcttcctggtacaagaggactaattaacactggccctgcctgagccttggtgtacaggaaaggtcctggcaacaaatcttttcattcctgagttaggctgtccctaagcagcttcctgcctctgcatctcatccctgtctcagctatctggtgttggttagtgctggattaacacctctaaagacccaggtgtattctccagctgattatcagaagccagtggataggctgggtgcagtggcttacgcctgtaatcccaacactttgggaggctgaggcaggcggatcacttgaggtcaggggttcgagaccagcctggccaacatggtgaaaccctgagtctactaaaaatacaaaaattagccgggtgtggtggcacacgcctgtaatcccagctactcaggaggctgaggcaggagaatcgcttgaatcctggaggcggaggttgcagtgacctgagatcgctgactgcactccagcctgggcaacagagtgagactctttcaaaaaaaaaaaaaaaagccagtggataatgaatgcacagaacaataaacatagctgtgtcctttctgttcttgtggagaaatgacaccatgtgtttctgtgaccttccttcttctgctttcctctcccagatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtgagcaattcccagagctgggctttgagactcaggaattcagactcagactttacatagaagagtaaatgagtctctgggatcctttctgtttcctcatgagcagattctggaatgttctggtgtctcttctttatctagcttaattatgtttccacttagtatttgaaaagtgctagaaggccaggcgcagtggctgtcacctgtaatcccagcactttgggaggccgaggtgggcagatcacaaggtcaggagttcgaggccacctgaccaacatgatgaaaccctgtctctactaaaaatacaaaaattagctgggcatagtggcatgcccctgtaatcccagctactcgggaagctgaggcaggagaatcgcttgaacctgggaggtggaggttgcagtgagccgagatcatgccactgcactccagcctgggcaacagagcgagacttcgtctcaaaaaaaaaaagaaagatgctagaaacatcaaatcaaacctattatacattgcctttgagaatatggaagttggcaagtgaatgaggtggctaatgaaacttaactgggtgatagggcaagttgtatgtaacctaatattcaatttcagaagttccagttactctccatgccctgtgagcttcattaggaaaggatatctttaaaagataaatgtcacccttttatcataacacagtgagcttatcaaacagagattttctttgtcccactgcaccaccagtgtagtggatttgaacgagctggctgcaagtatgatgaatagaaagggtctcaaccctttggaatgccccaaactgagtttaatgaattaattctcttcaatcagataaaagttccaggcccctagctctcctttccatcctttgtattgctatctgagctttaaagagggtaagtgttatgttgaactgaaatcagcatttgtgtgtgaaaggtaattagctcattaatggcagtcagataatgagatactagagttggtaatttcctttaaactgcaatttattgtgaatagggaggcactggaaagtaaaatccacatagttctgtagaatagtaagatttgagtgttcttgtccggctagcctgtttggagaagagatgaggaaatacaaccttgagttatgagggaggaatcttatctttagagctcctatcctacctaatataacaaagcatgaagagtgcacggagtcttagaacctcagtgattttcttgcaattcttagttgactcacattgctgaattacttttaaagtagaataaaggtgtctccataaaccatgacctacagatttgacccacaatgaccagcatgtcccttatggacattttctaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggtaggttttcagaggaaaattcttttatcaacatctgtataaaagaaatgatgaggcagaatttgggccctttgaaaaactctccagtgcattgccacatgctcccaagtggactgagtcccttgagagtcaagacgtggtcttataaattttatgtcccctaaaattgtactacagtcttctgcatatagtagatggtccataaatatttctctttcaacatgcattcttgagcatgcacagagtgcctggcacactaagtgaaaggaagcaacatagaaagagattgcaatgaatatttatggtgcacttgctcctcatgctgagggttcacagaagtaggcagagaaacagaagacagactctgggctcaagacacttcccaggaacagtataggcgcatggcaaatactaaatggatagctgccattatttcccttctcttctgcaagttcctgaagatttagaggactgcccacttttgaagatgcagcattttacagaaagaacatgggtctcaaaaaccataacctactccaggaatccttaaggcagatatcatttacctacactgagttctttgttgccaccctgtaacaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaaaatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgac

SEQ ID NO: 36326 - DNA, 33425 bp, Homo sapiens
agcttgcgggacacggagccgcgaggagacagctgaggcccgcggagaccaggggtgaggaggccgggggggacgggattagagggctgacggggctgggacgagggtcaggcgagcgcccaaggcgcacaggggtgaaatgggaccgaggaaccggaggggtggaatcagagggctggggaggcaaggaggccgagacgaggctcacatgggtgcaccgaaagggtgcgggggtgcagtgcggggggccgaggagcaagaggggccgctgcggacatgaggaacccgaggctgggagttggggggctggggagccaagggggcagaactggggggcaggcgggggtgtggccgagccgagggcctggtagggaccgagggctatgaggcagaatcgggtgctgagggggacgcgccccattttccgagatttggcctctccccaccccccaggagcctctgggccggcacgttgccccatatccccccagtccctgcaccttcaggggcccagtctgcctgatggcccccggctccgcggcctcccaagcgtccgtgaagcgagcgtcagctgcacaagtgctcgggctgcagctgcttcagccacaggtctgtgagccagagcctcaggcgcggaggccgggcacattgccgctgggttcggtcaggcaagcccctgaacctgtctgtacaacaggaagaactggctccggctgcagggatttcggcacagcgcttgacacacagtgaggcccactgcatggtggcgggctccttcgaagccttccaccctgcgggacagagtcacacatgtcgtggtggcattccccgggacaagttctctgggcccagctgagctctcaccacgggggatagaaagtggggccggccagcactctgaggccatctccagtctcttctgttgtcaaatttcgctcttttcctcctgcacgcgaggtggaaataccaaaggcattgggcatccagagaccttgattgagttcgctttgccctttcacctgtgtgagaccttaaatgggtgcttgccctcctataacctatttcttcatctgcagtgtagcctgacagtatgtacttctcagcgtagttgtgagaggtaaacaaaacgaatgcatttctgaaagccatgaacctctacacaagttcatttgtggaattcctttaagataccccctgaaggccgggcgcggtggctcatacctgtaatcccagcactttgggaggccgaggcaggcatatcacctgaggtcaagagttccagaccagcatggcaaaatcccatctctactaaaaatacaaaaattagccgcgcgtggtggcaggtgcctgtaatcctagctactcaggaggctgaggcaggagaattgcttgaacctgggaggcgaaggttgcagtgagctgagatcccaccattgcactccagcctgggcaacaagagcgaaactccctctcaaaaaaaaaaaaaaaaaaaaaaaggataccatctgacctgaagccaaccgagtcttttaagacctggcgctgctgcccactgcacccttcagagtggtgtagcttcctcagcccatgccacccgccagtcactcttccctctgccatcacacttaccacctgctgtacacaaagggccatcgtgggctccctgactacagggagcttacagtctatcaagaaagtcaggcctgtagaaagaaatggtcattgcacagcaatgtgactatgcttaatgccatggaactgtacgcttagaaatggttaaaaggatacatagtgtgtatattttacaacaataaaaaaaatttatatatgtagaaaaaaaatctaggatttacatctaactattattagtattagtagttatgaataaagaaataagaatctcttttggtagaaaaaggttggccaggcgtggtgtctcatacctgtaatcacagcactttgggaggctgaggcgggcagatcacctgaggtcaggagttcgagaccagcctggccaacatggtgaaaccccatctctactaaaaatacaaaaaaattagccaggcgtggttgtgggtgcctgtaatcccagctactagggaggcttaggcaggagaatcacttgaacctgagaggcggaggttgccgtgagccaagattgcgccactgcactccggcctgggtgacagagcaagactctgtctcaaaaaaaacaaaaacaaaaaaaaacagttaacatgaatgatgcttttgttacactatagtggtgcagttcccttttctaaggattgctgggtttttttcattaccttggttctgcagttaagcaagactcaacaagtattttttctatgtcccctaaaaaactgcagttgttaaaccctgcattcgttaagcttaggagtcaaaactaatgcactagaggaaaataaatattttaaattaaaaaaaaaaaaactttttacaagtcagatgtgagcaaaagtgccatagagacatgaaagagagcatgctggatccaaagatggggagatttcagcaaagcctcaaaggatctgagagatctcgggaggcaaaatggaaggagggcaccacaaaacaaggaggggaggggctgccctagggtggggggtacacagaaatggaaggaggagccatgagagagccaaagcccagagctggtggccaatgagggacaggtcagggatagaaggagtcagaatgacttcccaggtgtcatcacagttaaggcccaggttccccagcatgaaccccaccctgggactttgggcaagttccttagctcttctgctacagcctgccctgtgaagtggggataaccacaagaggttgttgggaggctaaaagccatcccaggaagagtgctcagagcaggggcggatggcagctggcagcaccgtcagccacacccctgcagctgccccccgatgagtttgctttgccatttctcacctatgtgggaccttaaataggttctaggagggtgagcacccatttggtgtgcagtggggccctgatccaggaggaaccagctgccagtcgcatttggtcagactggtccaggcaggcggtgctgggatgcaggagtccaatgtccctcccatgcccaccccgggctcttggtgatttgcacaggctcatgcacacgtccctcttattcggagtttttcactggtgtgccctgctcaggaaagcccagcaccaggctccgctgcctctggtgctctcccagctctccctactccctgcggcttgccgctggcctccatgccattcctgatgctgtctcttccagttgatccctcaaagaaccacagcactgtcccctgcccctccaggcactcccagggctgcctctggtttcccttggtgaggaatttctccttcctgccgggtgtgccatggtgtacgtcagattcaggagcttattgggaaaaggaaggaaatgattcctgtccctttcgacatctgggctccagggagagaaagctgtgtcctggtttctctcctcaccccttgccttaggttggtgatgcagaaacaagggtgcttggtccccagcaagtaagatggccctgggcaccctgcctttgtaacaagagcaggcagttggcacaggccctgagagtaagccagcctgtcccctctacagatgcagacagagcttcacacacacacatcatcacaccccccagaccttacttagtacacatggcacagacaccattgaggcatgtgcagatagtgggcacaaggcacagagagagcaggcaggtggccacagtgaatcagggtctgtagtgcagacaggaggagccaccctccctgagggaacaggccgattgtggggaggggctcacggcacaggaaagagtaccccaaggtcaggaggcaagaaggaggcacctgcatcccaaaaggtccagcagacgtcaccagcaaatggggtggaagtgaagggtcttgaattctgcccttgacagtggggctttacactgtgggcaggggtttctccaggggggccctctgtgtgctctagcggggagcatgctgtcctctcacttggatcctaatcataaattcacatgagcacattttgtggtgagacagtagagcctccagatcacttggaattgcaagggagtgggaggaggccccaggcactggcagttgctgggggcagctctgcatcgttcacattctcccagaagctccaggggccagggcagtcccaggcagaagaggggcccttggccgcttgcactgcttgagggcagccaagcttgctgggaaattcacgccatcttcgaatgccttacagctctgctggggcatggctggcaggacgtgccgcctcctcattgacctactagggctcccagcctctgctcatttctccagctcacagtcttccctttgtcgtttgaatgtcagtgtccctcctgctctcaaagtgatttttccttttttgctttatgttctttttttttcttttttggtagagatggggggtggggggggggtggcgatctcactgcccaggctggtcttgaactcctggcctcaagcactcctcctgcctcaccctccccaagcgctgagatatagacctgagccacagcgccttgccagttgttttatgttctttatccttttacctgcttgccttctgtaacctgggttgcattaaatttactcctacttgtgagtaaatgtgaaccatagcaataaatttagtctatccccagaaccttcagtagcaagcacccctattcctacgttatttgtatgtgtccactttaaataaattacctttcaattctgcctctaaaagaagagaagggttttgtgttttgttaatttaccacccttcaccccttgcattccaaatccctcactgatcagacatttaacttggtgctgggacctttccctctgcccaccccattctcttttgtgttttttatctttaggcttccagaaggcttgttccaagttagcaattcctgataaggacagccctcttgtgggctgtgagctccctgcatctcttacttcccactctcttcatcctgcacctcaggcccctgccacagccgcccttttagcaaagtttgtaggcagagtctgtggctattctaagactgatgattctagaagattctccttgccttcttcgttcagttttcagaacctggaagtcctcatgaaggtgatgggctgtgaaactgttccccaaattctccaccctagaactcggggtgttcctcagagtctcatgtccgtttgtcaccataaaagaatgcagtttttctccctggcttagtaactgtgtaggatttcttttttatttttttctggatccaatctcatccactactgcgtaggactcgctgaataaagtttcccagcctgagtgttagacaaagcccaaggtggagtccccgctgtggggagggtttggaggggtcaggcacccgagaggaagggggcaggagagagaagggtccatgctgagtgggtgctggcagggaggcccaggtgtggggcctggaggtgaatccccggggcgacgcaaagaacatggaagggggggcgctggagagctgtttgggtataggcaaggcaggcaggctggggaggcgactatggagattcggagttaggagagaagaggagccagagccaccctgggaggaggctgtgaggcaccatgtgcctctttccagtgagagagaagccggtgagggagtgaaggcacaggctttgcgatccctctttggccctgtcttccttctgacacctcaggcgagggactaaccctctccaaaccttgggattctcatctgtgaaatgggggcttgtcctggctcctggggtgttaggggcaactcccagggctggtcagctctggtcatccctaaggacttagggaggaagagcccacatgccgcacagtggggtcagcgcctggaactgtccacagtgcccctcttccagccagggcttagcaggcctgagccattctaggctcacaattccctcctcctattagagagcattgaataggctcgatggtgtcccacagcacctcctgtctgtcccagattaaacctctgcttctctcctggccaccccttgggtggccccagcagcctctggggatcccttcctgctcccactctggcctatctccaaaacagccctgggccggcctcccgcatcttggcccttctctttcctcccctgaacaccactagagccccaacaggtgtccctcctgccatctggtcaccacgtccaggctcacagacctggtggcttcactccctcacctcagagccctcctggctgctcgggacccgtgatcaggttgaaccccctcacctacctcagtgcctggcctcggcatccctgtcctgctcgtctctggccacgctggccaccctctgccaggaacagtcttcctcctctgtcacttcttgacaatgtccacccagctgctgctcctggcaccatctcctgagaccggatctctggatgcccacaagtccccacctggactcatgtcaaaacagtggccagggttgtccctccaccctctagtggccctgaaccatgaggccatgcacctgccacatggtgcttgcaggtgggcacctgcattgctggtgccatggccccctgattctgctgactctgacatttctccccagggtgaagcctggagaccctcttgccctggcctagctgcaggcccccgggatgctttgggcatgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggtaggcctgtgcacccccaaaggggacggggagtaagggcacggcaccagggccgacaagggatgtggctgctgctcccctacacgtccagccccacacggggatctgcagccccggatccctatgcagcaccatgtggaactcccgtggctgctatggcaaagcaccacacactgggcactcaacacagccaaagctcattctttcacagggctggaggccagagtccaagatcaaggtggcagctgcgccatgctctctcaaaggctgcagggaagagtctgcctttctgttagtgcctggccttgacttcctggaggtccttggcttgtagactcattcctcctagctggccttgttgcacacggcatctccccatgtgtgtgtctgtgccttcacacctccccaccctgcctgctgtgtgtctgtgactcctcctcttgtaaggacatgggcattttggaccaggggctgccctcctacagtgtgatctcatctttctttttgtggagaatggggtctcgctatgctgcccaggctggtctcgaatttctgggctccatggatcctcatgtttttgcctccctaaatgctgggattacaggcatgagccactccagccaatgtgacctcatgtgaacataactaattacatttgcaaagactttaactccaaataagatcatattctgagccacagggggctggggcttcaacataccttttagggaacacaatttattgcatagcagctgataagcagtacgtcctgtttccgatccgtgtgatggacgaggaggcagaggtgggtagatgaagaggctggcctgaggccttacagtcaaggagtggcagagccacatggcaccccagccaccacgatctgagagatagctggcactgtcccccttccacaggtgaggaagctgaggcacagagaggtagcacaactagccgagcagatttcggggaagatagagagttgggtgtccaccggcagacagtgtgtagctgtcgcctaggctgaactcagaggtcctttccttggaagacccttgccctccccttcatttattcattcattctggaagcatttgtcccatgaaagatggtgaaggacaaggtcttttctcgaaccctctctgctcagacagggtcttggagttaggctgtctgtctggcacaggggacagctcatggaggtgagcaggctggtgggccgcgtgctgtttctgtgaacctagtcccttgctgaggggatgtgcgcatggtccccagtcccagcatcacccaaatcacctgaaatatcacctgaagccatgacaggccctcagccatagctccctctgacagagccaccatcctcggtggctgcctcagtatcccccaagtgtgcacttcctttgccccttgcagcgaatcaactctgttcctgacacccaccaagggcctattttccttgaccccaggccctagcagagtcagtgacttgtgctctccctgtgcaacatgggcacaaacattgctaagtgtcagccacatgcaagggctatgccacccagcatcccccacagctgcctagagctcaggaggaaatgtccggtgaccacgctccatgaggtcatggcatgcgcaaagggtgttattggcttgttttgaggaaatattttagatatgtggcacaaagtgaatcagcccccagtggtggagcagagtgggcccagcaggggtgccaatgcacgggaggtgaggaaaggcctcacgttctgccttcttgagaggagcaggtggcactctgcagggagcaggggagtccagaccagggagttctgcagccactgggtcttcgtggaggtggcatggggccattgctgccttgaggcaaaaagccaggcccgggacagaagggttggtgcactttggcccaagcatgaggtgaccaggcaaagccaagcggtgccagccccaagctggggatcagatggaaaagccatcccggggaacaacagagcccaggggtttgctgggcctgcgtggggcacaggtgctgaagacggacaggccgcagcaccggggtgacaacatcagccttcagttcctgggcagggggagaagggcgcagagcagggtcccagggaaggatccaaggtgggagggcctggagggctgaggagtgagtaggcagtgcaggtgacctgcccaggagggccccgaaccaaagtgttggggtcagtgctgggggcgcaggggagggcagtgggttttggttttgatgcgagagcagccagacttgttgagcggctgctgtgtgagccacctagtgatgggtgcgagcaggaggggtgcagagctcccgagtctcctcagcccccaggaacccaccttacatggtgaactaaaatggagtatttgaagttgttatatgttccagccatcttattggatttattttttaagttatttttgttcttttctagcatcttctttcacacgcaggtgtggatgtgcataggtgtagtcagcacttggggtctgagcctcacacgttgtctacactaagcctggctgtccacacacacgcactcacatgtgcccatacacagtcacgagttccacctccgagctctgcttcccgtgtcccagcctgaggaggggctcttgggcatgaagggctttgagcatcttggtccctgagctctttcacagaccgtaaaaggcatccttctggaggccatccaggagtcagaacatccagtccacagggggctatttacgccttgtctccgctcttgtttggagcctcctgtcacatatttgagtccctgagcagtgcataccgtacactaatgatttgagtgtggtttttgtctctgccactagactataagcctcttgtaacagcccctgccccaaggtcggtgagacgtgtttctcaggcacctgggccttgcatacaccttggcttgtccctggagcatcttcttgccttgtgtaggagcctgctctgcagggaccagaatcagggtggatctgcatggtgcagtgactcagggctgagggcctctagggcgtgtcccaggccagaccctgggatgaggcgggagctgtgtccaggaagaggacgatggtggcccttggccaggcattgtctgggtccccacagccggaaactgcctccctgccccagcagcagtggcgggtgggcaggaagctgaggcctggcctcaccgggaccaagggaaacaggcgtccttcctccctgctgtgcaaaaggaaaacccagcagttggcaggaaacccccaaatggcagaggaactaatttctcatgtcttggctggttgtttttcaaaggcagttccagaggcttctcccatgagtcaccctttcattttaaaaatcacgaatctgctgagcatggtggctcatgcctgtaatcccagctactcaggaggctgaggcaggagaatcacttgaacccgagaggtggaggttgtggtgagctgagatcacgccattgcactccagcctgggcaactagagcgaaactccgtctcagaaaaaaaaaaaaaaaaatcaggaatccatcccggtagattcctcagaccatcagtagataccttgggtgcccagcccccatggaacaagacctgtcagcctgtgctgttggaaggtcctcgccttccagttaaagccgggagtgtcggcccagtgcagaatcacctcgccaccccaggcatgctcccctgacccccactctcagggacaggcacacaggggtgaatgtgtgttgtccagcttccagggcccccactgggtgagaaggcagattccaggggtcaaaatgcatgttagaggccatagggccactgagggagcgaccccttctgcccagaaaagccagggatggctcagaattttagacactcctccccactgccctccttctcagccacagatggcttcagtgtttctttccctgatctgccccgtggctctcttctgccctgcctacctgctaaaagacgctaaccctcctgtcggtttgctttcagcctgctgcgacctccctttctacccactacgcctcctcaactgctcagctctgttctatgacattgaaagcagtgacccaatctcacttcttaaaacatttccttcgtggcacccagaaggccactcctggagtcatccccactttgctagccatgctctggccctgtgggactcagccccctatcctcattcattccgcagctccatctcctgcccagaccatgttcttgcaggccctcaggcctcttgacctccgtggaacacaagtcgctgtggaaacagagcccattgcccatcccctgcctgactcttccatccccatcagggtaattaactgtaccacgagccttctagttgctcagaatagaaacttcaacactgtccctgcccctccatttatactgcccgactctgtctgctcctgtttgtcaccatggccctgcccagcccaggtcttagactctctcctttagacagtcgtccccttcttgccagcccaccctccacaccagggtcagagaggcctaaaagccccatctgatcatgccatgtccctcttcaaacagaccaaaggcggccaggtgtggcggctcacgccattatcccagggctttgggaggctgagatgggaggatcacttgagggcaggagttcaagaccagcctggacaacatagcaaaaccccacctgtacaaaaaaatttacagattagctggacatggtgatgtctgtagccctaactactgcctgtagccctaactactctggagtctgaggtgagaggatctcttgagcccaggggtttgaggctgcagcgagccatgattgcacagctgtgctccagcctgggagacagagcaagaccctgtctctaaaaataaataaataaaacacagaccaatggcagtgcttccctgttagcataaagcttggcctgccctgttcccacagcccctcaccccggcagctcctatggccccatccgcccagggaccttgtggaccacgcacagccacttcctctgctgagtgtgcccatgggtcccacaccccaggatcagcttcctggagctgctgtacaaatgaccacagacccagcagcttaaacaacagaagtgtgcttcatggtgctggaggctgtcatctgagatcaggatattgacagaactggctccttctggtggtttgtgggcaacccttggcattccctggcttgtaggttcatcccccaggtctctgcctcatgttcccctggcattctctctgtgtgtgtgtgtctgtgtccaaattcctcccccaacctgttttttttttttggagacagcatcttgctctgtcgcctaggctggagtgcagtggcacaatcttggctcactgcaacctccacctcccaggttcaagcaattcttctgcctcagcctcctgagtagctggaactacaggcatgcgccaccacacccggctaatttttgtatttttagtagagatgaggttttaccatgttggccaggctggtctcaaactcctgacctcgtgatctacctgccttggcctcccaaagtactgggattacagatgtgagccaccgcacccggcccaaattccctttttcatagagacatcagtcattggagtaggggcccagcctgctccagcatgacgtcatcttaactaattccatctgtaatgaccctgtttccaaatgagctccattctgaggtactgggggttagggcctcagtgtatgaatttaggggggacacaattcaacccagaacactccccaccccccagggtccccagctggcatgggtgattcctctgccctcctgtggccaggagccatcatcagcatggatgtcaggcagtttacttgcccatcaacagccccctcccaactagccgcaggctcaagtatggtccagctccccaccagatggttgtgcgtctgcctttgctgtcctgtgaccttcctgtcccagctccctgaggacaggggccgccctgctggccgtgacccctcagcatgtgggctgacagttggggaaggggggctaggtgtggtctcctgctgggggctgcccctcacttccccctcctcatccctaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgacctgtgagttctgtttcttctgaggtggccccagggctgcttagcaggcaacaaagggtgacgacattgtgggaagcccattgattggggtccctaagggtgctggggccctcgctcacaacggcagcagaatcaaggagcagagaaggcttgcggccccagtgaggtggagggtggcggtcacagccctccacaggtcatatagttcccagtcagcccacgaggcaggggtgggtggtgcagacaccctcctgtgtcctgtctgactgaagttccagaacagcccaggaaattaaagatgcttatcccgtttcacagaggatctcacaggtgatcgatctctggtcatgcagccaggttcaagtgccctcagtgttgtaactcagttaacatgcgcccgggcaggcgaagtcagggttggccaggtggcatgccagcaggtctcggggcagcagcgtggtcccctcaacgctcgggccccctgcctcagctgcccccaagtcaggattctgttgggtggagacgctctacggtgtccatgagccccatggttagatgctggtggaagcttgtctgtcagcctgctcctgggacagccataagcatggtgtggccaggggaacccagaaatggagagggctgcagatccatttcacagaggatataatcattaaaaagcagggcttttatttcatgtgactttctttcattctcctagtaatttcattttattatatttcgccaaagtgttggttgatgttagaccagaaatacagggcgtaagaatcgcaggctgcagcaggggtgccacaagggggtagcaacgtcccacccagctgaatagttgtccctggacaggccagcaggcagcagagttgcagtggattttcccttccttgccatttcctgtcggccatttcctttcccttcctttgccatttcctttcctttccctgttgttctaaattcggcattactagtgcatgcgtgcatccggggaaaaggaacaaggtgggagaagagagagaaagcgaatacccgaggccgccagcatcagtgggtgcccgcgctctcctcctcgctctcgtcctctgccctccgccctggctccctgcccgcattccctgggagcgcagccttgccttagcctgggagacagctgtccacagtgacaggcggccattgttctcggccgagccagcaggcttccggccggtggcagctgctgctcctccgctctgcggccccaccaagggggcgccgccaccgcccaggccctccccgcctgatgggtctctgtccgtccacgcgggagacagcgccacctgccggtgagaaggagcgttgctgcgccggcaccagcccagtcctacgctcggggctcctgcaggcctgggaaggagggagggcgcagctagaaggaagtctcgcctgcccttgcttccccgtctgtcagagtgcctcgcatgcaggcctgcctagcggccttgatcatgctctccctgtcacggaagtagaatgtagtcaagtttttggactccaagccattcttacaaaattgcgtcagagtggggattgtattataagaattgccactgaagagcagcgagtggctgaaacctctgtgtggctgccagtcagcccctccccggtgactggatcagcgaagaatccagaagcgaggttgcggggctgcagcccttggcatggggagtccgtgggctgggcagcactgcctcagccgctggcctttcctgagcagagtctaggctaagcggctgttggaaatagcagtagcacccggggcgagaccgtgagccacagcggcggccggagtctcccccagcccgagctcaggcctggtaagcaccaggagcccacagtttccagagggagtgaggaggagtccatggcatttaggggcagttttctgggcacagtggccctcagacgagaggaagaggaggcagcgctacaaggactggcaggacgaggggggtttcctgctggtttgcaggggatccactggccaaacttgtgtggagctgccttccctgagctgggcctgcctgaatgagttctcaggcccctccttcacccatagccttgccagtccccagttcttgccaaatgcttgaataggcccctgtgttggccatggcggcagcagctggctctggatgcccccacccctgccttgatgcatggattcccaagaacctgtctttctgtgacctcctgcgtgcataagccctcgcgttcatggttcttcctcggtggccccctctggcctcagcccttctccttttcttccacagcctccgcctttaggcaggagctctttcctcctctcagttccccatgtcctttgggtgtggcctgtgacactcaactcctgccctcggctgactggccctgattcaccatgcttgccacatgcacctgggctggcaggagttccaggagagtttgtgcattgaagtgacatgagtccctgaagccagagcccccatggtttcctttgggcctgttactggttgatcttttcttgagaagccaagcttaggtaggatttgggtattttttcttttcaaatgagtattgtggcttatattatttgttgctacataacaaattgccccaaatgtagtggcttaaaacaacagacatttattctcccagtttctgtgggtctggaatctgggagcagcttagctggttctggtccagggtctcttactgggttgtggtgacatggttgctggctgggctggagggcctgcttccacggtggtttcaacacacggccactgacaggaggccctggtcccgtcccatgtggactctccgtggcgctgcttgagcatcctcacagctcagattgagcgatgagagggagggaggaagagagtgagaatacacaaggcgggaggcgcagggcctctttgtttcgtaacacctgaagcacacgcagtcactgccactcttcatcagaagcagccagctcccacactcagcagtgggaagtgagctccacctcgcaaaaggggaagtcaaagaatttgtggacatgctttaaagccactgtcacacgagactaacacttgtaatgaaaaactggggaagtattaagaaagtgtacttcaggaaaaagctgtccgtggaactgccacgtgcaggcccactctgacaccttggttgtgtgctgttcccgcctttttttttttctggccctggtggtttttcatggacttgtagttaaactgcatatgtaattttccttcttttttcacttagtatcatgacagaagcattttacatgcttataaactctattaaaatccattttttagttttctgttttaagagaccaggtctccctctgtcacccagactggaatgcagtggtgtaatcggagatcgccgtaacctcgacgtccttggctcaagggatcctcctgccccagcctcccgaatagctgggagtagatataccaccacacacagctaattttttttggtttggtgttgttcatttgcgactgagtttcgctctgttgtccaggctggagtgtagtggctcaatcttggctcactgcaacctctgcctcccggattcaagcaattttcctgcctcagcctcccaagtagctgggactacatgtgcatgccagcacgcccagctaatttttgtatttttagtagagacggggtttcactttgttggtcagggtggtctcgaactccggacctcaagtgatctgcctgcctttacctctcaaagcgcgggactacaggcatgagccatggcgcccagcctgtttgtttttaagagacaaggtctctttatgttatccaggctggtcttgaactcctgacctcaagcagtcctcccacctcagcctctcaaagtgctgggattacaggcatgagccactatgcctgggctagttttttttaattaaactttttgttttgagataatcatagctgcacatgcagttgtaataaataatacaaagagattccatgtatactttacccagtttcctccaatggtaacattttgcaaaactataataaaatatcaccaccaggatcctaacatggtcaaaatacagagcagttccatcaccaggatccctcctgtcacccttttaaggccacccttatacccccacccctacagaccccatccctaaccactggcaactactaatcttctcggcttctaccattttattatttcaagaacacatataaatggaagcatatgatgtgtaactttaggggactggtttaattctctggagattagcccaggttgtttgatgcatcaggagttcattctttgccattcttgagtggtattcaaaggtatgggtcgaccacggtttgtttaaccatttccacgttgaaggacatctaggctgactccagattttggctgttccagataaagctgctatgaacatttgtgttcatgtgttcaagcttttatgtgaacagccttcattgttctgggataagtccacaggagtgccacggtggggtcgtatgggagttgcatatttcgttatgaaaatcatatttaatagcagcttaattcttcatcaagagactagatcttttttttttttttttttttttgagacagagtcttgctctgtcgcccagactggagcataatggcatgatctcggctcactgcaacctccgcctcccaggttcaagcgattctcctgcctcagcctcccgagtagctgggattacaggcgcccgccaccatgcctggctaatttgtgtatttttagtagagacggggtttcaccatgttggctaggctggtctcgaactcctgacctcgggtgatccgcccacctcggcctcccaaagtgctgggattacaggcgtgagccactgcgcctggccgagactagatcataatttaagtattattcctttgtcattggatatatagtatttctaattaatgggcaattataagtgattctgtactttgtctttaaaattatttttgtgtttctgatgatttcttcagggtgggttcccatgagtagagttgctccatggtgggatgggagacttcaaggggcaagttgccaaactagacatttctaattctggtaacaggctgccatgtgcgcgttattgagttgatgtgctcacaatgccccgggaggtgatgggggctttgcaggcccctgtgggagctgtcagggagccagcgaggcctcagctggcttggttggcacttccctgacaatccctccattgtgcccatcagtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgtgagtgctcccgtccagaccctggggacagcttcggaggaccggggcgagggtgggggccccccaggtaccgagaagagctgcccaccaaggctgagacaggagagacacccgtcagcccctgtacttgcccagcaagagactaagaagggcaacagtgtgagtctgttatgagggaggcctggatgccacgttcccctgactcctgcaccaggagccacctggggcagcccctcattttatgcttgtagcaactcataacagatggtgaaaccgaggctcccgcgagctgtccttttccaaacctaccccctcatacgcacataagccgggcgaaggccatactgattctcccagactctaccccatcagtgcctggcgccacgccccactgggagcaccctgggtcccgcgggtctgtgactcccaccacatccccaccaggaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagaggtgaggactggccgctgggcctcaggtgcagtttggaggccagtgagagtcccagcctctgcagcgggaaaaacgccaaaggggctggtggtgctggaaggtcctcactaaacactgccggtggtcctgccattttttctaaaggggcttggttttcacttgaacggaagcagcacaaagcctgccccgacccagcatggtgggcctctcagccacacagacctgcctggcgcagagggtctgctggcctcggggaaggcagctgtggtcaagcgttcctgggattttgttttaatgagatatggcaaggtgacagacacagaccaggaccttaacaaagagtctactactcacagttcctgagaggaggggccacgcctcacagagccatgcatggaaagcactgaggtagtcggggcgcagagagaagagagggaagctgggccagagccgtctctgcatcctccccaggtatttgctgtctcgaggaatcagctggcctgggaaggggcagcccctccaggaccagcaaggccccaagttgtcaaagcatcataaaaggcggaatatgtaaaacctgattaatctactgccttcctccccttcctcctctaggcagggtctcagcaggctaccgacgtcctctgggaacaatccttcctcgggagttatagccatgtgcagggatgaggcatttgtttctgaaagaagaaagaatacaaatgcatcaggcccctcctctgtgaacttagccactctgaacctcacccacagaatttcactaggtcctccttgtagccctgtgaggtgaatactaatattgtacccattttagacattgggaaactgaggctcaggttgcttaaaagacccgccccagtgagaagacaccaggggaaaggtgcacttttgtcacacgctctgagcacagaccttcatggaaattagcagagccaggctttgcatctcaatagaaaaccatgcaatctctgcagctgcaaggaccccagtgaaaagcaggcaagcctccactcctggcctctcacctcagccccaggaagtgacaaaggcctctgagctcaaggcagcctcagagtagaaaagggattctctgaagcaggcgtaactgctttattgaggctgggcacagtggctcacgcctgtaatcccggcactttgggaggcagaggccggcggatcacttcaggttaggaattcgagaccagcctggccaacatggtgaaacctcgtctctactaaaaatacaaaaattggccaggcgcggtggctcatgcctgtaatcccagcactttgggaggctgaggtgggtggatcacttgaggtcaggagtttgagaccagcctggccaacatggtgaaaccctgcctctactaaaaattaaaaaaaaaaattagccaggtatggtggcacgcgcctatagtcccagctacttgggaggctgaggcatgagaatcacttgagcccaggagatggaagttgcagtgagctgagactgtgccactgcactccagcctgggtgacagagcaagattttgcctctaaataaataaatagccaggcgcagtgactcacgcctgtaatcctagcactttgggaggccaaggcaggcagattgcctgagctcaggagttcaagaccagcctgggaaagaaacatggcaaaaccccgtctctactaaaaacacaaaaaattagccaggcgtggtgctgtacgcctgtaatcttagctacttgggaggctgaggcaggagaatcacttgaacccgggaggcggaggttgcactgagccgagattgtgccactgcagcccagcctgaatgacagagcaagactctgtctctaaataaataaataaataaataaataaacatctttattgagatacaattgacaggtagtaagtggtgcatatttgaagtccacaatttggcaagttttggcttatacacatatacacctgtggattcctcaccacagtaacggaagtattcatcacccccggaagcttcatcctgccccgtgtcatcctctgcccttccctacctcctctcaactctcatgggccctctctccctgcagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggtaaggggatccctgcgcccaggcccaggatattcctggcctccatcatgctgggcccataggggaaccccacccagcctgggaacttcaggtagtagtaatcctggcacctttcaagagggagggctccctgcctgatttgagtggccgggggtcccacgtgagcccttcctgagagctctgtgggtcacagctatatggagcccagagctccgggggagagcagagccctctgcactgacaggcatcccagtgcagtcagtgcagcccagtgcagaccagagcccatcatacacacggacaaggaggccacaggctgtgggtgaggaaggcctcagggaggtgatgctgccccgaggctggagggaacctggcttggggctgtactgactagaggctgcctgggaccctggcactcaggtcatcacctggacatgaggatgacagtcccactcagacctcttctcagaagactgtctcatccatgtgtctcctgaggttggattgcgagcattcagatatcatggaatgactgtttatccctcaaaccccacttttcccacgtgctgttctccaccagctatgtttgattaaccatgcacatggtggataattctacgtcagcacataggagcacccatcctttcttggggctgcggacattgcattcatcatgcagtcccttgtgggtgagcatgaagatcttttcagtctttcggtgctaaaaacaatgcatctctacctactttgtgcagcattaattgctcagagtcaagtgtacctatatctgtaggacacatccccagaagtgggatggctaggttggaactgatgcacgtacagtctgggtagatttgccaagcttcccacctcaggccatgccagcctgggctggcactacattcccaagaaggtccatttccccacagtctcaccaggctgcaggattcttcctgtcaggtaagaagcctgtcttggggcaattgttaagtttgcttttctgttacagagtgagtttgagcgtgttttcaaaagctgaagatcatttacacagcctttcctgcaaacactgtttttttcctttgcctgtttttcttatcagtttataggttccttgtatatgtgaaggaggttggttccttgtctgtgatgatttgcaaatgtttttccatgcatcttttatttttgtttatgggcttttgccacatggaggctttgtgtttttctgtagttgagtagtctttttgtggcttctggtttggaaagcacatagagacaccaggacttgatgattgtaacagtcaggggcagctacattccttggcctttcactgcggctcacggtctggtatgggccccctgtacgtcctctccccattgtacagaggagaaaactgaggctcagtcacttgcccagagcacaccgccaaagtcacagatagtctctgccactcccctgcctccaccaccgtgggggaatttggcacctgctccctagtgggctctcctccccaggatatgcagtcagatgaaatgtggccaagtcaggattcgtgctgggcccactcccacctgctgcctgcacacctacaggctcagcattcagcaccccattaaagcccagtgggggctctgttcaaacactgcctgagtcctgcagtatggcgtcgtggcagagcatggacagatggccttgcctggtcccggctccaccgcttccaagtccatcacacaggggtccctggaggtttggggtaaggattgagtgtcccagtgcatgtggagcacagagatcagagcttgcacaagagaagcacacacaggtgtctgtgttcttggctgcagcccgcatgggccaaggagttcagatccagtgccccccacctcccctttcctgccgccatgctctgtaggcttggcccctcctgctgtgatcctgatcacagccttccaccctagagaattaatcacagatccaggccaaggttctcccacaaaaacaagcatcatgtcggttacaagagcaagaaactggcctcaacttggcgagcttcaacgggggtccagcagcggcccagagcagcttccaggagtacgtggggggagtgcgtggtgctctgccttgttctgcggctgtctgaacagtctcctgcctctgcactcagttcagcctccaaacactgagtgcccactctgcacaagatactttgttgaggcagtgagataacacaggacccacttcctgcctctaagtctaatgggggagcaggaggagggcaaggacctggcaggatgaggcagagagatgaatggaatggagccgcatctcaggcagttgcaattcctgcaggccaggggagagaccaggaggaaagggcaggttatgccagaatcagggccaggtgtggaggtgtgccccaagtgatcctcccacctctcaagcctcaggagacaggaggatggcttgagccctagaggttgaggctgcagtgagctatgttcatgacactgcactccagccttggcaacagagtgagaccctgtcttcaaaaaacaaaaacaagccccagaatcagtgggtagaagactcggggcaggggagaagaccacccacctgctgctccttcagctggaaaagctggactgccccaggctgggaggaactctgtaaggactcactagaagcttctgaagtgatcaggccactggaggacaagttgagggctgggtcacaaaagtgagttcaggagggcagtgagagtcactcaaggtcacaggtcacgctggcacgcctggcaggcagcctgggagagataggagtcccggctctgcaggtggagacatcgcagagggccttgggcatccaggaggatggcagtgccataggcgacgctgctgcggcctggccgtgtggagcactgcactcctaggaagcaggaaatggctgttcacaggaacccacaggccaccggctccagctttgacctgggaagctgtttcaggcaggtggagaggatgaggtttgaggagcagagggaagagctgctgagggggtgggcgctgggcagtcgggaggcgaaggcaggagatggcttgagccctagaggtcgaggctgcagtgagctatgttcatgacactgcactccagccttggcaacaaagcaagaccctgtctccaaaaaaaaaaaaaaaaaaaaaaaaaaacaaaacaaaaaacagaatcaagaatcagtgactaggagactcagggggaatgggacaagaccccttagcctggggatatgttagtcccggaccagactgagcctggccagtgtgtgacggaggtgggagccactggaggggaggaggacccaggttcagggccagggttagaggggcgagcccggggagccggcgcagcctgtccagcacagggggtgcagaatggcaggagaggggatcacaggctgcaggggagcagcacagcccctgtgccctcctgccctttggctccaccctgtcccacagccatccctggtggtggggaggggcttcaggtaggaaggttctaagcttagcctgcatggccccctgtgggggagagccacctccagagggcatgggaagcagattgccgttcattctccatcacctgcccacattcctgcctctgggacattgaggggctggagtgggctggggtgtgtgggagacagaagcagagaaaggctcctcattctccctggagcctcccacgctcacagcccctccccagggaacgcctctgaggcacaggggaggaggcgctgcttcctctgcagctcctcgccgtctgcaggcgccttcacgcgtgtgtgtgggcacatgtatgtgtgaacattcgtgcgtactctgtgttcatccacctgcctctccccgtgccctttctcctgccctcttcttggctgtctcctgctcttccctccttcctggtcctccttgcctttcccttgccctgctcagaccccggaggtggcagatcttagacccagagagagccttgaggtccctgttcctgcccccttcatggcttgattctccacctcagctgggacaggagcacccagcctaccaggcactggtccagttcccacacaggctcatggctgcagtgcccaggaaggccgggactcctgcaaacccatgtcattcccaccacaatgccctctgcaggggagccacataaagaggcctggtccttggtgcaggcatctggagagggctgcctcccccaggcctcccgcagtgcatgtccgtctgctctggggagggaattggctgatatcccaatctgtctaggggacaccatcacctggggcatcagagttctcatgcccagctggtgctgtgcctggggactagaagggctggtgctgcgtggggtcaagaggtttacctgataaaccggtaagggatgccctcttcccccagtagacttgggaggtgcctcactcccagggtgcctccgtcactctgtcagggatgctgttgtgcaggcttcagtcagcaggctctcatcggggcagcctctcctttgggcagaggctgataggaccaaagaggtttctagaggacttgtgggtggaccaagcctctgtcctgtccctggaggaacccaggcctggggtgttgtggtccccagctgagtggagactgtgcctgtgctgagcttgggtagaggaggacaagaactaggccaggcgcggtggctcacacctgtaatcccagcactttgggaagccgaggagggtggatcatgaggtcaggagatcgagaccagtctggccaactttgagaaaccctgtctccattaaaaacacaaaaaaattagctgggcatggtggcacgcccctgtagtcacagctactcaggaggctgaggcaggagaatcacttgaacccaggaggcagaggttgtagtgagccaagatcgtgccacttcactccagccaggtgacagagcgagactctgtctcaaaaaaaaaaaaaaaaaagaactgggcgggcacaggctgccgtcagggcctcgctcaggcttccctgctgtgtgaccactcacgtcacatgctccatcttggcccagcagctttcagggcagagacggtgtccccgagctagagacagggaagcagaaggatctgctgtctgtgtcgggctcgcaagcctcgtgagtgcctccctgacccagaatgctgcccaggggcgcaggcaccgctaggcggcctcaggtggtccgttcatttcaccattcctgcaactaaaggacttgtgggttgtgtataatttctcactgtttttgatgagcctcgtttgggtgcatctctgagcctcctggctttgttccagtgctgcggctttgaatgctgctgtcttagaagcagctgtgcctctgctcaggtagcagcagggggcttcacgccccatccccccggccctgcccccaactctggctgtgtttctgcaggatgagaaggcgcgcattgaagcattgggtggctttgtgtctcacatggactgctggagagtcaacgggaccctggccgtctccagagccatcggtgagagccaaagaggccgacccaagtgggagaaggtctctcggaagcccaggcctcgagtgtggcccgcggctcaccaggggttcagggaggcagtgtgatgggccgagggggatttgtcatgcactggggtgataccctcgtagtgtgaagggaacagggcagattcagagactgcagcaccagtgtctgagtgtaagttacactgtatgttattatctcacctaaaacagctcctacaaatctcatagaaacctgtggctcaccaccctatgggctggaagtagagcttccaatattccggaaatgaggtttatcctcctcccgcgttcatgctgacaatccttttttctcttttgggaaaaaagtgggttcgctgggcgcggtggctcacgcctgtaatcccagcactttgggaggccgaggtgggtggatcacctgaggtcgggagttcgagaccagcctgatgaaaccccatgtctactaaaaaaaaaatacaaaaaattagccaggcatggtagtgagcccctgtaattccagctattcagaaggctgaggcaggagaatcacttgaacccagaaggcggaggttgcagtgagctgagatcgcgccactccactccagcctggataacgaggaaaactctgtctcaaaaaataataataaaaataaataaaaattttaaaaagtaatgggtctggctgggcatgctggctcacgcctgtaatcccagcactttgggaggccaaggtgggcggatcacctgagatcgggagttcgagaccagcctggccaacatggtgaaaccccttctctacaaaaaatacaaagttagccaggtgtggtggcacgcgcctgtaatctcagttacttgggaggctgagggaggagaagtgcttgaacccagaggcggaggttacagtaagcggagatcgtgccactgcactccagcctgggcaacagagccagactgtgtctcaaaaaaaaaaaaaaaagtagctgggcgcggtggctcacgcctgtaatcccagcactttgggaggccaaggcgggtggatcacctgaggtcaggagttcgagaccagcctgaccaacatggtgaaaccccatctctactaaaaatacaaaaaacattagccgggcgtggtggtgcctgcctgtaatcgcagctacttgggatgctgaggcagcaggatcacctgaaccctggaggtggaggttgcggtgagccaagattgcaccattgcactgcagcctgggcgacaagagcgaaactccatctcaaaaaaaaaaaaaaaagtgggtccagcctgcatctcattgtctcagcatgcggtcagtgccgggtctcaggctgtgggcactgtgaccacacctccttcctggtacttagaaaatctctccctccccagctgattgccagggatttggcacctacccctctgaaacattctgtcctttttggcagatgtggcaccttcttgacagcccatcctcaggctgtgtctttccttgtgtctctggacactccaggaagtgaggccaggatgggacggctagggcagagaaagagggagctcggcctggtgtggtggctcatgcctgtaatcccagcactttgggaggctgaggtgggcagatcacaaggtcaagagatcgagaccatcttggccaacatggtgaaaccccatctctactaaaatacaaaaaaaaaaaaaaacaattagctgggcatggtggcgcgagcctgtaatcccagctactcgggaggctgaggcaggggaatcgcttgaacccaggaggcagaggttgcagtgagctgagatcgcgccactgcagcctggcgacagagcaagactccatctcaaaaaagaaaaaagaaaaaaagggggagctcacaggccaaggtcaggggtttccgttcccaggcaagtgggaagtactgggcagtttgcataagggagcaacagaccccagaccccatgagagcaggttggtctctgtccctgcaggatgtgaggtctaggcctgggtaggtggggaggaagctgtggacaccgtggtcctctgacccgggctcttctccgcctgtccaggggatgtcttccagaagccctacgtgtctggggaggccgatgcagcttcccgggcgctgacgggctccgaggactacctgctgcttgcctgtgatggcttctttgacgtcgtaccccaccaggaagttgttggcctggtccagagccacctgaccaggcagcagggcagcgggctccgtgtcgccgaggagctggtggctgcggcccgggagcggggctcccacgacaacatcacggtcatggtggtcttcctcagggacccccaagagctgctggagggcgggaaccagggagaaggggacccccaggcagaagggaggaggcaggacttgccctccagccttccagaacctgagacccaggctccaccaagaagctaggtggtttccaggcccctgccctccccttcctcccatccttgtccttctctccctcagaagcctcaggacccaacaggtggcaggcagtggacagggtgcccgccccacagtgctttccccagcaccccagagccagtcgggacaccccccgcagcccgtcctggtggctgtggaactgcactgggtggcgggcagatggtggaaggcagcttaggagacctcaccaaagagaagatggaccggctcttgctcccagctcctattaggcccggggtgggaccagaggtcataggtgcccaacggcagccaaaccaaagacactggtgtgcatggggcagcatggttgtgcacgtgggaccctggggcggacccaggagccaaactcttgaagcaccccctgggtcaggcccagcagcggagtggccagccccagtttcccattgctcctctctgcggccagggccaggtgggttcatatttacagatatgcccagccagtcctggtcggccacaccagtgtcccaaagaggagagcgcagcagagccaggggtctgttctgtagcagccacccccctgcccccactccagggcagccatgatgtgcttgggcccaccagggccttccgggctgctctcttccctgagcccggaaccggcgacgcacatgtgtcttttgttggtgtgtttgtttttttccagggaggtctaattccgaagcagtattccaggttttctctttgttttatcagtgccaagatgacctgttgtgtcatataatttaagcagagcttagcatttattttattctttagaaaacttaagtatttacttttttaaagctatttttcaaggaacctttttttgcagtattattgaatttattttctaaatcaggattgaaacaggaacttttccaggtggtgttaataagccattcaagtgccttacacagctttgaagaaactaggactgcagtgggctcggataggcccattgaggtttttagaaaagcaggatttgttttgttagggaggcatgattttggtgagatctttctggaagagttttccgcctctttgtgatgctgaacacccccaaggttctcccctccccccgctgcccaggtgactggcaggagctgcgactgccacgtagtggtgcctgggcccgacagcggggctctgggcatcccgggtgaccttggcccatctgcctgcattcccacccccttgggcctggctggatcccaggcagagggaccttgctgctgtgtgattggaacattcccaaatatcttgtgaatttgtaatcaaattggtctcattgggaaagactcttaattaagaggctcaggcaagcacagaggcagcccgtgggtctctgtctcagtctggaggcagcagggatgctgctgggagtccatggcacaggccacagcccctcaccttgccgcggtggctggcagcacgcctgccttgctctgccccatgccctgaacaggcatgagagctccacgtcccctagtgcaccctgagagggggctcacaagtgaccgatcctgggtgcctcagggagctcactgagggcgtgcaaagttgaaagtggcaaggctgggggagggtgtcgggtagagggaagagggcagggggctaggggaggactcagaggccatctgcagggccaagccacaggaagggctgagctggaggtgggcagggctgctccaggcaggtcagagcagtgcagggggaggagaggagaaagggaggaagctgggctgtgtggtccccatgaaggcattcagagtccacctgcagacagcgagagccccaggaaggtttgcacagctgtgccccaagcaccttggcctcctctcagctcgccgaggaggcacgctagagccgccttcccggtgggagccctctgtcccacagggagcggggagccagctttgctggggccctacctgcatgcccagccttacccctcattctcacagcacagatgaggttgagaccatgcagtcaatgcattgcttaaggtctcttatttacaaaaaaaaaccttaaacatagtcgctgtcattcagacattcagagaatggttggccacaaacaatgaccaagtattgcttggcttaacttgaaggcctgctgtctccttctgggggtcagggacgcagctccaccctcaccactagcccaccctgcccgtgggcataaccttgacgaagagagagaatgattggcatctgcttttctcttttctttgctaataattctgttcctggctgccgagagtgaagtttcaccatgtggaggtttggctcctatcacctggtggtctgattcataccctagcctgaggctccactggaagatctcgcagcctcagtgtatgggaaaccctttccccaggcttgtcccagcactgccgctccccacccctgagccaggaccccagaggatggccatgccccgtgcctggcagaggtctggtgccagcactgggagctgctccgcccttgccttggggccgagggagccctcgtccacccctgcacagcagctgggcacagaggagcgctcttccatcttgaccaggactgcaccaagaagcaccaggtgtcttcagcctccaacctccggggcgaccttctcttccagccacagtcccatgagggcccctagccagggacactggtctgtaaattgtaatcctttctccagcccagctctccacttgttccttgtgtgagctgagcaggcagtgcacctctgagtgtcccttttgtaaggcccaggggttgcactgagtctgcagaggccgcgacctcctagaacgctgtgggtgcaggtgagccggcgtgtcctggggagatgctgccagcacacaggggccctcctgctgccagcaggttggggtggttaagtcttattagtgtctattcttaaaattaagtgggctggagaagaatggagctccacatgccagcaccgtatatggaatacaaaagctggggaagcagggcctgccttacaggtgtggctgactctgagcccaggcctgcaggggtggagggcagtccctcagaatcccagaggcagtcccagcctcagaacccaggataggaaatgggtgtgtttagtggggaaagggacggggtgcagacggcagggccagtatggggccccctccctctcctctcctctcctatggtgagcccagcgtgggcaccgggccgtctcagccgtgttcccagggctgggaggacagctctggcccttcttaggcctagcctcgtcccaagctaaatgtaagccagttgggctgtgttaaaggaagcagtgtttttggttcgattctgcctctgtagctcaaggggggcagcccccagagtcctgtgcattctgccaaggctccatagctttgccaaatgcacggagctctgccattccggtgcagtgcaggccttgcgaagggtttatctgcgttcgtctcggtgggcttctcctgcatgggagttgtgttcctgtgcaagggggagctttgctccaggacaggatgactgtcttccctattcttagggacaagtcccaagatgccagaaaggcagtctcccaaggacccaccatgcagaagtgtcaataaaccacaagttctgaactctg

SEQ ID NO: 36327 - DNA, 36392 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctagggagcccctgagctaggaggacacggaaaaggggattggggtcctgagattgggtctgttgggcccaggacgcgttttctggatgggtctaggatgctcccttgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcaggtgagactgagttctaggacatttagggggtctggtgcctggctccgccaaaaatggggactttcgggattgtgatcatcacggcggattgagcagggagagccgtggagggacaagagagggccgaggcagggtggggggcgcgggcaggtgcgagggggatgcggccaagaagcagcgataaagggaacattccacgggtcgggcggctgctgttggatcttagataaagctggaagggattaccggggcaggggtaatagggaccggggacgggaacgcgaaacaggtgaagcgctcagggcgagagcgactcggcttagggagtccgggagaagcctgcggctgccccctcgccgccgaggtcctgcgggtcctgcgggtcctgcgtgctgagccggggcgtgcgcgggcgggggccttcggaccgcgcggcggggcctgccctgacccctggcggcgggcgggggaggcaggcgcgccctgcagagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaaggtaagccaaggcgaccaacagggaagggctgggacagctctcctctggcagttagcccgtgcatccttctttagcattgccgtgtacgcacaccccaccccgccccctacacgcgcacacacacacacacacagagttttgtgggtttgatgtgtgggagctcccgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttgggacggtgagatggttcctatccattcccaggttgaaagtctagtgacaggtccccactgcacgtggcattaagacagtcagataattgtgtcaggtcttgtgctgaggatgagtcagaatacaagatgggcatgttcccccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttctttagtagctacctgggtcagcctgccctgagctaatggcacattcaggttggagttccttttcatactttcaggatgtgcttggtgagattaaaaataattggactgggttattggccagacttagatctgactcagtggtcagttttaaattatcattgttattagattttgacccttttagccaatctagtgggaggaatttattgcctaaacacatctggattgggatatcatgggctagagccatccttggcaaagggttttctctgagaaatggagggctaaggaaaaatcctggctcagggactgcagtgtgaagatctactcctatacaacccccagcaatcaatgaggcggatgagcaatttccacccaccacgcctgctatctatggatgggaggagctatagttcacaaaccgtttacattcatgaataatatatttcaaaaggggaaacagtttaatctgtaactggaagggaaaaaaaaactgtcagaattgactcccttggcttcctggagtaggaaaaaggaaaattggagcatttgcagctttttttgactagctggattatggaatatttaaaagcaacagcaacaaaagtaccttataaactagaaaatagaattgctaaaaaactatttactaaaaacattaccttaaagggagaggatatttgtgttttcccccacccccacccttctcatgtggctttgaacaagaaggagagttgccaggaaaagaggcagatttcagagagggctggcttcactggatcctccctgttgttccactgcactgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggcttggaggaaatagcagtttacaaaacagcatttcaaagagcaagtgtggggatcctcaaattaaagaaattaaaagaaaaagctagagcaagctcctgctagcctaaagaaaccaaaccctgactacttgctcatagaactgtgagcaaaacaagacagtcaaaccaaaaaatccacctagaaaagaatttggcagtctcactcagatgcctggcctagaggggacttcagagaatgccctacagagagacaccaagactacaaatgcaaattctgcccaaagagtgcctggccgatgaacagggtcctatctacatcttatggagactcctattttataaatatgtatcctcaagtccaagcacaaacaaaataacagaaacagggatgattctctcccagtttccatgacagtaaataataaatttccctaaattttactttcaacaacatagactttttttatttttatttttatttatttatttatttattttttgagacggagtctcactctgtcacccaggctggagtgcagtggcatgatctgggatcactgcaacctccacctcccaggttcaagcaattcttctgtctcagcctcctgagtagctgggactacaagtgcacgccaccatgccgggttaatatttgtatttttagtggagacggggtttcaccatgttggccaggctggtcttgaactcctgacctcaagtgatccactggtcttggcctcccaaagtgttgggattacagatgtgagccactacacctggccaacaacacagacttcttaaaaaaatcatgacaataattttgggtgcttcttaaaagcacccaaagctttactgctaatgcatggtagcttaaaacttcacataataagaaagaaccagtggccaatggaatctactgttaaaggtacccaatcaagtaaggaaaagttggtcctaaaagcaagcagccctgtaaaagctgctctgtccaatatggtaatcactagccatttgtgtttccatttaaatttcaagtaattaatatcaagtaaaatttaaaattcagttccttagtcacactagccacgttgtgagtgtgcaacaggtaaagctagtggcacagacatagaacatttccatcagcacagaaatctctattggacagtgccagattagggtgttctctgcattgtaaaagcatccccttgccaagttaaagaaaacaacaacaaaactctagagaagaaatgaaaccccagtttcatttctggagaggaaagaaaactcatgtgtggcatgagtttatattcaagaaggtgcagcattattacctattttactagtaataatgacacacattatagtatacaatccagttccaataaaattaatttctcatcttactaaaagcttgctgctccacattatgagacaatttacccaaatatagacatttacccaaaaatattaagtagcttgtgaatactttttaaaatttcctttaattaaagtggtcacaaactcaaacccttcattctccctctgagatttctgtgtcatcttttgttcacattgttattcacatgtttattatgtacttattttgattttctagataaataaaatggcttcaaatctataattctgataaaattagccatcaattaatttatttattaaacccatgcaatatgctagattagatgctttgctatgtaattcctacaataaatcctagcaatcacaaagattacagttagtgagacgacatgcacacaggtaaaaagtgtttttaaaaaatacatacatacaaccaaaacagtaagtcactgctacatggaaactgattggtcctttttcctttttttttttttgccttgactgccaggaagcagtttcaaatctatagctggattttaagtttcattaattcatgttcccacatatggttctgtattttcacttcccccttttaactgacatactgtcttatgtgatctctactgtaagccttctcatcattttggaaacagaccaaatataatatatatgataaggaatcaaaagtaaatacagtagtgttgaatattgcataacaaaaaggtttttaaatagggaatggtatcaatatgaagtgttagggagacccagccatgaaaaggatagcagggtcagagaaggaggatgtattgcagctggtttaatggagaatggtatgaaggaggtgcagtttgaattgggtcatggaggacagatggattgcaaatagctggggcaaaagcacaggaaggcattctaaacgagccaggcatggagacaagaatgtctcccacaagggagttgtagtagctcaatcagactgggatttgagatttcatgtggcagagtggtaggtgataaaggtgaaaagactgatcatagtaaaatgcggagtctgtaaatccagcactcatgataagtttggacatcatgtcaacagtggacagccataaatgactgcaagcatcggtgtggtataatgaaggtgacgtttttgtaaaatgactctggtgaaggtacagaaggtaatgaaaagtagccagtctagttgagcagaaaagagttcagatgtaattgcatcatggtccagatgtgaaatgaagacaatgcgaagtggcattgtggatcgaaacatacatgcacaaaatgacagaattttagaatttgaagggatcatcatggttaccaggctggcctccaattcctcttttgtaatattaatagaaattaagggctaacaagtttaaaatgttatccatctttttacatagttactgcccaaagtgaatattttgaaatgtatcattaaagaagaatagataagattatgtgattcaccatggactattgtcatgagaggaaaaatgtgtttagatgattctgttagcactgagacaaatcaggatatctgaaaggaggtctttgttgaaaaacagaaatatgcattcataacttgcttttctaaaattggaatgtaatgattcttaaatatgcacagacacaaatttttctttaacagtcaagaaaatgcacgcaggtgataatcagatcagttttggttatagtacaaaggtttaatgcctccgtgatccctttcaacttgaaagcattctagagcaattggtgattaatatcagtataacagtcatttataaaattattatttatttgatatacatctaatcaaagcataagatttatttttattattattattatactttaagttttagggtacatgtgcacaatgtgcaggttagttacatatgtatacatgtgccatgctggtgcgctgcacccactaactcgttgtctagcattaggtttaaaagatcagattgtctcggcaccatgttaatatctttttctgttggcattagtattagttttgcttgtgtatttgtttaggagatagcttcacaagttggtgattgatattctaccatgtatgaagtcatgcgtggaattcagaatccccagcttgtaaaattgcattatgatcatctttagtgggaaattgttctcagaatactgagcaaaggatgataccaaaatggcagctattattcattcttaagcatatgaaatgctttcaggttcaacccaaaattacatacattttaaatgcttactaaaagagtcttttccctcctccatctattaactgcaatcaaaaaacttcggttttaactgaacatgatttcatattatttattaaaatttaaggcaaggtgcaccaagtacccttgaattatgaaaagcttcatgatgtgggatattctttcagttaacggcagggttggctacacttttaaggggttcaaagtaggaacagctgcaatagtgagctgcatctggaaagtccagtaatttgaaaaaccacctgtttatgtatcctgcccactcaagtccataaaataacagacactttcatattccaaatgaaactgctttttagtttgccctacttttaaacataactctttgtgatggaatgaccagaaacagctggtctctaagaggacagggctatgtgcgctcacctgcggggttggaccttccataatccccctggctgtggggaaagttgagggctgctgtctttatacaaagatggtttattccaagatacacacactcttcttccacaccctggagaccttgcatatttagtatcttctttaccataatctgaggccctagagaaaaagatttgcaaactatacttgttttaaaacaactttctaaaaaagacactctcagcccctagaaattatgcctaacacatagatgctcagaggcaacctgttgtagtgcaagaggattgtgccaagattagaaaacaaatatttgcaacttttgtaactgtcttctctaaaacttgaatgtggtgattctaaagtaaagaccgacacaaaattctttttctttagcagtcaggaaaaggcatgcatgaagtaatcagatcaggtgtggtttcagcataatggcctaatgctttcatgatctctttcaactggaaagcgttctagtcccactggacaccaaggaggaagaagggacggaaaatattaggcccataggtttatcttcctcagtagtccacgagatttgagcttatatgtagggagcaaaattgtttgtctaaaagcagttaataaatgccccaaaaaggctgggcgcagtgactcactcctgtaatcccagcactttgggagctcaagattggtggatcatgaggttaggagagcaagatcatcctggccaacacggtgaaaccccatctctatgaaaaatacaaaaattagctgggtgtggtagcgcgtgtttaatcccagctactggggaagctgaggcaggagaatggcttgaacccaggaggccaagattgcagtgagccaagattgcgccactgcactccagcctggtgacacagcgagactccgtctcaaaaaataaaataaataaaataaaataaaataaaataaaataaaataaaataaaataaaataaaataaaataaaaataaaatgaacgccccaaaaatattttgggcaaactattttgtgtttcttttctttatttatttatttcttttgagacaaaatcttgctctgttgccccggctggagtgcaatggcacaatcttggctcactgtatcctcaacctcctgggctcaagcaactcctgagtaactgggaccacagggatgtgccacaattcccggctaattgttttagccaggatataaatgctgcctacatagagtttgtagctatctccttgactttctttatgcagattccttcacaaacttttgatggattcctttaccaaattctactgtctgttaaaatcttctatctttatatctttagtccaaacaacacgtcatttataaaccttaaaattgtttctgggcaaataaacaaggcaaaataggaatatatatttttaggcaatttacttctgttttggtctcataaaaaattgtaattaaattgtagaaaatatttcaattcctctttaatatcctctcctcacatactggctctcaacttctaatcctcctattgaaacattgattgggaggccaaggcaggcggatcaactgaggtcaggagtttgagaccagcctggccaacatggtgaaaccctgtctctactaaaaatacaaaagattagctgggcatggtggcatgcacctgtagtcccagctactttggtggctgaggcacgagaatcgctttaacccgggaggcagaagttacagtgtgccaagatcaagccactgaactccagcctgggcgacagagtgagactccatcacaaaaaaataaaaataaaaattgaaatttgcagcctttttaaaaccccatagcctctttataaacccaaaagcactatcaaatttggcgaggtgtcaaaagaatcagaggaatgtttacaaatacagatgcctgggcccacctcagatatatatatatatatatatatatatatatatattttttttttttttttttttttgagacgatgtcttgctctgtcacccaggctggagtgcagtggcatgatctcagctcactgcaagctccgtctcccgggttcacgccattctcctgcctcagcctcccaagtagctgggactacaggcgcccgccaccacggctggctaattttttctattttttagtagagacagggtgtcaccgtgttagccaggatggtctcaatctcctgaccttgtgatccgctcgcctcggcctctcaaagtgctgggattacaggcgtgagccactgcacccggcccagatatattaaattagaatatctagaggtggagcctgagtatctgtatttttcagagtttcaaatgatcgttcttcaaatgattacactgtgaagtcagatttagaaatgactgtacccaaggttggctaaaagatacacaccctggttgattctacctgaagagagcaaataagatacacagcaaagttgtagatgttttccctgccagtagaatacttgcgggttaggccatttaaaaccctgccagagagttttgaaacactgtggagggctcccaaatcaacttgctcaatggttctccatcccttcaggctacttgggcttaaagccaactgcaagcttagagcctcagagtgacctaggaatggggtgaccatatattctaggttgtctcatacagactagccagcactactcagccgcaagtaatagcatccaggcatgctcagaagtgtcccatttggaggaaaaaaacaatattgtcacaaatgaattggcaatggcctgtctctgattcttatacctggaatatactggaagtccctactcatgctattttctagcagaataggcaaaatttctacattccaggcatgtcaggcctttccctgattcctttctctaatgtcactcgtctgctgtcttttatcacagccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaattagttggtagaacagaattacacctgcacagaatacaaatttcctgcctttcatgggaactatgttgatgtttcagatatgaaatacatcttgttttctttattgaacctcgagaagatgtctcttgttggtcattatttcatggcaggggaagtacatattcctaaagacacaaccgagtttccctttaaccatcattagttgggctggccattaagaaccagacgcttttattttcaaagagacttaagttttgatgttgtacatatgtgcctaatattctatctcatagcaatttaaaggtgacgttttaaaaagctgcattcagtgtataaacttctcctgatcccagcaaggatgttgtgatgattttatttaaaaaggtaagttgtgtctagatatggcagtgggtcatctcatgcatggtgcagatgtcaaacacaattacattttcttatttgcaatgactaaaaaaagaagctgagcccaagcagtgagaaagtaggagattgggaggacaagaagcaaaggaaaaaagtaacatgagcaccgttctccctgtcctgccacttgctccattatggactgggctgcgatatctcatatcccagctccacaactcccaacaaccatttatgtgcatggtgcttccatgtgtgatgacccaatcaggctcaggtgtggactgagtagttaaattataacccttgtctctgaagagtttagggcttagtggggaaacagacatgtaaacaaacctgagtgaggtcatgtaatcaaaggacaggccacagtcaaccacaaagaagagagttctcagcagtctccaaagccgaacatatgtttaccaggaacagggtcccagcagagggagcaacaggagcaaccagagccttgaggggtcgtggcctgttctgggcaccagcagtggatcaatgtggccagagccagggatactagcagaagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagccattaaaaagggagtcatgtctcttgttggtcattatttcatggcaggggaactacatattcttaaagacacaaccatttcctcttaatcctcattagctgtgctggcaattaaaaaaccaaaagtttttactttcaagaagatttaaataacttctgagggtgtacatatgtgcttaatattctgtctcacagtaatttaaaagtgaagttttgaaaagctgcatcctgcgcttgtcagaaccatgtctgatgagatatcccctttaaagggctctcggtgcaatggggcaaatcaagggggtttgtgcaagtgggagtgagacaggagatggggtgcttcttccagcactccctataggctgactgagtgacaaagatcattttactgacacctccaatggccctatgagatgggtactattattattatcaccatcatattccttttgcagataaggaaactcaggcttagcagattgccagaacaacacaggcaggaagtggtagagtcagggtttgaacccaggtagtgaaactccaaagcccggattcttaaccactgtcctccagtgcctctctgtaataagtcatgatcccagaagccattggtgtggccacaatatggaaagagatgacagtgtcctcacactgggtgagcagcttatggtgattccagacatgatctctgttgggagtgacaggtctgagcttctaggatcagaccctagatcttggcaagtggtttgaggaaagagaaggaccaatgtaaaaccccaggcttcaaggaatgtggatgctgggcagggaggattaagccccaaagaccagaaatggggtacacagggcaggtgtggccagagtagaactagagtagaacttccagtgactagaaatagaaccagacacgttgcagtggtggataaggtagaatcgcttaagtctttaaagtgcccctgatcacccaagttggccagagaccctggggtggggctgattctgtctggatatacggggaggggtaagcatgaggaaaggaagcaggtcctgacaggtactttgcactaaacagctccttataaggttctcaatttgcctgctcaatttctacagacatttgtgggaccacaccagtacattgtaaaagcaggaaacaattgagaaaaacctgagttttatgttggtaggagaaatgcctatggaatatggcaaatcgtttctctgagacttcctccctagtaattacatatttgttctcaaaaacaaatgccagaaggaagaagcagatttaatagtgcattttacaaggcaccattaatctctaagaagaacaattaaaatgtctcagcaatcatggttcactgtatatcttttctatcttcttagaagtaatatatggctggaaatgggcataccaaaatatgtcaaggaagtggaattgcgttcattagatttcaccactaattattttagttagcttcacagatctctcttccttgcttgttcttgagagcgaggctttttagtaggaagagaaattgtctaaaacgattaataaccacaaattcaccaaactattttgggtaagtccctctatttctctaggtctaaagctaggaataagagtcattctcatataatgtactgtcccagaaagggcattatattagtctgttttcacgctgctgataaagacatatccgggattgggtgatgtatttaaaaaaagaggtttaatggactcacagttccacatgcctggggaggcttcacaatcatggaggaaggtgaaaggcacatcttacatggtggcagacaagacagaattgagagccaatcaaaaggggaaaccccttataaaagcatcagatttcgtgggacttatcactaccacaagaacagtatgggggaaccgccaccatgattcaattatctcccacaaaatgggaaaattatgggaactacaattcaagatgagatttgggtggggacacagccaaaccatatcaggcattcaaccaatatttgggaagcaccagccctgcaccaggcacggagcacgtcatgagtcctgccgtaccacagcctgcctgacagacctcagtcatcctctggagcttgcctctgacatctggacctcctcagaatcagcatctcttctccttgcccccgccatcctttgtttttatctctgctgtggcattcatcaaagccttccaactatcctgcgtcactgtccttcagtgtcctctctcctctcccttccttctcaccccactttgtgcctgtatccttcaagcagagcaatggcaccctcacttctgtggctgcccagtgccccatgcagagtcagacatcagaaaatagatgctgaattcagttgacactctgaaattctttttaaagtaagttaatgtgtgctttgaatgaaaagacactgggattacattattgagtgtctttcttcctttgccacttttgtccctattggccatatttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaagtcccctggcaagggaggggtgaaaggagtgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttctcatagatctcagatctcttttcaggaaaaagaaaaacaacaacaataacaacacattaatgactctgaaagagtcagacaccattaattccattattggtgtctgtgccaagtgaaatgaacgtcagctcttttcccagatatgtttccttcttttgcctcctataataagagatgattttactgtaataatataagactcatcaatttgactccaaatagctttcctatcaacaggctaagtgtaaaataccaggatcattattcagttgagaatagatagaactaggaagtagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgaaaataatagcaaagtgacttagacaaattacaatagcccataaaaataagataaagtttaacacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgccatacctccttgagtaagtggggactcaaactaggtctgtcaattgttccagaaaattaagcatctaaataatttaatgataatttaaaagaagcacaatgaaatatttcaaggaatgtcacatacaagattctgtacctcttctgctttggttagactcattcagaataggttcctgctttgatcttaagagggaggtagagattctggagaagccctagggaagagcaaaaggaaaggaataaggagccaagaggaaacccagggtaaggctgaggagggactgtttcgtgtaggtgatttattggaagggttggaaggaaacatggaatgacaattacctttggttattgtcaggttagtatgagacttacaagaaaagcactgctcagacgcaattaccattcaagataagaaataataggaaaggctagcacacttagctttttatttaaaaaagtgttaggtaggctgagcacggtggctcactcctgtaatcccagcactttgggaggccaaggtggatagatgacttgagcccagaagcttgagaccagcctggacaacatggtgaaacctcatgtctacaaaaaaatacaaaaattagccaggcatgatggcatgcacctgtagtctcagctacttggggggccaagaggtgggaagattgcttgagcccaggaagtcgaggctgcagtgagccatgattgtgccactgcatgacagcctgggcaaccgagtgagagcctgcctcaaaaaaaaaaaaaaaaaaagtgttaggtgacatgagagaagatcttccaagtaataagagtggctaatcccaggaatgtgtcaccagaggttattttgtaatagtcgtgtgttaaattccttatttgtctatataacttctcaaatccttctgcctctacagttatagtttaactggcgcataacagccttcacacacagcctcataattaaacatagacatacatatgaacactttcccctatgccagcaggatacttggtttgtttaggggcaaagaggaattgatgtggcgttgtttcaatcagtggttgaaaatgcaagtggtaaacattgaaaaatagaacactgcaaaaggcatgcattgtatataccaaaaggtcagcatgaagcattatctgtatggcaagcctgcccatccactccctcctacacgttgcatattcacacagttttgcagcttgtataaacccctattgtgatagaaactcatgaaagagtgtggtctctgcgaaagctggctgttctgtgaatttagaccagtggttcttcaccctggctgcaaatcatctggggaacatttaaaaacactgttttaaacaccccaaccctagaaattctgatttaattggtctgtggtggggcccagaactctgtattctttttttaaggctctcaggtgctgctaatgtatagctaaaattgggtctggtttagactctcagaatttcttaataattaaacactttatcatgacaagactttcaggaccttaaaggccacagtggggtagttatcatttcactaggtcctcatctggggaggtccttggcatttttactggaatatatttgtcactcaaatttctattacaaaaaattctttcttgcacactgctttagcaactacatgagatatactttgtacatagcacaaatctcatatcacttatgtaatccagctctgtggttccttcctttcctttgcctgtttatttttaattcttcccaagaggaagcttagccagttagaacaccagagtatcatccccctcccccttttcccacctgagttcatggcttagacatactaggaatgaagctgacaacatgcactagtttttttcgaaattatgcagcaaaattcccaaagtgcgagtggccacagagatcttcacagggcccagggacaggcagacatcattctttctccagttcctggcacagaaaagagaccttaggttactgagaagataccagtccctcctcagagcagacaaggaaactgagcctcagaatgaaagactgaatttcagtcctttcttgaacatggacctccagggttatattgggccttggaaaaggcacttacactctggactgtagtttcttcatctataaaatcaagaggcagaaacagacaatctctaagttgcctttatttataaaattccgagattctagttgaccagtattcatacaagagttgaagcctgtaagagtgcagaaagcccacacaaagagacagtggaagacctctcatcagtagtatttttattaccctcttcctaggttttaccagtcaacatcctcactgttaatatacagaccgtggtatttaattaaatcatctttgaaatactgagctatcaacagatggcatgctgaatgcaaaaggaccacaaataaatatttggtactgaagaagatcaagagttggagttcatttcccattctgatctgggctcagaactctgtggtcttccctctaatcatccttgccaccaaattggctgtatctgttctaagatggatcagaaaatcagttccaaagttggctacaaactttcaggtttgggttttgttttgtttttttgttttgttttgttttgtttttgcaaccagccaattcatcttagttcacatgacagagaagtgcataattacttgcaactttagttagagcagtggccttaagaaggtctagctaaataaaaagtgctcagactttctgagtgctgacagttgtcaaattcacctagttcacatggccccatttctatcgtttgttttgttttgtttttgttttttaacagcccatctgtgagcaataggatcagatgactaagagctacagggcagaaacactgttacttagagtcaaattttcccattacctagctgtaaagagtttgtttctctctgactcatataaagtttaccatttaggcccctgcatgattttaattccatcacttaacaccccagccatatgattctgaaggtaaacatgaaggcgtttgaattccagaccacctaaacattcttaaggaaatcatcatctccacgggcagagctatgccaaaatctgtaggttttaactcaaatttcatgataagcaaaaattgaattaatttgtcttccattttgttcacctttttgccaaaattatgcctggattagaataaataaattcaatcaatgaatgcaatcactaattcttacgccagataataacacattcagaattctcctttccctgggagattttatcaggttagtgttcttgtaaacaggagaaagagaaaaatataacttagtaaatagcagtattcactaattcattcatttattcaacaaatattaatttactacctactacattccagggagcttagagtctagtatcagaaataataaccacacacacacatacacacacactacattaaataaggatgtgataggctagatgaaataaataaataaataaaaggtccaggtgagaaaagaaggtgggggctagaaagaagtcattgaagaaaaaacatttaggttaaaacattatgaataacttagagtgagccaagtgcagagtgctgaaggagtgctccaggcaaaatcaacagcaaatggggagtccttgatgtagaaaagggtttgaggaattgtcctgggagaaatactcaagattccagtctgaattctagaggttagtgatttagagaggcaagtacgaaaatgacttcctctcttaccttaaaagtaagtgcaccatagaaggaaatcacccttccttggtaataattcctgagtgagcctgagaagccagaggccatctctattttataggcactgtccccttttcagttacccatggctagctcattgaccttgtcctggtcgtttcctcatttcacttactccatcctcaaaacgtagacgcttcataaatattgtataaatgaatgaactcacaaagtcacagtacagcaaggcaaaagtgcctgcaataaacaagcattctaggctagaaatatttctcaacttcaaattgtgtcttattacattgtattccgattttctagagtggtagttctcagtcaagggaaagtttttcttcccttccaggggatatttggcattgtctggagatagttttagttgtcacgatttgggggatgcttctggctcaacttgggtagagaagcggggatgcttataatcatcctacagtgcacaggacagtacccccacccacactccagtaatgaagaatcattagacctaaaatgttaatggtgtccaggtagaaaaaccctgttgtagaggttggggactgcgtcttgacagccacattatacagtgtatcaaacaattctgtataatgggctgtaattatccttgcctagattttgcaagaaccctagtgtgtatctttttcctcacttgccaagcaatgttcaaacctgcagagatttatttcattcattttctgtgtgtttagtaaacagactagaagcactggaggaaaaaatattccagcaatgaggtaagacgaaagctattagtaaccctagtttaacttagctgaatagtaggaaacaacctctaccgtgaggaagtgtattgtagaaactgaaaagacgctaatgatgtttaaaaagctgtagttcaaacaaatgtgcatgcagaccaatgggtagactgaaaatgatgaagacatttccgtttcttgtgtctttgatagaaaagaaagagcttttattttctttagtgtggcaatcattcagatttgtcccatgacatgcccagaaggttgaagaataacaaactcccaagtgtaaacacagaatttagcgaagaatccaggcctctggatgaatccctgtaattgcatgtttggataaaataagattttcatacattaaacaaggtaggatttttctatctgggacggaactttcaacacttggaggggttgtagttatttctcctcaaagatggcaaacatgagtgccccgagttatccctcctctctgttcaagttcgctaactaatcacccagtatccatgctatcgctggcccttctgtggcctatttttatactgttcactgttcagtgtcacttgtttggtaacactcaacatcaacatgtgctaccaaattgacaccagaggacaaaaaagaatcaagatatgtacagcctgctttgtactgagccagctgccactagatgttttttgtgataatgaacacgtgaggccatgtggacgcgagagatggctccgggttccctcagacggctcacagccagctggtctgcagtgcggttttagattccgatgtgggaaccccataaaaaagaatatgcaggccaggcgtggtggctcatgcctgtaatcccagcaatttgggagcctgaggcgggtggatcacctgaggtcaggagttcgagaccagcctcgccaacatggtgaaatcctgcctctactaaaaataaaaaaaaaaaaaattagtcaggtgtggtggcggatgcctgtaatcccagctacttgggaggctgaggcaggagaatcgcttgaacctgggaggcagaggttgcagtgagcaaagatcgcaccattgcacttcagactgggcaacaagaatgagactctgtcacaaaaaaaaaaaaaaaaagtctgcaggctgcataaagaggtatgaaaatgttccagaaatcccaaatcctatccctgaggttcattttggtgagggaatgtgtgtgcattttctagggcttccctaaaaaagtatcacaagctggatggcctaaagctacagaaatttcttggggacaaatttcatgattctggaagctagaggtccaaaatcaaggtgtcagcaaggctatgctttttctgaagcctatagggaaggccttccttgtctctcctagtttctggtggtttgctggcaatgtttggcattctgtggattgcagctacataactccactctgcctccatcattaatggccttctgcctgagtgttttcatatgaccatcttcatataaggacaccagtcatatttgatgagggttccaccctactccagtatgacctcatcttcactaactacatctgcaatgaccctatatccaaataaagtcacattctgagtgtctggggattagaacttcaacagagcttgttgaagggggcacaattcaatgcataacaggatggaaactagaaacgggtatgtttttatcagtgtagaaagatttagcttaatttttcaaagtgtaataaaaaccccaggaaaactcatactccctcctaagaagagcaaaagatggagaaacccgatggttaccttcaaacaaaaggaaaggaggaataagatgaaaaggaattaatccaaagcaaagagagtggcttatatggaatgttggtgcaactttctctgacacatctgtgcactcatcagctggggcatcatctccctggggtacatttggtcactgtgtgcctcatggtaataaactccagaagcctcattgacttgctagagatgagctcatccttcttgcttgcttaatggcaaaatacaaaataagcagtcactgacatggaacgatttcaggaatgccaaaaggttctccttttccaaaatatctcttccatcttcccaatactgttactgacatcactaacacctctccacttccggttgagacacctgggccagagctcctgatgtggcaggcagtgccctaaacgttttgcataaattaactgatgcccagagcaacaaccctaagatataggtactatcataccgcatcttacagataagaaacttaggcacaaagaggtttagtagtttagatgagataaccctgatgagcagagattcgaacccagcctccatgctattaaccaggacatcatattgcctttcatacatgctcttcaaaggcaacacagtaatcgattatcacactcactcacatctgattgtcacatttttcagatctgctctcctagcagagaatgaagcctaaggtatccttgtttctcaaagtgtcctccccagaccagctgcatcaaaatgaggggatgaggtgcaaatgcctggaccctgcccttggagcactgattcataatctcaagtcccaagaatctgcattttaacaagcatccccagaaatttcttaagtatactaatgtatgggaaccactgacactaaagaaatggaataaggggaacgtacaatgttacagtaaaccaggaaaagccagaaagacatgacaacacagtgaggactctggtagccaatggtcagtcaaatgcccaggggccctggccagaagagagttaggttgctgaggagtaagagtgatgctgaatgtggaggcttgagagcagaaggaagccagccagctatatcctcttgcttggatcacacaccctttccttggtggaaatggttatttgcagagttagagaaggcatgttttacagtttggatggcaggtatggatgtagacaataaagagcaaccagagtccatgggttcagaaatccccatgtgtttctgtttgaatgagacgcttgcataaacagcacaaggagtttggggtggggttaaagagaatggtgtggtatagggagagctgaatgaggaactgagagagcaaaatcctgtgtttggttcaatcactgattacaacctccctgaggctcggtctcctaatctgtaaaatggggggaaataatacctgccttgcaggtcctcacacacagggcatgatgtgaatccactgaggcatatagcactgtgtaacatgagttattgctattccaaggcccgtaaaaggctcttgccttggaatatatctgccacaccaatgcctgcagtccattaatgacacataaaggacactggagataacgatgtcccttgttctatgcatccctcccacccatgccagaaaagaaaacacagtcacctgaagtcattctaaagagtatgcctgcctcttttcctgcacagacacatatacacagacacgcacatacacagaccatgcacatacacacacatgggaaaacatgaggaaaagtggagacaagaggcaccaaaggacaaagtcacttttgtcgcctgtcccttccccagcagggctgggcctgggctgcttctcctgcctcctccctgaagccccctcctcatcatattccagtgcgtgtccaccactttggggccaggtctacacaactgcagtgattcaggtcacgggagaaaacccaaacaagcacaaaacatgcttcaacctatattttctaaattgtttttctttaaaggtgaagacttctgagcttgaattatccccttgtcagtgggctttccatgctgtccaagtgacctaagtgataatcaacctccatttcattttgagaatggttgtggtattttagagctatggtgaataagaaaatcatttaaaataaaatgatttttatttatttattgtttttatttattttatcttaaatgaattttaaatcatttaaaataaaataatgggataaaagaggatgctaaaaataataaatatatatgtatcaaagtgtgcttgtaataccaggcaaagaattaataagagataatattatggttggtgaaatgttatgtatggctacatcctttcaatgagcatttatagttcctttaaaatatgcctactgaagaaatatttacatgctaattaacatgtgcatagtaccactaggtattatagaggataccagatgtttgtagtagacacagaccttgccctaagtcctggtcttgatgtagtcactttttagtcactacaggtgactacatttagtcactacaagtgaccttccttcaatggggaaataaaggactttacaaaagacgtagaagacaattcttaatataaaagtgatttagatcttcacaagtttgtgaagagaagcagatgagtgaaatagaacactatcaatgtaaaatattattctgaggcctctgtaatgactgggaagcaacaagagggaggtcatttcagagagagaggctctaggttccaagctggatgctcaggtcagtgactgcaggtcccctccacacccatcaccccacaccctaaccctcttcagttgctcacaaaggtagataaatacccacatttttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgttttcatagtaaataatgctcatttatccttaaccagtaatacatacttatgggcttaaattagcaaaagcctctcaaaaagtagctccactcatttatccaccagtgtccagatgccatccagcacatgaggagctcccagaaaggagcagggaacaaactagggctgtcaggagtggaggagaaagaatggcatatgcaaaaaggagctgtaattaaatccaagggaacatggcacactctagtcttttgcacgagacaaagggcaatcctggtaaaaatacagatccccaggccccaccccaaagagtctgatctgattctgaaatggggccggagaatctgcattttaacaagcaccttcaccaggtgatccttttgctgagaacccctgagaaatgagaaccctgtgctagtgctgaatggagcattatattccagagttgaagtttggtgatcagttttccagatggagctggtccttggtgcatacctgggtataaatccaagccaattcaggtatatgagctgatatttcaaccgaaacactatctatagcctaaattttttctaatattctgtttggtatgaattctagaaagttgtaaatgctatatttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcataacaaatcacccccaaaattgagtcgcttagaacaacaaacattgatcctccacagtttctgtgtgttaggaatcaaagtgatttaatttaatggttctgctcagggtctctcgggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctctccacagggcaactcacaacatggcagctggtttccagtagagcaagcgagtgagagaacaagaaaggcaagcaaggtgaatgtcccagtcttttgtaacctcatctcagaagtgttaacccatcacttttgccatgttttattatttagaagcaaatcactaagtccagcccacaattagagggatggcattacacaagggaatgaacaccagcagacagggtcattgaaagccatcttagatgctgtctatcgcatctaagtgtgatttttccagatgaaaagaatatattaatttgtttcagtcttagtcgatgtgccatcccatttgtgctttgctaaaacttgtatcaatgtaaagcaaacattttctgatacaatttaggtagtgtattgtggtaatagagaccagtagtgttgaaaagatatgttgaggtcagaaattaagctcatgtttctaaaagaggagatatgtacaactactatgcaagccaacaggaaagagtgttttaagaatgctttctgctacaggtaactaaaaacctaaacagctgtggctttaaaataaaggtatatctaagtcacataagcaaaagtctaggggtgggcagctgctggcattgcttcagtagcttgataatggcaaaagcagcatctcttctatttccttggccttctaatcatgcatgtcacctcacaatcacaacataggcaacacctcatattctaagcaagatgaaaagggcaaagagtcatgccatatgcctctgtctcttttcataaggaagacaaagcttccctggaagtcccctctagcagatttcacttagatctcattggccagaactgagtcacatgcctgccttaaaccaatcactcaccaagaagactaacattatcatggcaagtctaaaccaactgtgactcatctctgaaatcaaaggattattaccattacccgaatccatcaggatcctgttggcagagaagtgggactgtaaattttgagcaggcaacaaacaagtcttctgtaaacttcttatgtgttgttttttatgtgttctatatatccagtagaatcacaatttccaataacagtctaaaaagatattttccaatagaaacagaatgtgtaagatcattacttatgaaatcccaaatgtacttaaggtttccttcttgaaaattccttattcaaaataaaatgtccagattttgaaacccagaaaagattctatattttaaaaatcctgtgcacatgtaaactgtttttcaaatattgccttcagatacattgaacagaatgaaatcttctgagatttactacatcagccaagtattatcaaaacaaacaggacagattgcttttcttgacgtctgctgcttgatttgtgttaactcatgtttctgaaattgtagtatcataagccaatgctgcacaaaggtatttcatgtcatttataaaaatctagtaatgtaaactgttaactccttataaagcatctgttgacacacaaaaatatcactgaagtgcatttatgcctttcttctttaggtctgcataatacttccctccagaaggccaagttgttccataaattacagaacagaaagttggttgtgggaggaatagctcaacctcatctgaggcatcccactctaagaaactaatggcacctacacctcttgggcattgagtttttaagcccatttttaattcttgttctgctcatattctaagtgagcacataaagtgctgctccaagcaagaccagcccttgtagaagggcaagtgcagtcagtcccctaggaaacgggactggggagtgatcgtttcaatgagagataaatcaaactgatgctaaacatgaacaatgagcccattagagattgtgagaaagaggcatcatcatccactcaacaataggcctgtgggacctcttgatagcctgaggatgtttaatttcaggtgcaggtatccagaatgtagcagctagactgatcaaggatgtgtgatgacagcaagcagtagtggaagagcccaggagagttcctaagcctgaattgcaatcctgtgctgccataaaatgggaagatatacttggtccagtcatctgacagctttggtcatcaatttctctatctcatatgtgactctattgctttaagaatccctttagctttaaatatctatgaatctgctgaagcagctgtgctttgattgatgtggatctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcacaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcctagggaaaaagtatgaagcacaaggctggacatagacctgggaatcaggaaattagagttctaattgcagcttttccattgattcacttgggatcttgagaatatctgtctcattttaatcattctgggccacagtttccatatctgtcaattagagtaagagtccctggctgggtgcccaggattgtgagaacataccattcagagccataaaaatgcaatcagtaccaataatgtactagtaccagtacctaggatgcaaaacatcctagatactaggtgtcctaacttaaagtggaaacattaacaagagtaattctttgaatcatcaaactgggaatattttaggaagcatatctatctgggtgaaaactaagcaaataagacaattgtaaaggcttgtgatctcaggaatacaaaggcaaaaatgcgcagacttgaaatatgacaagttctagttttgtcacttagcatctctgtgaccttggataatttcttaacccccggcagtattctcatctgtaaaatgggaataatgacatgcacttcagtggtttgtggtgaagattattacaaatagaaattagctcttttgagccactggtggggtttaaattcccagcccttatgtgctttgcagctgttagttcctcttattacaattgtctatttaaaaacctagtcacagcccggtgcagtagctcacgtctgtaatcccaacactttgggaggccaaggcaggagaactgcttgagctcaggcgttcaacatcagcctaggcaacatagtgagaccctctcatctctacaaaaagcaaaaaattagccagtgatgcatggctgtagtcccagctattctgagggctgaagttggaggattgcttgagcccaggaggtcaaggctgcagtgggcagtgatcatgccgctgcactctagcctggatgacagagcaagaacctgtctccaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagacctagtcaccaaaagcaagagattttttaaatgctactattttttgggcatttactaatcatattgctatgctctgcacccaagctaagtaatttaaataaattatctcatgtactcctctaaaactaattactgctgtgtaaatggaggtagaaagaaactaagctttatttctgcctctattgtttctttaacctgccttgcttcctttttcagttgcacctaattggctgtacttttagttttctttaaaactgccttaaatttcaaagactaaagcagcaataactaactgaatatatttatataacatgttatttttgtcatgttgctttccacccctggagacctgctctaaattcacttggacgtttgaggataaatcatgctcactagcagtttctgaaaatgcagtttcactgaaaatgcaggcatccagaaatttagtaagcaacttaaaagaaagtgtaagaatctcctatgtattcattgaaaaataatttgaatttatgcttagaaaaatagaattattattaagaaatcttacacactcatgtttttaaatatcttcactaaggaccaattgtgtatatggtgtaacactgtcctcaaagaacatgccgggagaattgttgcagttaccagagggttaaatttggcaaactcttttttattaacgtgccttttaattatgaaatagcatactcaccttagataaaatttgaaaaccatttttgtaaagtggtacaatattgaagaaagttgataactttcagaccagatttaagcctcaaatctacctctcttttacctggacaactcattagcatttctgaacctcacattttttctataaagtgagaatactatattatagagttgttgtcagttaaatgagaacagtgtctgatcacaactagtcaacaaatgttcacaactcttcccctcctaggaaaagaatctcaaggcagacctgcttcgggtctgctctgtaaagaggtaggaatcctctgctcccggtaaattgcttcctaaccttctttggtaatagactattttttaataaaggtgatggatcatttcccattatacactcaaaatgtgtgtccatttcagggcagtcatggatgaccattgcccatcttttgaccccagattaagaacacctgctgtagtattttaattctgccttcaaatcctcttacaaaacaaagacatctttaaaaaataaaattctttaggtgtcttgcagttgaatgcaggaaaaccagagccccttatttttgatagttttgggaagaatgcagtgtcagaacacaaacccataatagacaaataatttgcacagaaacttcataaaagtattgacctgatttgccatgtatttgccaccttttaaaacacacaactaaatgtttaccctgtgtctagatccaaatgggtgaagaaaaatgagtgacaatacatctacttaagctcacttacataattgtggccatgccgtttttttcacattacattattagaacattggacaataagtcaagaaacagaatgttctacaaaataaactttaaaaattggtaagcatcatgtgctttttccagaagacattttattttgttgaatcaaaggtggctctttggcactgagtagctccgtggagtcatggcagtcctcattccctaatcctgagcctgcctgagtcgctgctgtcagtcatccacttgttgggatttcaaactgcattaaatcccctcctatagctgtcactgccaagcagttgcactggctctgtcctacctttctgttggtaattctgtttttaatcctgtgcttcagtgtagtttatataaatctttacagagggataaaacttcctgtaattaattgtttgggtgaacatgtacctgggagagctattgggaaaggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttggttttctctagagctgtagttctcaaccttttgtgtggtagagaaacacctagagaacatgtttaaaaatatcctgggttccacccttgagagataataaggtccaaggggaacccaaatatctgtgtttcaggtcagcttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgccactgcactccagcctgggtgacagagcaagaccctgtctcaaaaaaataaaaatgaaaaaaatctgtgttcccaagttccaagtgatgctgatgctgctggttgcctttaagcatctcacaaagaacgaactcataaatgctaatacagtatatgtctatggatactgaatagtgggttttttttctcttttcttctattctgtgctcatgttgtgtcacttcttccttttagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 36328 - DNA, 85918 bp, Homo sapiens
cccagcgctcggggagtcaggttgacgcgccctggatgcggggctagaggctcggggctgggcgcgctcccgcggagccggagccgcagaggctcccgggctggactcaggcttctcaggtacaagttaggtgccagacgccgaggtggggtcggcgaggagcggcggtaggaggtctggccctgggctcggggctccggcgcccctccgcgggttcgggccaggcagcgccggcggcggccggggctgggcgtagggagtccgggccggcggaggcggcgcgcagcctcactccccgcggcgctcccggcgcggtggtggcggtggcggtggcggcggcggcccaggcagacaatgaacttgcgagctcgacgagccgaggcaggtttgggccccgggctccttggcccggcctccccgaggcttcagcgatccccagcgggaggagtcccttcgccattggtcctggccgcgctccgggcgccctgcgcgcttgaggaccccgcgggaagggttacccagcggcgacacacgccccctccctcgcagagaggacgcggccggagcgaggggacaggggaccgagcagtggcgtggtggcgccgtggatagccggaggccggcggggggcgcaagccgcgtggaacgcaccggcgggctgtccgggagaaggagcccagtagtcggaatcggggcgcccctgcaccgcccagctctgggagccgcaggcgggggaccgaccgacggacagaccagtgctttcacggtgtgagcgcgcgtcgtttggcggtaggggacggggattccccccagccttgcgctccgcccccacacccctatcgcactttggggaagtttccaggcgcggcccggggcaggtaagtgggcatccgccactctctccccggttgcgagctcggatgcgcttccagaaccctggctctagccttgcggcggttccgggcggggaggccagagctctcccgcgcctaagcccgtgggacccggttcagggaagggggatggcgggggcgggcctgggaagagataggggagcggctgagccccgagcggtgtgaacttttgctccccgccccctcctccttcctcctccccgccccgcccccactgctgtcccctccctgcgccccgccgcgtctcgggaggcggcgtgactcgggagttgccggcgcttcccggcggtggcggcgtctctggccggccttggtgcggcgagccgagcgaggcagctctgagccgcgcggtgaggccagaggcggggagccggggctgcggggcggcgaagctggggagccggatggcagcggccggggcgcggaggcgacgctggcggtggagatgtaatgcgagtctgttgggttgtgtgtgccgggagataggacgcggtggctgtgggtggctgggtggcgggctgtggcgcaattggccccctgggatggcaggatagaggcgccggggcgaagggaaccttgcctttgggaaaatgaatgaagagccgtggaagcaccttcccgactcctccaggcaaccgatgggccggcgtgcgcgcgagtgtgtgcgtgttgaggcttcggagccgcccgggtcctgggcacagctgcttgacctccccgtcgctgtccgggtgcccacgttcccgcccgccctgcgcccggggccggccggcgcggctgggacggcgggtatagaggaggaaggctggggctgggttgccggctgctggcggctggaggtccgcgcccagtgtagggaagtcttcgaaggaggctgccaggctggaggctgggaccagctcctgggggcgggggcccttcttcgtctgcctgcgtgcgcggagccgctgtgacagctgggcgccttcgccttgttcacgttggttaagttaattgtaccgagttctcgggaatgaagtgtggctccgggatgccccgcagagggatgtgacaagccggtcagtgaggctgagcaaaggggctaaccttgcctctgggcgccctagcagtgcccccagcccctctttatcagctgcaattcctgagtgttgtgggatgcctcggtgggttagggtagccacccagcgttggggcagaaaggcctcggagggcatctgcacccccgaggggccctgaagtaaactgaggcctagagatttgcccagcgtttctcctggaccctccttggaccttcctggaccattatccatcccccgctttcctgcttctcctcccaggaccggcaaccttgcaaaatcaggaaccctcccttccagaacatggcacttactaattttacaaactgaatgttgaactaggatctcttgattgatacataaagacatacatagatcatatatgattttattcaaagtagtataggaataaaaatgccttctaagtaggtaggtttttgcaaacaagtttttctcccccaagttcctgagaaactgtcagaagattttctttcttgccacctcctagatgggcacacagagctggtgaggtaaagtggcttgttatggccttcctgtgggcacataggtgagctggaggtggagctgcaggtctgggcttccctccaaagtccagctccggaggagagccagctcaggagccctctgcagaagtccaaccctgtctttgcggctctctcctctgggctttggatgattgcagtgagctggcttgtaggtgaagcatgcaggggtaattcatccaggatattgtccaggggggtggcaggcaggtcggcccacagtggtcacatgtgtgccttgcttttcttggatgatcaaagctcgccatgtctgagccactgtcctggccagggacccagcacggtcaccgtggctgctgtgagggctgcagtttccttccacacctttgtcatccctggttgctgctgcccctggccaggaaaagtgagatatcagaaacatttgatttttcacatgcctggaagagagaagattaattcctgcatcaagaagaagtgtttggggaaaggttggtaacgtgggaagcggattctacttatttggcgtcttgagaaacagcagacaagaaattccaagttaactagctgggccccaggagtctgcagtaggggaagctgtagattagtgctggactgtggtagtccaagccatttcgagttcggctggaaggtcccctgctagtggagggggctggggagaagagggagaccccagggctgtcctgaacaggtgagcacatgcccatctacaggggacagactagactcagctccagccagttggggggaaaacagtgtcaacaggtcttgtgaattttcgagaggattctccagcctgggtatttaaatgtgggctcaaattctagaagtatggtagagggttaggggtgagtgcccttccaggaggtctgaagcttgccatctggcccggtgcttatctattgggaagggtgtcactgcatcagagagcagggcacaggagccacacccattgtgggcccagggactaagaactgatggctgcccatcatgcctgcggccaggtccctaggctggaggtgaggcgggcagagctccttcatgtactcgtgtgccatgtgttcattcagcagctgttgaatgaattgccatgatgtagaaagtcatctgcatgaaccttttcatataattcctttcaccaaatagatcctacagctgagcctctgggatgatttggcggggctaggacagacagggtcccagccctcatgggatggggacaagcggaattggctgtgtagacagacaaatggtccagaagctgccataagagcccagaagggtggtgatgcaaagcaaggcttgggagcaggggtcagggagtggagggtggactcgggggagtgtgaggagtctccttttcaggtgtggacattgaatttcagagcagtgggtgggaggcacccaccccctgaacaggggatgctcaggtatgatattaagttgggagtgacttgcccaaggtcacatagccagtaagtggaaagtcagggggtctctgatctccagctcttggccagctccttcatctccactgtactgggctgaggcctcttagaaactcccagaggtgtggacactccctgtaattggcagctgtcatttttcccatctacacgttcaggccctgtccccgttcctagggcctcagcaggcccaggattgcagagatgccatttggagcatatttgtatgaaagaagagtcgtctaaattctaaaagcagagactgtttttaaaagtggtagctgacttgggagtgtcattgatctgagcaatcagccagcggacttctctttagcagcttgtgatttggaagtgactcagtcactggtgagaatcacgcagcctccctccccttctggtctgtaaaggggatgctcaggtatgagattaagttacttcaaagggtcactctgttccagtgctgtgaatgaggagatcatgtttgcacttagctggctaagtgttgggaggctgagtgtttccactgctcaaggcatttcttcattggcctgcagtatgagggtctgatttctttactgagatagtttctcctttcaaataaagcactgggacaaaatgatttatgtgtagacctgtgtctccacagcaggagatggaccataaatggaacagttatctaattagtgtgtccagtctaggtgtctagttaggagtgtccaggaagaaggagaaaggttttgtgtccatttgggccaacatagattttttaaattgtaactatgggagttggggaggaagacagttcatcgcaagacctatcacgtgctgcgtccctataggtttgaagctggccctctgctagacaggtcacacaggtatatccctttgtgtcctttaaagggctgggaagctgttggagatgacacacaccaagctctcagccatccggatgtgcaggaggagggattgggaatgacggtagaggcaggagggaaataagggggtgaggggagaagaacaactgtggctccagaaggaggaggcggcgtgaatcagcaagtggttaagttgtggggaggtggcaagtgggaagcagtttctcatcttcgctgatttccaaagggatggagaggaaaggaggctgtctgcagcaggacctgcagcgtttctgccctgcaaccctgggccaggtgcatgggggcagagagccagcgctcagcacagagcacagcactcagatcagtgggcgaggcggagctcgtgcaagtcagagttatgtaacgccgttgacaggcaccttatggggcttggcaaagtgcagcaggagcccggggtagcgactttgagattggagtgttccgggaagacttcgccccctggcttgagggcgggtgtcttttcagagttaatacctgccagtgcttggcacagtgcctggcatccagtaagtgctcagtaaacactggctcgggtgatattcttcagccccggagctcctaaccgtgcatgtctccatatttgattccagtatattctacctcaaaggatataggcaggagcccctgcaagccttggctccagctaggtttccttagggtggtggcttcactctctggactctgtctcctcatctgtgcgaggagaacactggtaaacagctacccttcaagacccttcagctgaccttgcagccaggctgtggagcagctccgctgtgcccatatttgatgcaattaaccagagagaggagaccgcgtggctctaggtggaactgtgctggtgtagctcgcttgtgaatgttacatctcaccccactctcagcttaaaagagcccagagggggcctggagggcgggggggtgggggctcctggcttcggcaggctctccctgatgcctattttacatttctagaacttatcgtggcccaggcctcttagatctctgaagaaagtaaggctggcagatcctcaaaagcagagggtatcattataatggaaacttggacactttccagaattgcatttgtggtaaaaatattgaaacagacagtccaggcacccaggtgcctggaaaataccccaacatgggcaaataattagatacaggccaggcacaattatgtttttctgacaataggctggaactcggtggcttagcattttctcttgaaacagaatacgcccctgccggacccttttgctccctgtggtcaaaaagatagtggtgtggccagcaagggggagggcatacaaggagaagtggcgatcccatccctcccagggtggccctggatctatctcagggaggttctgtcctgcttttgcttttctgtgtccctgtaggtagctgtcccgagggactgggcccgtggcacctttgctaggaggccagagcctgcatttcagagtctaagaggtcgagagaggtgtaagatgtattatcttacccttccacgaaagtggtctgggcagctgtgttcccttttgtaacccctggcagctcactcatgctgatggcggtaagttcacctgtaccttcacgtttcttgtcagccaaatatttggcgcccgtgacacggaagctcttttagcccaggtgttagatcgcataggcactgggtggggcagggcaggtagtgggttgagcctgggatccacgctgactcaggttcaagttcatgcagtgctgcttcgtcccattactgtggctctgaacaagtggcttagcttgcatctcggtttccccatctgtaaaatggggttaatgatctctacctggttgggtggcttgagtatttgaaatagtacaattcagggttcaggggagctccccacatggaatcacttttttctgggtgaggtctaaacctatggagagatagaggaggaggaggaggaggaggaggaggaggaaggcaggtggaaatccacatgcgatggctgttcccgactgcagctgttgttggagaatgtggctgaaccagtgggcaaggaagtggggaacaggggcagtcaggcagacccgcccaccccattgcctgcggagctggaggagcctctcccagcagggcgaagggcctccttaccatggggaaaggcagggctgggctgtcatgtccacgccctccttccatattcctgggatggtgtagaaaccaccacgtatagacaacaggaaagttacacaggggagcttcctcctcatggaaggaaacatctggggtggcggagaacagtcgccctgtggcaaggaatatgatgtgctgggctccgtgcccggcccacggttggagggtggtcaatggcatctgttaggtacgtacttggtagaagtggccacagtgtgtcaaatcggtgttgttgtctgctgtaggaaataatctggctttaaattcaagaacatctctttcctacttgttggcagagcatgattgaggtaatggtgatccatggatctcaaggtcacattctaagttgaacgcaattcacagggagctgaggtagtggttgactcctagcctgggcctggagaagcttctctgcctcctctctcttggtcccagccccccacagggcctgtgcttttaccagacctggttctgtgtttgcaacgagacgcctggccagccgggcctggacctggctacacttgggtcccccggccactggagagggggagcccccacatttgcctacttcatcatcgagccccccacccccactgccttcaggaagcgtttgccagtcattcttgctatctgctccccgtacctcccttccccagccaggtgtggatccttcctcctctgagcttctgcagttttcctctgttgtatttctcaaccttgaccctgtcccacactgtgctgggctccagtttcctgggtgcagtctgctctcccagcctgatgaggctctcttcaggaggagggtgtctggggctcacggtacatccatgtagctggactctcacttagtggccagtgactgccatgtgctgcattaacgcgtcaattaaaaatgattcttccaaaggctaggttctcctggaggttttatgtgaacactgagtttgatagtgtggcacaggagagctcacacttgtcactcaatttcccaaggagtcgagagtctaatggaataaccttggatttcctggcattaggttttggggctattaaaacatagtgaccacagttttttgtgtcttgagagccttaggggaaaatgttatggaaatttggttgttgtttcaggaatataagcggagccgtctactcaggcgagaaatgtggaggctgctggtgtttcttatagctggtataaatagcttggcttcaagttccatgctcctttgtttggaatgtaaatatttgcattaaaaatataaagtatgtcctggcatgtatttttagggactataatttccaaaccccaaatcagactatgggtctactgaggattaattttctctgctttgtgaacctgtgtatgtaaagagtcttccaaatgtacacaccaaaccctgtttgctttgtgcatggaaggaaccgccaggattacaagaaagcagggttgccccggggagtgtgggccgagggcttgtgtttctctccacacacttctgatggttctgcctggtagctgcagcggctcagggcggtggggtggaggagttttggccgagatcttgtgggtatcatcaggggcctggcttctctgttgttggtttcctggacatccaggtggggatttggctgcagctggctgacctctgtgtcacgtaaccagacgcttgactttggagttgcagttgctctaggaagatgttcgggagttttagtgccctttctgtggtctggtggagggagcaggaggttctcatgtccggttcagaggtgaactgtgaaggcctctgtgtggtgtcttcctccactggattcctgggggctgtttagctttaatttttctatgaaggacaacctggatgattggttaatcccttactgtgggtgggatgtcatctctggtctggcctcggcctgttctcggtagtggggggcttgatgggcagcaggagctgggcaggccatttgcccctggtatgggggagcttgttcctaaggctctctgggcagccttcaatggtcaccttctggcccaaaggctctaacggagaaggttgggccatggaggtcagctggcctgcaggggaggaccgaatgcaggtgggcccccaactggcaacctccctcttgtctcatcacaggatgaagggcagatgagaagacagccaggagggtcctgggccctcagctgtgactccccgagaggcaggtaccaagggcttcctttgtccttgcttcccagccagcgcgtggcccctgcccttgggagggtcagctcctcctccgtcccactgaacactgatgcctcaggactggactccttggggcagcagagacccttccgtctttccttccctagctctgccttgcaaaggtgcagcctcctgagcctcagagtgtctgacatctctctgcctaggcaccctctctgaaacattgtgtgggcttagaaaccgtgagccttgggaaggaccatcttcctctgagctctgggcgtgttgaactgcggaggcttaccacttcctcgcctgtggtcatctccagcctgacccatggtggcgtgatcctctctcatcatccgtcacagtttttaataaagaaaatatgttccagaaaggccgagtccccatgccgcatcaggtcagtgatccaagtgcattatagtgaaagtcagaggaaatagctgcttttaggacacgctgaacttgcctaagaaagttattagtgggaataaatgagggggaagaaagcatgctccgactaacgagaacagtatcagcctgacattttgtgtcgtcctaactttgaaaagctatttatacccacttgctagcagtttctatgagaaattagatatgaggagatgtacagaagagaagagtgggagctgggtgactgtgagctcctcctcagaaacatcttccaggcaaaaaaaaggaaaagaaaaaatcatttgctcacctatcgacaatagaaaatccagggatcttttgcattgtataaaatttggctcagagaagaaaaatgatgtattgaaaagaagatgaagcttcagttgccatttgagtggtggaaaataaatttgctttcggcccttaaaatggaaataagtcgatagaaaaatgcaggcctgcccccttttgagtcagcagtttttttggttgatgaaagggtgagaagacgtgctcactggaagtcacccgctggatcacttaggaagccgcagaagtgccgaaggacatgcatgtgtatctttcaaagttctcaactgatttattaaaaaaaatcataaagcagacttttgaaaaacctgttcaatctattcttctttaacagctttactgaaatgtaatgcacacaccataaaattcacccaaagtatacaattccatgttttttagtatattgacagatacgtgcaaccactaccacagctaattttagaactttttttaatctcaaaaagacatcttgtacaccttagctatcacccctttatctccccattcccctacatgtacccttcagccttgagcaaccacaaatctacttcttgtctctgtccagcccaattcctctattgtggactttcgtatgagcagaatcacatagaatgaggtcttttgtgactggcttcttttactctgtgtaactgtcatggttcatccatgctgtggcatgcgtcagcacttccttccttttcatggctgaataatattccatcgcagggatagaccacagtttcatggatccatttgtccattgatagacatttgggtggtctccacctttggctcttatgaatgaggcggccataaacgtttgtgtacaagcttctttgggtgtggacatgtgtttccgtttctagggttatgttttatgagacgttttcactttcttctaataataagattcattttttaaacaacactctttccctggccctagaaaaggctttgttcttagatgggatcccgatccccctgtcagtgatcctggctgagatactgaattgtctgaattttagagctggaaaggccttcgggcgaacgtggttcagcccctttttatagatggggaagctgagggccagagaggccacacataaagagacaggattgaataccggtttttggagttacaatccaattactccaaaagttctccctaaactcttactaaaaccccaggttgccttcttgactggcctggggcagcagattaaggtgggttgggtgaacagatggtggttagcttgccctcttttatgtgattatgggtcaaggttttcagtcatccaatgtactcttgcctgttttcctttcacccatctgtctgtccatccaatgtccatctgatgtccgaggcccagaacatctccccatccaccagcggccgaataagaacagcaccttgtggcgccagcatctttctagttctttctcccctgcggtgatgggcggcccggctgcttatccggggaataattaaattaggaaccaattcagagaatgaaattttatctgatttggccaagcccgtaataagcaaggggctgtaattgtgactccaggatacattaggaagttgttttttcaagggtacgctgggtgaaagcattgaaagaaatatgtggagaccaggccgggagatctccctgggccaggtttcttgcatggcctgggggtgtggtcccacagggcggctgtgtcctcaggctggtccttccagcgtttatgtttccaggcaccatttagctctgatgaggtagataaaagtgttttgtggctggagtgttctctgtgcttaggaaagttctgttaaaatccttatggatatctatctcattgttatcactgatattctaaagcacctttacaactgtaataagaagtaaacttggcagaaactctgtggctataaatcaggggtgccgctttgcaacccccacggagcttattgaaagaaatgcacatactttggtcctacatcagctgttacatcaagtctccggggatggatgctgggcatttgtgtgtgtgtgcacgcgtgtgtgtgtgcatgcgtgcatgtgtgtgcatgcgtgcatgtgtgtgcatgcatggacctggattcgttaagctctttagctaagaaacgctgagggaacttagcagtgattgtaatcattcttctaatgagaatttccagttctcctatggcaaagataagggacagataattagcacagtggtctcaggaatgagcctcatttgtcctcaatctgtgatgagactttgtgactgtctttgagtttcatgttcagattccctgattgtaactaacacacattgttcatcacttggtagcagtggtggaattttagatctgtttttctcttggggaaggaccccattctcatccccacagtggcccaggctggaggcccaggagtctcctttgacagatagctggtcagtgcagaattgcttcctttgtgtctctgccactggaaggttatctgttccttcagaacaggaaatgtgtcttattcaacgtggcatccccagggcctagtccatgggaaagaatgattgggccgatggacagacagatgggtgaaaggaaaacaggcaagagtatagtgaataattgaaaactttgacccatagtgcagggatggtgagtgtctttcagatcgtctgtttatagctggggaaacggaggcctgcagaagtcagtgacttgccctaatccttcagctttgatcaagaagaacattggggagcctggcccttcaatgtcttcaactcttctgactcaggctctgcacatcctcttgagagtcaccctccagtgaaaagaactctttattgaggccctgctgtgtaccccatgctgttctaggagctggggatctagcagtgagttagacacacagggtcccagtgctcacagagggcatatcctcatggagagagacaggcagcagacaaggtcgcaaatatcagagaatagacaggcataagggccatgtgctggagtgaccagctggtgtgcgggaaaggcctttccacaaaggtgacatctccgttgattcttgaatgttcagagggtgctgctgtctgatgcttggaaggagggaacagtcagtgccaggaccccaaggggagaacctgttgatgggatgggattcatttatgctcgggagaaagagacttggtttattggacgcctgggttgattttcttctcttctgcatcctctgcactgacatttgcagctctgccttctccccgtcccgtctctgggtgaagaacacctgtccgatgctcgctggcctgcagctgctgcagagtttcagaaaacagggctagcaaaaaacaaagcaaaaccccaacatccctgtcctctcactaagggcttggctggggaggcagagttatttttatgtaagcacatgcttgagggggtacgtcttggggtgggcagctgaaaccacactcataaaaacaagaccgaaataggactgtgaattcccaaaggtgaacacaggccgttaacttgaatttggtgacagttccatgcagcctaggtcctggagcgggaaccctttggagggggatgaggcatggaaaactgtttgctgatttggcctcttctttaagcattgctttccggccctggctgtgacagagacctggcccttgctcaggatttgagccccctcaaggggaagttcttcctccctcctggtgctgcctccagctgtttctgtctcctcgtcagtaagaacctctgtttcttgagggccctcctgttggttgtcctcttgttgcagccacctccctacctgcgagggagtgggccccaggctgcctctccatcccaggtcctgctgttaacctgggtaaccgtggtctccatggggcagcactctggcctcccaggtcctgcatcaggacaccctgaaccttgtctactcctggactgctccataccacatggagtccgtccttgttaatgacgtgttaatgccaggctttcttgtggaaaccacacccaagacaccagctggtcaacctgacacacagtagggcctcaacggattgtgtcatcagttattttcataaactttaaatctctttctggtctccccagacatccttaagagtgatcctttgtcacattgcaaagttttcccaataaatattggtcagtagttgtgacagtaatatacatctccattttatgttgttgactaatttttaaatggtggacaaaacataaatttttctacattttaataaatggaaagataaaagaaatttttttttctgagtagtttggtttagaatcattccagttgttcattcagcatctcttcccaagtcacatgagtcctacaccaggcagctgtggctgtattgacatgctgaatgcttgctcagagtccccataatctcttggcactcctatatgctgcctcatacttttattttaattttttattttgaaataatttcagactcacaagaagatgcaaaaatagtagactccctgtgtacccttcactcagcttcccacagggagaacatcttatgcaaccctcagacatgatcaaagccaggaaactgacactggtacaatagcattaactgagctgcagaccttatttttcttattaaacctagggatctacagcattttagaagcattttagaatttcataagctttagcattgttgtttgtcttttagaggatgtttcaatcccttccaattgacaatcagttaaaattcgtttccgtaagttcaacaaatactggaggatgaatttcacaggttccacgggtccacatggcgctctatgggtgcatcgtctctgatgggtgcacagaggtgaccttctacctcagatctgagagattctgagacataaagaaccttagacagtagtttggtttataggacagaccaggggagctggagttctgataatggaaaccaggctgcattgagtatttagtatgctttaggttttatctactttatttcatttcatacactcagcaacctttgaggtagatacagttaacatccccattttacagatgtaagaactgagttcagaggagttcaccctgcccacattcctgcagctggatggtagagttgggcgtggaatataggcagtgtgaagtcagagactgcttgttcttaaccttgccgggctccctccttggctcaggcctgcacagtgactgctgtgtgccctggggctgtcctgacttctctgagtctctgtttctttacctgcaatgcaagaggcttgtgtgagatctgccgtgtcccttccatttctgagtgcaggtggttttattggtgaaaacaattctacccgtagagctagaaacacccaagcaacatccaaatgaaatttgtaccttgccccttgtaggtgcttttaaggttggtagaatttctgcagcctagtttggtttgatgggagcctcaattccaattgaattatgctctggtgtattttaattaaaccatctacaagctgattttataaagaggcagaatccccatgtagtgagctgtgcctgcctccctctgtgctcaactctggagccgagtgaggctcgtaataaccagaggactgtgcgagctgctcaggctcggcctcatgggcagcattaattgtgagatgccaccggaacgagatgcgagggcattatcagcatatacttaattgattttgcattctccacaaaggaaggttaaaattaagcttgtttgtaaatggtgtttaaactgcacaggcttggggatgagttgcagaaactaacagagcagggcactggttggagggcctaattttctctttaggtggtggacagagcacatcactcaactaaggtaaagattttcccatttaaaggggctgaaagagtgtaagcctcggctcgtaaatttgacagacaaggcctccgcttgagtgcctcagggatggtctggactctggggatgaatgtgtaatcacattagcgtgatgagttaaagggccccatatttttaaatcctcaggcagagctgcattagagaagatgctgttcgagatcagacttatgataaacaggctcatggaaacagcctttgctatcctcattcctggtatagaatgtaagattctgattgtcattctgacatgccccaggaaaggtctctgctcaaacccaagatgagctttaaacctgaggtggaatgccgttctctaagtatctgttctttggctctaacatataccaggaatgagaacagcactctgggtgtgttctcactctcctttaatcctgataagaaaacattttaagtatctccagatccatctatataatttgcaagacgcagtgcaacatgaaatgcatattaaaaattattaagaattggccgggcgcggtggctcacgcctgtaatcccaacactttgggaggctgaggcaggtggatcacgaggtcaggagattgagaccatcctggctaacacggtgaaaccctgtctctactaaaaatacaaaaaagtagccgggcgtggtggcaggcgcctgtagtcccagctcctcgggaggctgaggcaggagaatggtgtgaacccggaaggcggagcttgcagtgagccgagatcgcaccactgcactccagcctgggcgacagagcgagactccgtctcaaaaaaaaaaaaaaaaattaagaatttaaaaatagggaaagcagaacaatacattctgtatagggtgtttctgagcaaagggccctgtgtgattgaccatgggtccacgcccttggagttggctctgggatcttgtaggatgctgatcctagaccaatgtgatttatagcaacttgtgtgaattgtgaactccccgggggcacgggctgcagctgaatcaccttggtgtgctgggaggggtctggctggaggcctgacctaagcacacgcttaggaaatgcccgttgagctgaatcaactaactcatggagccatcagcctggtctgctggggaaatttcatgtgactttctcagtctccacgcatcgggaatctgggacagtctaccgctaggctcttcagaacagacagggacaaggaccaacattctctaatgaaactcactgacttgacagctcagctttgagaagagaaaacctgaatacaaaacccatctacattatgtgtgtgtataagcctcaagtcctggtgatttttcactgtaaaatggaaaagattgacacacagtggctctccagtacctctgtgtggttaatgtgtgtgtctgtcgtgactctgtggctcagtcccaagagaggggcagcccatctcccctggcttttcatccctgatgtcctccctgtgagctctgctcctcccagtggagtaaaatgctcctggagacagtctaggattttaggggccactgtaggtcatccttgtcattctggatcccggagaatgccaccttgcaaagttgaggggggcatagtgcatcttggtaaggaaataaaatcccgcccaggaagcatctctccctggagcaagaggcttggaagggcccgggactcctttgtgctgactctttgttccttccctgcaggctggcccagactcagagttgccctttcccctttgccagtggagagggagagaggagcatccagggccagctgccaaagacaggggaggttctaaccaaggaaagcccggacttttcaggttttaaattggaagagggcttcttgaatgagcattaaagttacttttttattggaagggagtgtagggggtggatgctgtgctcagcatacatcaggagagagctgcccaagtcagatctcttccgagcagcgtcttgggggagagactgtgcaccaccgctagattttcctccctttgtcctcggtttgtacagaggtcactggagatgtgagctcaaagggagccgggacgctgtgctctcctctcattgtcacaagtcgatgggcctgaataggctgtgacacttgaagaaagaaagaaaccatcctttatacctcctggctggggagagacagcagggcaggaagcctgcagtgctggaggccaaagctactcccatggagcctcagatgtgtggagggaggtctgtgctgttcctgggtgtctgggattgtaccctccccaccgtggggatgcacagcctgttcttaacttattcagcaaataacaaacagcacctccatgttcaagcaaaagctggctttatttattttccccattaagctatccacagtcattgttttcactttcaaaagcaaaataataggaaaaaacttcacagtatttgtattacctgatgtaggagtctgagagaacttgaataataagtctggcttagaagtattaggggaaaaatcttgatacacaaaagagaaacagaaacatgaaaagaggaatgtgctgaaacagtcctccctgcaaaacatcattaactccgcgggggctgggagcctgtctgtcttgtccacacactgcaccccactgcctagcacagccgcattcaaaaggaaagtcagccctggctgctgggaggcagtggcgagtgagacatgcccaggtcctgtcctcatggaggttagagtctaggaggtgaatgaggtggaaacacttaggcaaaggatcatttaatttcagttgtgatgagctggggacaggaacgggaagtggtctatgagcaagtttgctgatgccgtgagcccagtctggcagaggcgcggggtgcattggagagctccaggtcataatggaggaagctgcgcggagggagaggaggcagagactgcagacgtggcgaaggtgttgggtgtgcagggggatgttatgtaagtccccagtgaggtgcctggacccagagttctcattttaaggcttagaatgtgctagaatccttgtttctagagactggattgatgatcacaactgggcgatgctcccaactaggcccccgcccctacctgccacctgaattgtgccctttgcagttgggtggcacactgtttagtgtctcctgctcactgcctccagggttccagggacttgctgattttctgtctctactgagagatttgagaaattcttgaagcaacttgccaagtagaaactgtctaatggcatcagtgcaagggttcggtgtctttcccagccggggggcactggccctgcagaaatgaagtggaaagatcttgggagggagagcaagctaccttccctgggggtgcagcaggcgtgacttgagcttgcgctaatcacacccacttctgtcctgagaaagtcttctatggaaagaggctaaaaagactatgtggaaaatatctcttttaaagcccccatttgagacctctcccctgccctgtgtgtgcctagcccgtaggttgctgccaaggtgagcaggcccgggatgtggctggggaagatctacagcctcctggccgagtccacccaggaggagccatttaagaccctggaaacccatcagacctggcaactggaggtcattagccgtctgactgagaggcgggtcgtaaaataagccctaagtggttacgagctctgttaaccattttaaaatgcacaaacagaggagctttggtttggcgcctctgaaaggaaatgggcgtcgtctgatgggagaacattcgccttcatggtcaaggcgcaaggaccagcctgcattggctcattcatgcgcctgtcgaatggttgctgtgccctttgcctcttccttggtttctgatggggcagaaacttaccaccatgtatctagctttctttttttggtgaacttttaaggaattggagtataaccttcatgcattaaagagcatctatcctaagtgtgctgcttgatggattttcacaaacagaactcacctatgcaaccagtacctagatcaggtatacagacagcaccccaggacccctgggctctgttctggtcattaaccacctctcagcacccatgcaagggaaattgctatcctgacttccgcggcctgggtttttggcctgttttgtgctgtctctaactggaatcctgtgtggttctcctttatatctgggttcttttgctcagtactacatctgtgagattcttccctggtgaagcttgtccattttcgcagctgaattgtatttgtccgttctactgtgggtagacactgtgtgatttccagtttttggccctacaaatagtacaatgaacattctagttgatgtcttttgatcagcatatggatgcctttctgttgggcacgtagctaggattggaattgtggtctttgggagtgagtacgcccaagcttcagtagataatgccagtgttccaaacaattgtactcatttaccgttcccatcagcagcgtatgagtctctggaaagatgaaataagagcctggaaaaaatgtaaggtgagactgactcccttttgtcctctgcccaagttcccaaaaagaagagaccctgggggataacagctggccctttttgcattgaatgggtgcactggaagagataaggcttctgggatgccccagaaagatgcacctgtccctcctggggttctgcccacgtggtcacgtttcactggaagccagtctgtttctgaacttgcggatggggttggttggtctctgagaagagcccagaattcagcattttagtctccatgctttgggtgtctgcatgcaatgaagcaaagcctccaggctcatctttgagatgaaagtggctggcctggtggctggcctggtagctggcctgggttttctcttgggagggcttgagagctgccaccatttaatggctcagtcaagaaaggtttttatttgtagatcagtccagtctcagaaccaaatggttctgcacccaccccctggacttccaacccagtgttctaggtggagaaagagctttccctgtgccaaaagctgttgtttggtgtgatgaggggtccagagcagtgggaagaggcagctgacatttactgagcctcctgcatgctcaggagaactccgaatgcaggtgtgctggtctccccaaccacacaggaagtggaagaagagaggactctgcactgtccctgagcagcagagccccagctggggtgtgtgtcctgccctggctctgtcaaatttgtaactcacaacagtggcagtggctggctaaaggagacttggaaggaaggaaaacctgtgcccgggttattgcccggctgtcttccctaccccaagtagattcagtaaatcgggggcagggcttggaagctgttggtaacaaatgccttaggtgagttttactcaatttggggaagcagtgacttcccagacccttttgatgagaggctgggtaaggagaggaatggaggaaataagaaacagatctcacgctccaggagcgcctggcctgagcagcctcgtgcaggaagctctctgaggagctggacaagctctgtgtctgctgctccacagggtcatgcttgaaatgtgactaggacggccgaagaatggaaattttacatctcatttacttttaactaatttaaatttaaaagcagatacttaattcagttattagaaaacttttaagaatgtttggaacagcttgggtccataactccttttccgactctaagtcttatgaaatctagatacagctcaggtacttcagatgaaaatgtagcatccaaattgagatggacctaagtgtaaaatacacactggaatttgaagacttagtatgaaaaaaatgcaaatttttaattaataacttttatactgactacatgttgaagtggttattttgcgtctattcgagttgaactacatgaaaattaacctcacctggaacatttaacctaggtatgggctcacactctgtttttgttgggcagtgctgctctgaggcactttcttgctggaatttgactcagagtgctagggagttggaggagaggagagaagccccagctgtggccccttgtttggctcacgtgggagcagggtttcaggctgatggcacacctggccctatagatggccacaaggccacctgtgatgggtctgttgggctctggctggcctgtccatctccttgggtactttgcccaaagagggaaactgcccgttccctccaggtagtgcctttagaaaacgagaatcttctctaacgctctgggctaggaagagagagctgagcacgtctcaccctgggctgcactgcatctcacacaagtgggacatggcctgctgctggtcagggtgagaactctgcctttaagttagaatcagatcaaatcaaatcaaattgaattctttaccccagtggggtagagagcaccgccaaatactaagctacaggaatgtggcccagaaagcaaattaggttttatttctgcctcctgcctttgccccgctgtttctggaagagaccccatagacagtgccgtgaagggcagcctacggagtctgtggcaggcagggactcgcaggtgagcctggtagtgggtcggcgggttctcatccatggtgctcagcccgtctgaggtcatctgccctcttcttcattggattctggaagcctccccaccagcctgcgagatgcagctgaacagggacttgttttgtttactgctgcatcccagggctctacacttgagcctgacatagagtagggctttaataatctttattgagggccgggcacaatggctcactcctgaatcccagcactttaggaggccccggccagacagatcacgaggtcaagagatcaagaccatcctggccaacgtggtgaaaccccgtttctatttaaaaaaaaaatcagctgagcatggtggtgtgcacctttagtcccagccactcaggaggctgaggcagaagaatctcttgaacctgggaggcagaggttgcagtgagccgagatcgagccactgcactccagcctggtgacagagcgagactcagtgtcaaaacaaaaacaaaacaaaacaaaaaaactttactgaatgggttcatttggaggatgccccttaaatctgatggtcaaatatggccttcatgttgaccttcctgaagtgacatccccgtaggtgggcatatgcatttcccttgggagagattcccagaggggcctctggcttgggattggctaggaacctcagacctacattgtgtttttactctagatctgtaagtgcagatttttcttttttttccagaaactgtttcttggacaacacagcaactactttccattgcaaagaaaaatcctgtcctttgtgtgctctctacaaagcactcacacagccaggctatatcatttgttcctgacaacgtgctgggggggacatcaccattttctgcatgtccccaggaaatgggcgggaccacttgtccaaagtcctacagctaaagggaggcacagtgacaccttagattcaggggaactcccatcttggggtgacttctttgccctcagtatattccacatgtcatggaacctaatggataaatctggtttggtcaggcctggagcgcagaactgttaaaggcaggcaatgagagaaaaatctgcgtccttcctcgagggatgagctggctgactgggaaggtccaggctcaggctggcctctgcccaggtgtcctatggcaggggctcatggaggagcactgttcctgttttctgggtcccctgctctgcctcacctgtttaaagtcagtgactcaaatttttaaaactgtgaaaccgtaaactgtccatccctgttcagccttccccaggccacgggccctgcacgtgtcactgcttgttcatggttctcccctgtgttgcctttgaggctcactcatcttgatgactcagagacttgccagagaccctggactccccgtcccaaattccccgagcctggccccgatgattcttgcaatgttactctgttcatggtgcctctgccccatttccatctgtgccatatcaccaatagttggggggggggtcccccaaacaacagggactaacttgaactttgcaagactcttgaatttcctggctatatttattatctgtatggcactgatttgtactagagctgagcctgcagaagtcagttgaacccatcctctctatattcaggaggactacaggatgtaggaactcaaacgggatgttgatctgtgggagtttgcaactttgcctagcagcacagacctgcctccttgggagaggcctctggggagggatgctaagccgatggatgtctgtgcagagacaagggactgtccttttcacctgagaggccattctcatcctgcctagtcctgtctgattcacatctgaccccagcttagcccagacagagacatgctaaagcatgttctgatactttctagcttcgattatctccttgtatgctttctttgtatacttagggcccaaaataccataaggtggaacattctaaagtaaaaatgatcccctttttattgtttgaaaatttgtgtttcttattaaaatagaacattttacagttattcacaagataaggtcttactttaaaaatcactattttcctctgtctttctgacttctttttttaattcaagaacagggatattaaggcaggtgatgaaagcagaatttttaataagagcatagtgatgcttttcacaacggacttagaagacattaaaatatatgtgttttgatctttttctggatttgaatatgaaggactagttattgcaacagacagcaaagtaattcatttcggatgcatttcagcaagccagccctctaggagacgctggaataaaatgtggaagtgtgtgacacagaccagactggacatgtacccggcccatcagctaaaaagccaaagagcaggtggaaacaggaataacagtgacagtgatggttaccatgatgaggagcactgccaacgattcctgaacttcccaggtgccctgtccttgcttggtgcttcccatggattatctcagtcttccctgtggctccattagactacatattgtcacatcatccccatttttcagataaggaactgaggtgggctaagtgtcaggccgtggagccaggatgagaactccagctgtctagataacccatgtcctggtaactgccactctgctcccgagtggtcagcatgtaaaccactgcagcgtggggactgacttcaccatccccttggctctgcctctgaccccccgagcaggtgagagctcgagccagctattccgggaattaggcatatactcattttttgcttcagttatttcactaattaaggcaaagtttctggtagtttgacattacgtatctggataattgcctcaatgtatcattttcactttgcacccgcagacacaacctttaatgaaacttgaaaacccaactctccttgggggaaatgatactcacttctgtttctaggccaggcgcagtggctcccgcctgtaatcccagcactctgggaggccgaggccagcggatcacgagatcaggtgttcgagaccagcctggccaacatggtgaaaccccgtctctactaaaaatacaaaaattagcggggcatggtggtggtcgcctgtaatcccagctatttgggaggctgaggcaggagaatcgcttgaacccaggaggcggaggttgcagtgagctgagatcatgccactacactccaggctgggtgacagagcaacactccgtctcaaaaaaaccaaaaacacaaaaaccatctgtttctaaatctgtttctgaaagtagttgagggcgcagacttccacttataagcttaattgcccaacatgcagaagaagtctccaacttccctgtttatcaggcttgaaagtcagccttggtttggggcagatggcctgctcctggtccttatctgggagatgagaggttccgacagtgtgatctctcaagtgcctcagtttggatctgagcttctgttctagcggcttccatgcccaactggattgcatatcttaggaagcaggacagaagtgcacctgcactgattactgagcaaattggtctgaataagtgcagtagatgccagagatttccacgaatgatgtgaatgtgatcactggccagaaaatatccatggacgataaatatctgggcttcatgctctgaaaaatgttcctaatctcttctttgtgatccccaaagagatttttaagggagtttggaagtctgccacttgcagaagtcctggtgttcccagcactaagtgcaggatgtggagtctggggtgcgactgtcttgtcactcagatggggctgcatgcccggcacagtgctaagtgcagccagttactctggaatgtgcaaatggcccctctgccccagctgcagagcgccttgcgggtggctcaggtcctagtggggataggaagaatgggacaaaaggaggaggctaagcccaaggcatgtgctgtcaccaaaagtgctggcttcatctcagaaagctgtggctgggttgggcttggttgctcaggggaacagggagacgcagcccaggaaatgagctgtggctgggctggagcccacctccccaggagggaggtgcatggcagcccaggtggggtgcccccatcctaagatgaaaggtctccacctcttgcttaaattgtaaggtgaacgcttttggccatttctaaggaaaagcacctttgggatttgttcatcatccttcatttttgctcaaggttttgggtgtgaaaacctcagaaaaactaagtcaaccaaagactttccagcgatgtcatcgactgtgttgtcatccaaaggggaaaataatcccagcttatgaatatttagaaagaagataattgcaaattgctttgtgaccgtgtaaactcgtttttttttttctttcccccagccagttacataagaggaggtgtgggtcagtcccagaaatagatgcagaagcagtgacagaacacgtcttggcggtggtggagagagacagccctgggttcgagtcccagactcgcagtgtgttagctaaagaagtttgagaaacatccgtctctttctttccatttcagcctcctcccccttcccctagctggtcgacgctcaaagctctcctagcccaacactctgtaacttgaggaataatgttttaaacccccaaatctagtcctcccataaaacccagtgaatctctcaaattgattaaatggaggcactcattttattagataggtaactggtattttgccttttctgaagggtagaagaggggaaaaagtgactgaggggaccaaataagaaaaaaaagacaaaaagacagaagaattcgggtttttagttgattccgaatactcgatgcttttgaaacgtttccaagtttcctttacgggaaaggaatgcaaatgatccaaaagggaggagggatttttttcccccttcttttttgtcctgagctcagtacctgggattttgcggcatgtgctgaaaaattatatcttctgggtgcagaaatttgcctgaaagggttatacgaaactgagaatgggtcaaaacaaaacaaaacggaaaaaacaagacttctggccacaggtaagaatcatataatttactgagacatatcattttggcatgttttgttaagggtgaaagctaatttggaagaggcaggaaggggctcttgaggttggtgggaatgagctgccgtaatggggcccgcagaatcacccttgtgtctgctcccagcaggactggcgggggaggggcagggagtagctctctgtgggtgtcgggaaccccagggccagtgaagcctggggccaacccccagcagtcccacagcagggttgggtgacaacaatttgcctgaaagtcatggagaaacaggttttcagtgacatagagactaagcctagaggcagaattgtaaaacctaccaagttttattacttatttactttttttcttctttttgagatacggtcttgctctgtcacccaggctgcagtgtaagtggcatgatcatggctcactgcagcctggatctcctggttcaagagatcccccgacctcagcctcccaagtagctgggactgtaggcaccaccactatgcctggctaatttttaaattttttgtagagatggggttttgccttgttgcccaggctggtcttgaactcctgggctcaagccatcctcccacctcggcctcccaacatgttggaattacaggcaagagccaccgcgctcagcccaaattttaaatttaacccccgcccccaacatgtattgggcattctgtctttatgactgggctatgtttttatgtgtgttgcctgcctacctttagaattttcttcaggacttttttttgtaaaagcgaacaaaagaagagactcttttgccttcacagagctgataggactgtcagctggttaaggcggatgctagtcagacaagcacacacaaaaaacggaagtgggaagggttggaggatcagggcagggccagtgtggtctggggtttcagggaaggggtccttgcctgagatctgaagggtgagcaagagcgaatgcatctagcagggccagtggtgttggggaaaatgggatctggctaaggaggctgggagaggcagagatggacacacagagacagcgagataaaggccgccagcaggagtgggggctcgggggtggggttggggggatgcagtgctgcaagggggattgaatgttcccaggtacagcccagcaacgaagaggggctcagggcttgggggacctgcccaaagtcacagagtgggtatggttgtttcatgatctcgtggtgtctcccgggccgcaagccccacagcgccagggctgtgcctacgctgcgcaccctgaatccccatggactcccagtcaggggcttgcgttctgctccgtggccactgctgtacctttgcaaggatggggaaggccttggggatggggaggccatcacacaggcactttgactgcatcaagcgaaattcttacttaatctgaaatgacttcaggtctgaaaactgtgtgctttgatcaaatatttacttttccgaaacagaaaccagagcaggtcttgattgtaccagtcagcttgaaccagtcagctacaatgacttttcgtaagtctatttttttttttgagatttcgttttagcccaggaggaaatctgctatctgcaagaaagtcctggccttcataatgaggcctgaattctttccagatcttatgagaaagattccactcttctgtgattaattcagagaggttactaatttctcataccatagatcgtttgctttgtgggagatgactgtgcctcagccaagatccacttattattttttgaacaagttttttttattatcatgtttacatagcactgaggacacaaaacaacgctggaagctcagctgtctgattcatacgctgtattgctgactctcacttctcccttcccctctctactctacctctctgcaaaagaaggctttccttccagagctggcagctgcccctgcttcttgacaggatgagcaagacagcggtggtttaagcaaggtcttcgctgtgctccggagagatgtgggtattctgggggaacatgcctttgttataatatttattgaatgttcacttttccagctctgaatactgaaacttagtgagattttttttttcgagccatgccccatcaacacttttaggttgtctctaatggaaaagagaaaagaaaaagattcatttttgatggactgggcatatccaagttcagtgtcttgggtgataggtctataaataaatacttgtttgacctattttacagaggttggaaatctagattctagatctgagtggagttatcagaaactaggtctgttatctaaaaagctagaggaaattgacaaggagaaggagggtctgaaatgaccttttttttttgagacggagtgtcactctgtccccccaggctggagtgcagtggtgcgatctcagctcactgcaacctccacctcctgagttcaagcgattctcctgcctcggcctcccgagtagctgggattacaggtgcctgccaccacgcccggctaatttttgtatttttagtagagatggggtttcaccatgttggtcaggctggtctcaaactgctgatctcaggtgatccacccgcctcggcctcctaaagtgctgggattacaggcatgagccactgcgcccagcctgaaatgaccattttttaattagtttcttgtctggatctctctctctttgcctcctggtgtcttggtgggaccagcgttttcatggccacatcagggtggagaagggctctctcccagcctctccaaagcagttttattcagacattgctggtctgcatgcagctttagccaagccccccaactcttgaaaatgggaaactgcttgatgagtgaatgtgaaagtacatgtccccatcctccatgaggtgagaggtcttcagcttgcgtttaagtccagccctgcctcttacttgcagtgtgatttagggccagccacttcactgtcagagcctcgggctcccttcatcctttttaaaagtattcggccactgattccggctcggctgggtctttatacaccaggccaaagtccttactgttgagctgagatcctgtttgcagaaacgggagggaggaaagaaaaagaaatgaggctgctggtggtggtggttgccgtttgttgagcagttggagttggcaggcactatgggcatatttttgtggggattttcccgtctaatctccacgcctgtccatggggtcggtactgccgttaatctccctgctacagatcagcgaagggaggcaccgaagtgcaaagcagtttgcccgagggcacacagccggtaaggggttgatacaaaccagatggcacgtgtggatgttcacctgcctctgggttttggcttttcatctttcctccccgccatgtttctctttccacaagggtatgtgcccgttcctatgtgcccagcagctgtatgggatgagatcctaggctgcctctgtcaaacgctctttgggcattggtgaacattcataaaacagcatcctctggggtcacattgtcccttttgctcttggacctggagttcctttggtctgtgcgtgtgtgtaaagatgcatgcccactccagggaattctgtggtctgcttggggttttccattgcagtggcagagaagacaagggaaaatgtccttcccggctgcactcccaggcctgtcatttggagttgaatggtaatagaagggttttttttttttttttaatgatttatagtatgtctggaggaaagatgttattaattcaaagataacttgagaaaggaggggacacagtgcagcttggacagagcttcccactggtgctttgcgcagtctttagcccacctctgccttgccttatgtggtcctatggcctcatttcaattccctatttcacctgatctgacgagggaggcaaggagtgcatgcattttcaacagataaagaaactgaggctcagagacgtgtcttactggacgtgaactcacgtcctggaggcctaggcccagtccgttttctatttgccacaccattttttgtgcaacatttattattttttctttattatctttgtagttacaaaagtgatgcttgctctatgtaagtaaaattggaagcaagatggaatgtgtaaacagaaagcatagccccccaaatgctacccacaatcaacaatgggaaactgtgtggggagtgtattagtccgttttcacgctgctgataaagacgtgcccaagactgggaagaataaggggtttaattagacttacagttccacctggctggggaggacccagaatcatggtgggaggcaaaaggcacttcttacatggctgcggcaagagaaaatgagacagaagcaaaagcggaaacccccgataaacccatcagatctcgtgcttatttactatcacgagaatagcacgggaaaaaccggcccccatgagtcaattacctcctcctgggtccctcccacaacacgtgggaattctgggagctacaattcaagttgagatttgggtgggcacacagtcaaaccatatcagggagtgaatgtgaatgtgcatgtcccatcctccatgaagtgagaggcagtttgggcttcagcttgtgtttaaatccagttctgccatttacttacagtgtgatttagggcaagccacgtcaccccacccagagccaccgttttcttatctgcacaatggggcgattacacctacctttagcgttgtctaaaagtcagaaagagatgagaggaagcaggttcccagcttgatgcctgccataaaatggcagctcatcctggttcctttccctttctccctacaccagtgcttctcaaactttcctcttcgtactcaaaggtgaaagacagtgagagctccctggggtttcccaggctggccccgacagcttgcagccagcaaggcaagctggatctctgcaaattttgtgtcagttagtatatacgtggatataacttcatttgaaaacaatgttttcaatgtttgaaatttcgaatattttaaacatggaagcttcagtttgtcttacagcttcatacagctcctggctaacctctgcacactggaggtagaggggctggcacacctccacatgcccacatgcccctgggggaagcacacctttgcacactcctggtggggttggcacacctccacatacccctgggggtctggcacaactccacacatccctgggggcctggcacacctccacacacccctggggggctggcacacctccacacacccctggtggggctggcacacctccacacacccctggtggggctggcacacctccacacacccctggggggcctggcacaccttcgcacattcgggggggacacacctttgcacattcctggaggatcctggcacaacacgtttctgggggggcagacacacctctgcacactcactcctgggggaggtacacttctgcacactcctgggggcggggctggcacatcaaacactcctggggaagaccagcacacacgggggagggttggaacacctgtgcacacactgcatgggtgctggcacacctgtgcacacactgaatgggggctggcacacctgtgcatacactgcatgggggctggcacacctctgcacactcctgaggtccctacagccaagctgggttggtactggagctgttctcctcacctcttggcaggcttagtaagggctgggtctgtctgggggcagaaaatgaatgtcagctgacttcaggtgaccccctggagaaactccactcgcctggctctaaaaccctccagaggacctcgccatttatttgggttgcttggtctttccatcagaaagaaataaattccaatgaagggttttcaggccgttcttctcattgaagggttaaccagattcttattttgctcatctttggaaataaaacaatgtttagaactacccggatcagcaaggccatctggtggggagtgtgcagctgctcccctttcagtcgcgccgcctgtaatggattcattctagggtgcatcgtgcatctgcagaatcatgatttgcagttggttttgaacgtgtgagctatgtgtccatgcgagacctttctcctctgcccgtcctgaaggacatctgggccgggcatcttccactgtcctgcagccttttcactcttcgtgaagtcaggtcaaagtgggcaaggggactctggggacctgagagtggacagagtcaccctgctccttctgtccttaatctgtagtctctgtgcattatactctgggctgctgcttttcattcatttctctatctgtgtcaaggaaaaattgttggacagcaactagaatgtaccactcatctttgtagtctaaatacaccacagccagaatgacccctattctgaaaatgggtcactttttcctggtaattgaggtttgatgttgcaggtgtttgagccccaaaaacgtgcaaaaagaataattataacatgtattaaacatcctgggctcctgagatcactgcacccatggaacaatgctgagccttccacattgactttgagatgaagagaatgagggtctaaatggtgaaggggtttgcctactgtcatgtggctggttaaaccgtgtggccggtgttcagcctaggccttgagtctccagttcatccctaggccagctcgctgtcctgtattctgtaagtcatttgggggaggaagtgtatagcattacattctctgggccacagtttccccacctgtaaaatgtaagtagtaattgtactgtcctcttagattatgacatttaaatagaataatccatatcaaccccagcctggtgtctggacacaaggaagccctcaacacatgttagctggtgtcactgttgttgtgactcagcaataagaactctgttctggatatttgctggatatttgccatgctttctggagcttgttccctgactctttaatttaaaagtatttattgagcacttactctgtgctattcaggattgagcactactgaccctggccttttatgaatcttgtagtccagcctcgcctccttacaagggagacgggtggccggtgggctgagtgatggctgaccgtgctccactgtgagccttgagttctgagcaggttcccctacagctgccaataacagcttcgttcgcctgctgcaggagaaaggtcacaggctttgcagccacacagaccagcggttggattttggccccaccactggtgagtcctgtgactcagggttatgtgtttaaccctgctgtgcctcagtttcccatacatgactcggggaatctcagtgctgacctcagagagtgccttcaagaagggacctagcatgatcctctgcaagtggcagacactggactatcaggcatttccttcttcttttgccgccaaccctaaactgactccgtgtgctgctgaaatgctttgcagctatatgactgtcctcgctttgttccctagagccattttggtagacgcgcttctcggcacaccctgtaagctcctcttgagtggcctctgccttattggaaaaccggagtcagtagatatacaagcatgagaaaatctagtccctacactggtgtgatttactactggaaataataaaatgagcactctgaaatagtttttctctccacttggtttcagaaaaaattattgattgtgtcacaaagacctttagagtcttttgtgcacattgaaatcattgggggggagaactgcagcatgaacatatttgaagtctctggtccaccctgccccttcgctgagaaaacctgattattttgtgcatttcagagagactgggacatctgctgtgtttggcccatatctcgggtggttgcacaagggaggtggagctgattaccctattagagagcaagctatcacagaataggaaaaagaccccattctccctcctgcctgccacggccagaggccctggttcactgaatcactgctgttgttaccacgcttgtttggcttcctggagcagagctagttcttctgcagattctctggggctgggtgggcttcacggctgtccttgaaatgggatatacagtcccgaatgtgggcatttttctggagcctctggagtctttgttctggcgttagatgggatgttcccagaggacccaggctgttcatttatttgtctgtacgaacggacacgctgcagcccaggcctgtacgactggacacgctgcggtctttgtctttggagccccagcaaatgcaagccctgcacatagtaggtgtttaaataaagaggtgcaaaagtgcgtgggccactaatctggagaaaaccctgtgtctcttttggattaattatctggctaataaagcaagcgctgcgccggctagtcaacgctcactgcaaaatcactggcctctgagcagccctgaaagacataacagatgaagataatgagtttgtattaaggagaaattaacttcagatcatacacccatgagtgttatggccaaaaggggtagtcccaaatccatatcttatatacggagaaacagaggccctgagagatgaagtgatgctcagggtgaccagccaggttagtgatcaggacaccaagtagctccctgccttgctgggaaggtccctcctttgctgctctgaagttttaaaatgcaaattatcatggaagccaccacctgggccgcagcgtgtccggtcatacaggcaggcctgggtcaaagtgtgtccggtcgtacaggcctgggcctcagagtgtccggtcgtacgggcccaggctgcaatgtgtccggtcgtacaggcctgggccgcagagtgtccggtcgtacaggcagggctgggtcaaagtgtgtccggtcgtataggcctgggccgtggagtgtccggttgtacgggcctgggccgcggagtgtccggtcgtacgggcctgggccgcagcgtgtccaactgcacacagcccaggcttctttgatgtgcggggacaaaataggagttgggggctgcgcaccggggcctgcctcctgtgcatggggccagttccattcctgtccattgtctcagctgcaaaggtaactgacaagggacagccccgcctctccttcctcccctgcccctgcccgcctttctttctgtccttccttcccctgtccccacacttggcaccaggccagcctctacacatctccgttcccccatcccttgtctctgtcctggagctgtacctgtctcctagcacactttcctggctgcaggagacaagcctgagtgatgaatagagtctgaattgagacaggttaagactcaatgccccaggccgacagggcattcaaaggagattgaaggaggtaggggagtttcatcccatcagctgcctcctgggatgcttccctcaccttcctgtcctgtgtctctgggtgagactgcaaatctgtattctcggaagggattcctcaaaagattggaagggggaagggcaccaagggcctggagaagccgctggactgtctgaggccaggcctgggtggtggggtagaggttaggatgggctccctcttgagggatggtggaagactgagtgtcaggctcctgaggcctcttgacccatctttctataatgggctgcatgtccttggggaagtacagaccacactggccttggtttctcctctataaaaggcaggctggatgcaggtacccgcaggtttgtactggcaagctgatgatttgctggagcccacctgggttttgccctgggtctgagtgtacccaccatcattgttgaggggttccgggtgtttcttactgtgaatgactgcagtagaatcctcagggatcccaggagcttcactgtcttgcatttcccatctgtacagcagtggctggtttaccctggatctttggggatgggtgcgtttctggaaagttggcccttgttgttgagcactgaaacaagttctggatgagcatggtcatttggaggggggtgagcttttccagaattttccccacagctgcgccaggctcgccagagctacgggccctggtgacaggggtgcccgaatgatcctggccagctcagctttttagtaccttgttctactgtagaacttgggtgttacttcctgcatctgtgtggccacctgccttttccagggcatcccctcagataagtggcagacaggaaaattggacaccggtgtctggaattataatatatgcacactgaaagcaagtaaccctggagtgaggacccaagggtctctccagtaataatgcaaggaatccgggtcatttaccgagaggcaggggagccagagatcacctccaaccccctccttgtgagctcttacgtgggctcctgaactgcatctagaagccaacttgacaccaggcagacaaacaaaagggaagcaaacacactttgttagttttacctggacctaggaatcttcacgagagagtgaagtttgaaggagtggccaaagcaagatgtttttagaccttttagacaaagaacaatccatttcagaagagacagaacagaagggacctggtggagtaatatacatttctaggggagtctctgggagatctatgggatgtgtaacggcagtggaagagaagggttactttgtgaagtgtatttatcctgggtcattgcagccccaagttcccaggctgtgctgaggagggccattttcttggcctggcaggggaagggtactcctcccagaggagtctatggcttggagtatgcaggaagagacaggtcagctggccctttctgaaactataatttctccaatgttttcgactcaaaataatcaacatatcaatttggcatgttttgggatggctcatccttccacggtgtgcggggtactagactctgggttaagcattttgtgtatgtgacctcatttcttcctcacatccacagtaggagactgagatcattttattcccattttacagatgaggaaacctagtcacagaatggttaaattcgttgcctgagatcatagagcagttacagacttgattcgggttgaaatgcaggtctgcccaactcccaagcctggcataatgtcttattttcgactgcttggaaaccatttttcctacatcccatctttctaccaagttgagaatcagtgagctcaggacgcaggggaggcgctggctgcatattgtagagatctgatcttggggaaatgcctgtttattatggatatggcttatggactaaaacaatagcattgaatgtacgttgtatgcatgtaaggtagttgtgattaaccaaaaccaatgttgatgacgaacttaacagagagtcaagtgtgctttaaaaataagcttaaaaaactgcctgggttttgtatgcacagattttgggccagccaggaagatccctcaggttgtggtttgagaatacctgttttagacaaagcacgggtgatgtgtcccagtcatcaggaaggatgaaatctggcaaggaaaccgtaaggatcagattacaggaagggcttgctcagggagaggaaggaagcaaggaagaaattagtaactgaaaagaggcaaggaggaaggcctcttcatcaggaggtgggggagtgtggggcagtggataactaaaacaaaacagctgtggttgtcataaacacattttgtcagaaaataacctggtgtgttattttctgatgtttcagccattgtgtcttgattcaggaacagctcccttccgagtttctttttgtttgtttgttggtttttgagagagggtctcactctgttgcacaggctggagtgcagtggtgtgatcacaactcaccgtagcctcaacctccccaggctcaagcaatcctcccacctcagccttccaagtagctgggactacaggtgtgcaccaccacacccagctaatttttgtattttttgtggagacagggttttgccatgttgcccaagctggtctagatgaccctgggcttgagtcatccgcctgcctagtgctgggatgacaggtgtgagccactgcgcccagcctcccctctgagtttccatcattacattggcctatcggctgctggtggtagccaacctctgggaggcagaggttgcagtgagtagagatcacaccactgcgctccagcctgagcaacagagtgagactctgtcttgaaaaaaaaaaaagaaaagaaaaatcaaccctttattatgtctctggtgtctttaggaattggctgggatccagcgggtattggctgctctgggtgggctcagccaggtggccctgctccacctgtctccccctcctcctggccaagcaagtgtgcaagaggacaaatgagtacacaggacatgtcttagggcctggcacgtgccagctttaagcccacttctgcctcattctgctggccaaagtgagccacccaactcaaaccgaagggtggagaaatacgtcactcctgtagctgaaggccctccaaagtggcaaagaatgtgaacatgggaagaagaaaaaattgagaccaataatgcaatctatggtaaagagtaataaatgactatcaaattcccattgtgggccaggactgtgcatctgtaataccagctaacatttattgagcactgactatgggccagagactctttttttttggcagactcttgatctgttgcccaagctggagtgcagtggtgccatcttggctcactgcaacctctgcctcctggattcaaatgattctcctgtctcagcctcctgagtagtgtggattacaggtgtgcgccaccaatcctgacaaattttttatttttagtagagattgggtttcatcatgttggtcaggctggtgtcgaactcctgaccttgtgatttgcccgcctcagactcccaaagtgctaggattacaggcatgagccaccgcgcccggccgggctagacactcttttaagcaccttacatgaatgagttcactgaatgcttacagcactgccatgatacaggtcctgtgattattcctaagtcgtatccaaagaaatggggagaagagacgtttaatatcttgttcaagatcaaacctgggcaacctggctccagcactcgggctcttaactccagtgctgtacgtgatctgttgctagcggggacttcttttgaaaaatacagaggcccagaaaccttaagtgatttgtccaaggccgctgggtggacatggacttggaatcctaatccatgtgactgctgtgtcctctccgctgtgctatgggccagtgaatgttgacggagtggtgtggctttattctgcttattgactgggatgtgatcaaaactgtcgaagtccagatagaagactgaatctgatgatttataatttgtacagaactcttcagtcttgttggctttcttctcagtctcagcaacaaccttctatcttagagctacatgtgaaaaatgttccttctcctacttgttgatgaatagtccttgaaaaaatatatttccatatatatagcctagagaggaatgtcagcagttacacatactaatcagaagaaggctttgtgttttagtaaaggttaattaagacccattgaattttttttccttaaaacataaaagaaaaataatgtaattagctatttttttccctctctgtccccagagggcaaatgtaaatgttctacctaaatgaagctatttgtttaaatccatccagatttcttctgaagtttcatacatctttcttctgctatatcagcttatagctacaataatttaataagtttttcctagggtgaaattggatgccctttatcgatcttacactgagggggcattcaattacttaatctaaagtggtatttctgggtctctcaattacaattttgttataaatggcttgctaatgatgcttgggtgcataggttaatagggggtgtccaagcaagggctgggtaattgaacactttctattttgggacccgttatctgatttctctcctggtgccaggttcccacagtgatggtctgcagccatcaggctcagaattgagcccaggtgggaagcaatctcactgaaatgtatacctgaatcctttggtttaatacatgaacggaagtgccaagggccccgtcttgtctgagtcgaccggcaccaaatgtggacattccagacaggtgaagtgcagggggcatacatgactcctttctgaaggaagaaccacttgagtgttaggtttctgaatgactgttcttgggataatttgtggcctacggaaaaggccagatacagaacgtaacagcaatccattttcctttcaataccaccccattaattggatttttcttccctgagttatgttctttaatagttatacatagtaaactattctatacatattttactatgtatatttactatacatagtaaaaattcttttgaggccaggcgtggtgcctcatgcctgtaatcccagcactttgggaggccaaggcgggctggatcacttgaggccaagagttcgagactagcctggccaacatggtgaaactccgtctctattaaaaatgcaaaaattagccgggcgcagtgatgcatgcctgtaatctcagtactcgggaggctgagacaggagaatcgcttgaacccaggaggcggaggttgcagtgagccaagatcgtgctgctacactccagcctgggccacagagtgagattccatctcaaaacaaaaaaaagaatatgtagtatgccttccttcttgcactcgagcaaatcccacccctgactttggccttcaagactctacagagcctggtccctgcctcctctcccatcaggtttccacccccaccagcctgtgccccagggcctaccctgccagtagccctcatgggctgggactccccacagcgtctctctacggggcctttgcttcccctggtctccacgtgactggcttccttcttgttcaggtttctcctccaacgtcccctctgaaatcaggtcttccctgtcaccctgtgtatcatacctcccacttctttaaggcagtagctccaacccaggggtgattatgcaccccagggggcactgacaatgcctggagacatttttggttgtgacatgtcaggggaaggggtgctatggcatccagtgggtgggggccagggtgctgctaagcatcctactgtgcgcgggacagccctgacaacaaagcatgggccagccctaggacggcacaaagaattccaaaaccctgttccaatggttgtattgctctctcccccttttctttattcttttctgcatagcctttatctagcagcatctgtgattatcttattcatttgggacttctttatagcttgtgccctgcagcccctacccctggtgggacagaagctccacttgggaacaggcctcctctctgggtcagccctgcaccactcgcgcccgtcaggggaggtcttgtctggaagccgccgggctctagggccttcacttacaagggactcacctggtcttcagattgcttgtccatcttactgagtatttgacatactatacagtggctatcgattttggtaaaaacttgtaaatgtaagacagttttatgtttttttctcagagaggcccccacccccacgcccaccgcagcccaggggtattttccaacaccagcaaatcctccaactccagaacctaactgattatcttaccattcaattcaagtctgcccctaccagaggcagcctcagactctaccggtttgagggctcggtctcaccagactgccccacttcagatgccagtcccaagtattgggtccccaggttacccgcacatctgtccaaattggctaaaaaggcaagagtgtcccacaacctcctcaggttcagtaattcactagaatgactcacagaactcaggagagtgcttgactcatcatcagtctattatagcatagaatgcagaaacagccagcagatgagacgcatggggcgaggtatggtggaggagggtgtgtggagcttccatgccctcttcctccactccaccctcccagcacctcgaaggatccaccaacctggaagctgcctgagccctgtggtttaagggttttgatggcggttccattacaaaggcctgattggttaaatcatcagccactggtgattgacttaatctgcagcccttattccctacccggagtttggggggtttgttgaaagctgctcactgaggcttggtctttctggtgaccagcctccatcctggagctatcctggcccgcaaagtgtcaccgcatcaggatacactcaggtatggctgaaaggggcttgtcatgaatgacgaaaggtgcttctctcaccccatcattcagaaaaattccaaggattttagcacctgtgtaccagtacccgaggatagagaccaaatactcatctcttatttccacatcacatccctcatcttgtattggcttttggtctccccctacctggacatgcgcaacactcagctgttcttcaaaaggtatttgttgaacaaatgaatgaatgaatgaaagaatgctaggagctgagaaaacactgtatctgagtgttttgctaaggctcttgcagcatctcgaattgcctcctcaggtctttctgtttaggaagcgggactcgcagaggccgggctggttggtgggggcagctgccccgcagacatgctctgtggacccggtccgggcaccccatcttccctcctctctgttgagactgtcggctgctcatgtttttactttgcttgaaatgagctgcccctgcccttgtttaggaatgttttgcccattcgtttgggtccagattatgtacattcctatcttggagcttcaaagtccgtgttttgtttgctttttaaagaatctaattcgattttctgcagcagaaagacaggagggtgcgaattccctccccgctgagctgctggttggagtctcatttttaaccccggcttggccctgtcttggacatgtgaaaaaatgttttcttggctttaatgatggagtttccaagtaggggatcttgcccttttgtttctttagtttggaagaattgtttgtagcaagcgatgggtcaggggtggttgagcaagtttgaagcagaggttgatccttgaggtttctgacatgtccctccagctgccctcagggataagagatgggggtagggcctgagatgtctggcctggcttcccagaactggccccttctgcatccccgccccagcgcctctgcaggactcaggtctcagcctctactgaccagcctttctcaaactggctccttgataccctagtgagattccttggccaattaggtacttccaactttgtgtattatattcctctcttgtggattcacagggcttattagcatatcaaaggccctgaaaagttcagctgtaaagaattctgtgtaattttgtccattccacattttctccaaataatttaagcacagaacactcaccaacggcaagcagaacattttgtgggaggaagacattttgggaaacacagcttggctgtttcttggccaccatattttgagaaaacatgaagttttcagtccaaggggcatgaacatttcttctgttgagttctgattgtttaatccttcagccagtacatggcgatcttgatgcgcggttagttaatgctgcctctatggagacagtgagggttgtttgaggggtggcgtgggtagagttggagatgagtctaccactcttgggtaattttcaattgctaaagaataatcatgtggtataggatctctcatctttgattccatttcaaatgtttttggcattcactgacaatgaaaaatcatcatcataatagttgatgatgctattattatcaatgctgtctaccttttatggtatgctaaatatgtggcaggcattattcaaactgtttacatgtagtagctaatttagcacctgttaaggtgtccttattatcctaattttactattgaggaaaccaaagctcagagaggttatgtggcttgctcagggtcacacagccaattagtggtgatctaccactgctagaaactgagtaggtctccttttatgcttatccatggctctttctacgacatctacaaagaagtgtcatttgggcaacaatatattttataaccacaggattctattaatgggtttttaagaatcatatcttgctcgagatgatgaaagtgaaaaattatgtcaggttctgaagctctgtgtcactcgagggaatcctatacattggatttaattgcttaataacttaaagtcaagtagttttttaatatgatacattctactgaaggagagactcatttcattgtttctaaattttcattaacttttgcttcctaatctgataataaaggttaactctaagaaagagactgctgatgccagtgagagggaaaaaacacattttctctgcctgctccctttctaaccatcctccttagtattcttgagatttttcattgactgaaaagcactgatatttcaatccatccctcaaatttgtagtcattgactgtgcatgactctgagaatgatcacaacatcctgggattcagagatcctgtacctgagaagtatcaaggcagagggattaggggagatgtagactatgcacaatgtgagacgtttgatgtggcgctggtggtgctgggattggggccatgtttggtggcagaaattgagccccaaagccagctgcaagaacctgaaacctcttcctttatgctcgcgattttctatgacttgcttagaaccaggctggcttggctggacttagaggtggaaaagagagtgagcatctgtctctccttggaggatgagctttgggttattgctattaccacacaatgtaataaagcttcttgtctttctgtgtaggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatgtgagtagctttgtgctaatcttgactgattggttgatttttagaaatgagtgcttttctttctatcaccatctttgggaacacagaaggaaaatgactaaaaaatgtcttagatgtagcaaggatcatttgacagccttatggatttgaatgcactgagagagtgctgtttgcttacgctatggagtgccaggaagggaatctgctgtcctgaacgctgggctaggcatgttcaagggccgctggctctcattattgcattccaggacttcttgcttgatatgtggtcgtggtagttaacagttgcttttgcagatcaccatcatttgggattttaaagttgcgttaaatttgattttctgcttctattctacattttaatctctaacggcaatttaaatatacaactagtaaaaagattctgcttaattaccgtgtgtgcgtgtgtgttgtgtaagtgtcagaaaggtaaattatggtagaatggattttaattaaacttttatctttattctctccaagttttttttttttttttttttttttttttttttgtggggcggcgggggagaggaaagcacagtcattgaccgtctaccaagttttgctttatttgttaatcattgtcaaatattagttcaaatttgaacacggtcgtcagtctcagggcaggttcccattgcggttagattgtgtctttgctcattttcccctcctctgtgtctctcctcctctgtttccttgcagatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggtgagtgctgggtcccagggctcctgtctggtctcgttccttcattcgttcattcctcccgcaacgttagcgctggggttggggggcgagggcggcagaaagagatggcacaattcccttgttaggaggctgttcccaggcaaagacccagcagggtctggaactcggttcccagccatgcagtgagcattgattgccagctgtgtgcaggacacggggacgagtcagaactggcagctcttcttgttccgaaagcccgggcacatgacccgagcagtcagcagtaagtgccagtggccagtaagggccagcaagaagggcgtgatccgggctcttggctcccagctctgtgctattccctgctctgtgccgctcccagctctgtgccgctcccaagctctgtgccgctcccaagctctgtgccgtttcctgctctgtgccggtcctctgctctgtgccgttcctctgctctgtgccgttccctgctctgtgccgctccctgctctgtgttgttcccctgctctgtgctgttccttggctctgtgctgctccctgctctgtgctgctccctgctctgtgctgttcctctgctctgtgctgctccctgctctgtgctgctccctgctctgtgctgttcccctgctctgtgctgttcccctgctctgtgctgttcccctgctctgtgctgttcctctgctctgtgctgttctcagctatgtgctgttccagctgcagtcactgcacctgggggagactgagttgcttcaggcctcagcttctctgacctgccccatctgccttatgggttccatatgataaccacatggagatcattctggaggccttgctctcagccctttgccgcaggcttaccatgaccactgcccatccctctctgctccagcttaaccccatgcaccctgcggtcctcagatcactgtttcctctctgtaaccttttccttgtgccaggagaggtttggtcactggagctgaggggtgatacgtgcctattgtcaaccagagtcctggcaggccacgagggtgttttccagtaatggactcaggttgactagaagggaatcttcaaagttttccctagaccaactcttaatgtgtttcctgacaaacgtttgctttcatccttttgatgttcgtcctacagtgagctaaagtgtaaatgtttcttttgtggtttagcagccgccactgtaggagccagggtttcacatccctatgcatttgctggacgtgtctgaacacactcccttgctgtagggtgctcccccgaggctcacagtgatttccccttaatgaaaaccagctttctaccggcaggaaaggaggaagaacagaggcgggcctctggaatctagtcttcaatgtcaccttgaacctcttgttactttggccacggatgttctctttccaatttccattgacttcaggagttgtggtgttgggaagtggatttttaaatgtttgcaagtgaaatttatttatttttcaggcagggggtgaatttaagctgtatgtggccgatgccagaatccatgtctgtctagagtatgatcagttccccttactgtttggacaaagggcagggtatttgattgaacagggggaggagagagaacatcaggcaggtgctggctgggccccatgaggaaggcatcatggagtttataggatactgcccttctctctcctgtgggcagccctcggtcctctctccctgtttgacacaacacatgcatcctgggtgtcatcgctgcccagccacttacgagtcccacctgtgcacaagttaaccagccccagactttgtccctccaagcagacatgtttctagctcttgagtaggtgttccagcctttaatctgccactgtctagcttagtggtggtatcttccagcccttgaagcatgcatggattgaagtgggtagccaggccgcatagacccccacccccatccccagcagccctttctgaagcttacctgggctgagcctcttgctgctgtcgccaggccctttaggcctttccatctctctttggttgctgtctgggaggccatcgctccagcagtagcaactttgtcctcagtatctcctgcttcttggttctcataggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggtaaggcgtctgtgtcactctggcagggctagcaccctccctggggtcctggctctggctccaggcctagcccagctctgcttcacctccagaacatttacatggtggcagcaaacttcttttgagcctccacttctccacctggctgtcactcttaccactacataaaatgttcacatcacttgaacattactataaagtggaaatgttgactttctaattctttggagacttaaggacagctgatggctttcttgagaagttgccatttctttgtttttaagaaattaagcagggatattgacttcttttcctgatgtactgatctgataagtttggatgggggaattataagtgcagttaactggttagtcatcgatttgctgcttggggcttttgtaatccctggccactgggaccatataagacggaggcagcttctcctgaaatagactcagctctgacacatcgcctataactaattgctgtttaaaaagcctagcccctgtcaacctcatgcctttgggcattcaaagtgaggttgattaataataatttgttttaaatattcacaagaatattttataagtaaacatacatatttactctttaaaatttattttttattgtataatttaaggtgtacagcatactgtgatgtttcgatggaaatagagacagtgaaatgattgctacagtaaagcaaattaacatagccatgtttttttcacagttacctttgtgtgtggggaggggggcgtgtgtgtggtaaaagcacctgaaatatactgtcttggaaaatttccagcatgcaatacaggattaataggattaataactacagtgcacatgctctaccttagatctctagacttgttatttgcctgacataattctttttattggattcagcttagaaggcgtttatccactgatgccttctaaaagagaaattgagtcacgttttgcttaaattgtttaccttagatagtgatctattttttaattttcctagatctgttatatttgcaatctccaaattaaataaatctattagcaactaagaggaattataatcagcccttcgaaagatgactttttaacttaagactctcctgtccaaggggacagacttatgtgcctaagtcctgacttaactcttttttttcttttaaactcaaagaaattaagtcactgggagtcacctccagtatgatttggctgttatctagttttttgcaaacttgggagtccaaactccccaaatctcaagtctgacttacatttcattgtgactcctataccatatgcctctgggaaaatcacatgttcttatgaaagagatgaaaatatgtattctccggccaggaaacagagactaagataatgaatgaaaaaggaaagcctcagtttggtctcctaattttgcttgctccaagattttaaaaagaatgaaaaataaaatcactgtgctgatatttacttaaagcagagtttggtgagttctatggtagtcttgtggtgtgacaagtatctagccctgcttgggccagcggccagctctgtgccttgcggccgttcatttttcctgttcctggactctgtctgcacctctgcaaagtgggattgttggaccaggtcagttctagactccttccagctctgaaatgtgactcagctctgccccagcgcttcctctttgttagattcggggcagaaacagcaggatctttcatcatcttgggcccctaggtcagagaggacctttcttctgctgtctttttgacagctagagtcacacaagaggttcaggattcaagtggcctgaacgtgatggctgaacttgaggccggagctttagacatgttgaaagtctcctgcctctactcccaggtacccatcgtggtactctttgtttcttgaattgccatcgtcccccttatgtcttaaggtccgagagaggaggggccgtgctttcctcccctgatctgtccctggtgccaagcacaatgctgagcacggattagacactaagttaatgcttcctggatggacgaaggatggatggtggctggatggaaggaagacagtcaggtggatggacaaacgcctccatggctctaaaaccagttcatttttgagatctgacagaatttgtgccaatttagctagagagttcacttgtcctttatattcttattcattgtgagtagaattttcaagggacttctgattgactcgttttttctgtatcctagggtattatctctttaaaaaaagaaagaacaaaaggccagaacagagctgttcacctggatgtgattacgcatccgacagaaatgataggggcctgcagggatatgatacacttgtcactgaccaaagagactcagtcatctggctcagtctctccccagataagtaactttcagatgtgtcctgtggtccttggcaaactgtcaggaaatcaagtgtagagctgattgatgaatttcctttttcctaaacacacacatatacacacacacatacacgcacacacactgtctctcctcaaaccctcaggaaatttggcttcatcctctgagagagtctgtgctgttggaatgcctgcctgtgtcttggcatcacctctgtgctgggacgtgtgtttgccatttacatccttcactcgtgaggaccatgatgaaatgtgaaactggctgggacccagttcccgttcacccaggctgcactgagtaggcgccagctgcgtgcagagcagtcgcctcgcaggagacagggcgtgtgagccctgtggcaaagcccctctctcttttagtcttagagtatgctctgtgatgaacagttacagcttcaaggaaggaaatcacactcaaattcctcataagggttagtgttcccaccctcctcctttctcctgacgctttggaaggaaatcatctagtaccagctccaggctcctggtctgctagaccagttctcggctcctcccggctctgaaatgtggctcagctctgccccagctctttctctttgttagatcctgggcagaaatgtcaaggcctttcatcatcttgggcccccagttcagagagaactccatctattattactagaaccatctactgtatagaacatatattggaatactatacaggaaaaccattttcaaaaccacctataatttcccacctagataactgctgtttatgttttggcgtgtttttctgacagactgcattctcagtgggcccttaaaatgccacagagctgtgcactgtgagcaaagttaaatactgtgaaactgggggcccaggtgctagggaaggtttcatttttgctccccttggaaagaggagctcaggggtgggggcactcagtgttgcatggatcgcctggacttccagacagaagtttttggggtggaggtggggtgtggctgtggcaggggggggcatccaaccttctctctttggagtcccagatgcccgcaaaggctgacagcttggcctctcccgctgcttaagaggaaggcatcggggccaggtgtggcctctggcacctagagccactccgtgggagcctgaatcacacccctgctcacttggagtgttttctgtttccaggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggtgagcagtttctgtgtgttgtatttggggtgagaagaggaacttttgaagaacagtgttcccctctcatgacaaataagattttgtctcctttagaaaaaattaaacaggtcgggtacagtggctcatgcctgtaatcccagcactttgggaggccggggtgggtggatcgcctgaggtcaggagttcaagaccagcctggccaacatggtgaaaccccatctctactaaaaatacaaaaattaccagatgtggtggcacactcctatagtcccagctactcgggaggctgaggcaggagaatcgcttgaatccaggaggcggaggctgcagtgggccaagatggtgcaactgcactccagcctgggtgtcagagtgagactccatctcaaaaaaaaaaataaaataaaataaaaacaaacaaaaataaacggaacttgcaacgttactgctgtttcttacgtaagtgttattcttgaggctgtccccactgagttgacacatgttgcagatggttttcttaaccattctgatcctggtctgtgtgacttcagccccagcaggcctgaccaggggcacaggacggttccttggtactgtcaaggcgagggaaacacccttagaatcaggggtgtaagcttctccacgtggtttaactcctagaattctgtgtctctccacgtggttgatgcctttatccttgtctgcgttgaatgtacagtttccagctttccttgagagaccaaaaggaagaacaatgctgagcagagcagctttgctttaagatcaagggtttcccagtgtgggtgaggccagggtagtgggatattgaacagccactatggggcggcctggctggcactgggcactgcttgcatcatttatgcctgtgtgaatgcagaatctcagggctgccaggacctgaaaattatttggtccagtgctccctccaatacttccacatcagagctaagggggcacctgtctaatccgaggccctctgagtcagggaattctccgcgcaagatggccagtgtagcttaggacagctgtgttcctattttgagaccaggtctgttttggggaaacatccactcattggtcctctttcttctccatagagtcagacagaccaagtctaatccttccaaaacaggagaggctggcgatatttaaagacagggaccacagccctttgtgtcttattttcctttgggccaactacatcttcttatggattgaattgtgccccccaaaaagataagctgaagttgtctcccccagtgtgtatgactgtgaccttatttggaaataggatctttctttgcagatgcactccggttaaaatgaggtcatactggatcagggtagaccctcacccaccctaagacacagggagcatgcctcttgacgaggctggagtgatgctgccaccagccaaggggtgccaaggagtgccggcagccaccagaagccaggagaggagtggaacagattctcccctggcatcccagaggaaccacctctgccccacacctgggtttcagactccagcttccaggacactgagggaagaaagtcctgtcattacgcaccacgagttcgtggtgatttgtcctggcagccccgggaaactgacccctgggaccccttcttcaggtggcataccttcctggccccacgtatttgccaattataacaataaggcgtgtttgttgtggaaattttggaacatatattggaaaactgttttcaaactattaatttctcacctagataactactatttatgttttggtgtattttcttccagacttttctatgcaaataagtgtgtgtgtgtgtgtgtgtgcacatgggtgtgacaggacagtcttatgtcctgcttctttcactttgcattgttgccccccagaaacatgctttaaagtctgctctggtcacacttctgagctgatgtccctcttgtggagtctgcatggctcccgctgctctgagtatgacctggtcagggagaggctggatctgccctccctcagccccagcgctctgagcctgagctcttggtggctgtcccggtgccatgccttctagcaggtgccaggtgtggtttcgctccctgctctctgcatctcccagcccaggacttcttccactctgttctgaggcaggcactgacttgccgtcccttgccatgtcccacctgctggttcccgtgttttggaggcagaaatcggccctgctgagtggtctccctccatccagcagggctgacgcacactagccgagctctcatggtgacataactgtcacctcgagctgacccctcgccgcccccggaggtgtttgcatagctgctctgcctccctccccgacacggcccccagctgaagggcgcaagtgctcggtgtgctcatcaaatgttttcctgtcgctgctgcttagttcctcattctgagaaaggtcagaccacgccttaacctcaggggccgagagtgcacacagcagccttgtgtactgtctgggcacagagaggtgggggcccatctgtcgggactgggtttggtgtgtgtcagccctgctctgggccctgggagactggagctcccagtggggacgtgggcatggctgtggttggttgcagttctgcagagtaggaggtgaggagagtggggctccagagtggggagatccagaaggaactgacctggagaagactgatgccagactgggttttgaaggatgaataagagtttgctgtgtaaacaaggcaggaaggtgggttaagatgaagccttccaggcagagaggaggacaggtgcaaaggaaaacaccacatgttctcctgtttagggtggagccaaggtccctgttaggggttggagccagggtccgtgttaggggatgaaaccatgggccctgttaggggatgaagccagggtccctgttaggggtggaaccagggtccctgttagggggcggagccagggtccctgttaggggatgaagccagggtacctatcaggggtagagccggggtccctgttagggggtggaaccagggtccctgttagggggtagagccagggtccctattaggggtggagccagggtctctgttagggggcggagccagggtccctgttagggagtggagccagggtccctgttaggggtggagccagggtccctgttagtgggtggagccggggtacctatcaggggtagagccagggtccctgttaggggtggagccagggtccctgttaggggatgaagccagggtccctgttagggggtagagccagggtccccgttaggggtggaaccagggtccccgttagggggcggagccggggtccccgttagggggcggagccggggtccctgttagggggcggagccggggtccctgttaggggtggagccggcgtccctgttagggggtggagccggggtacctatcaggggtagagccagggtccctgttagggggtagagccagggtccctattagggggtagagccagggtccctattagggggtagagccagggtccctgttaggggtggagccagggtccctgttaggggatgaagccagggtacctatcaggggtagagccagggtccctgttagggagtagagccagggtccctgttaggggtagaaccagggtccccgttagggggcggagccggggtccccgttaggggcggagccggcgtccctgttagggggtggagccggcgtccctgttagggggtggagccggggtccctgttagggggtggagccggggtccctgttagggggtggagccggggtccctgttagggggtagagccggggtccctgttaggggtggagccagggtacctatcaggggtgaagccagggtccctgttagggggtggagccagggtccctgttaggggatgaagccagggtccctgttaggggatgaagccagggtccctgttaggggtggagccagggtccctgagtatgtttctttcttcctggagttctggtcccacctctgaggataccaacaccacaaaggtgagtgctggaacagaagacagcagcaccgtgcaggtgcaagcggctcagcaaggagcaagacctgccaaactcttctctcttaccccagcctgagtctgccagctagaaggaggctcacagttcacagcatggtccccccaagtagtcaccgtgttttcttcttttaataacaaatactctatgtatcctaggaactgaatgtgaaagcttcttgcctccctggtcctcagcctaacagaaatagttggtcaattcaaacacatattcagcccctgccacaggctgggtgctgtgctgggcactgagcatacgtgccctggtgaacaacagtggcgacccagtgcctaccccctggtagctggtgctttatcagagaagtgggcggcggcttcgtcatggctcatgtcctggtgctgaggggaagggcaggatgccagggcagcagcgtgtgttaggacgctgacccaggccttgcattgcctgctgtactaattagtactgctgcggaaaaagtttgccaaaacttagcagcttcaaacagtttctgggggtcaggaacctgggtgcagctttactgggtcctctacttaaggtctctcatgaggctgtgacctagctgtcatcaggctgggggtcgtcaatatgcttgactgcagaaggacctgctcccaagcgcacatggttgtgggcagaattcagcacctcaagagctgttggaatgagggcttcacatctttgctggcttttggcgagaggctaccctccatacctcaccacagggcctctccggtatggctgcaggctttatccaagccagcaagctagagcgtctgctagcagattagaagtcacgattttttctaacctagtcatgagtgtgaaatcccatcgtcattgccatattctgttggttagaagtgagtcatgaggtctagccacactcagtgggaagacactacagggtgtgaataccaagaaccggggatcactgaggaccgtcctaggagtcagccacctcccgttctgcacctgatcctcaggaaactggggcctgggctttgcagccgggagagtagcttccagcttgatcccagctctagtggcagaggaagtgtgtttatgtgcatattttctgtgtaagttactgacatagcagctgtttcatttcttcttaaacatttataaaaataagtaacaataggaatttcttctttttcgaagcccatgacccatggcctgtctgaaatggttggcgcgtttcccatctcagccagaaaggatgataaatactgtgtgtttaggtcactcttgaagaaacaaacactctgagcccaagttccatcagtctaacgggatcctgggccattagccctgttctgtgaccttgcacttctggaagcaggagattttgggggttgctggctgcaagttggattggtccaagttgttcttttccttctataaattggcttggagaggggaaataccacttttatttttagttttaggttcacattcagcctaattgatccaaagtagagggtttgaaaatgttggaattttaagcaaagtcaaatcacttttaaatttccagagaaggagtcaagtggcaagtccattttttttttttttttctggaggagaacagaggaataatggaaacaagtggatgggatggttcatatggccaaagaagccagccaagaattcatgttccagtttcctctctgtaagagatcatgacaatttaaaactagcttgatgcattcctatgctaaattggcccagttaattaaaaagaagccaccaattgcaagcagaatttttctttatttaatcccattcgtaagtggtaaagactattcttttcaaatgcatctcacattagcctcctgcctcttcatttgtgagacagttgatagtgtttgtctcttaattcagaggcagttatagcccccgttaaatgtgaaaaatgcgtggaaggtgctggcacctccaacctagttgcattcctcctttattcaagggacatttggagtggggtcatgtaccatctgttaaggattttaccgtgtctatgtttggggtttgattctgtgtgtagtcttaatgcaatgcccagaaacaacccaccacaggaatggttcattttcccattctgtgatgatgagtccaaagggaaggagaactcagcttggcgaagaattcaaactcgattttgacccaaacccctggagtcttggaacctggctagttcttttcttcatctgcttatataaactgattttttaaacaacccgttggactggtcaaatgattcagttatgacgataaactaggaaaggaagcaggcttttaatgaaatggattctgttataggcagtcactcatggggacacagaggaatagcagggctgaacatttgggcaggaatcctggtttcatcagtttcactctgtctgcagagtgtgtgagggggcctcagggtggtgcacagctttcacccgctgagtgtctgggaggtgtaccggggtcatggtggcaggaacacaggcattggaaccccagccctgtcacttactgctctgtaaactgggacaagaaacttaacctctctgtgccttattttctcatcggtaaaatgggggaagatagtcctacctccagggtagtgagagttaaatgacttaatatttgtagtaacgtgtttaaacagtgcttgacaaatggaaaatatgtaactattattattattaggtatcagttattactaataataacaataaactgatcactcatttactcactccccagagttgcaaaccacataaccaagttttggtcaacagtggaccccatatatgatggtggccccgtaaagttataatcccgtgttttcattgtgccttttctatgcttcaatacataaattctaactcttatgttacaactgctcacaggattcctgcggtacaggctgacagcataggagcagtaggctgtacctcgccacctaggtgtgtagggggctgtgccatctgggtttctgtgaacactctatgacattcacataatgacatcacctactgatgcatttctcagaacatatatatccctgctgttaagtgacgcctggctgtatttattgaacacccttgatgtgctagatgcaagctgtacataggagaggaaaatccatcccgtttgctctcatggagcctctgtctagttgagggagtagggccaggcttcatgtaaatgactgagctggggcagcccctcagagctatctctgggtgaggcttctcccatccacccatcattggacaggaccacctgtggaggcttaaccttggttgctgctggtggtctcttcagctgaggctcgttcccaggagggactgggctgtgagttattagcaggatggctccccagttttgcaaagctctgtaaataggaaggacccggtatttgtggatgcctaagcctggatgcacctcattcacctacttccacatcagagggagcaggatgcccgccctagggcaaaagccagcacacacagaagggagctgagccggattcatgccttcgaaccgcagcggaactttgacttgagaatctctcttgctattcaggcagcaccggaagcccctctccaaacagctcaacttcccccagcccctagaagcactgattgaaagccctggatgtgttctcaatcagaagagagcctggcactgggaatgtcatgcgatgttttctctagaacagatttgcacaaggattaaaacgcaggctgttcctagcactgagggattcattattgatttaaaccatctcaaagggaaattaggagaacgcctctgtggagaagagacggaatgaggagaaagccgtggggatgtagaggttgcagcaatagccacggatcgatttctctttctcacctctccctccagctctcactctttcctttcctctaagattttggaagattaagaattacaagggtccttgtgaggactactgtagtgcggtgtctttattgaagctgcctattgattcctggtgggttcaggcattttgcttcccagaagctgcctgttgacacaccttgatatgggccctggaagcggcacgaggtcactttaataggactgagctgttgagccacctgaggtcaagggggttggcctcgatcacagagcggggagggagagctggcagcgcccaggccagaaggacagctcgggtctttgtgaaggggttctctgaagactgttcaggagggactgcctggtgaggcgccacatcttgttattggtgggagaaaaaccaccaagctgaaaactcccaagtgctgaacactgtttatgttttggggaaatgtttgtgaagtccttggcagtcctgtgtattcccacatgattgtttggaaaggacggttccgagcaggaggaacactatagggaaaaagagctccgttgtgtctgtatctgcagagatcctaaggtgagatgtgtgcccgctgggctgggatcagggagggcacttagaaacgaccctggggcagccacagttcagggacctgtctcacccggagttctgggctgcttagtgaggttgacgctgttgaaggagggggtggcagcacatgtcacatactggccccgccccggtgtgcagtggccattgccctgcagtgaggggcccacaccctgcgcctggctttataaccaggggtagcccgccaatcctcagtgcaccccagttttcttgcttgtagaaacatctgccatgagagtcactggtgaatcacgagaaggtgctttgtaaaccacgccaggctcggagatgtcagggatgcttggtgtcgcctctgagaagtgctgcctcccagtctgtgaacagttaccggggccctgtgattggatgctctggaaggaacaaagaggggctgggaaccccactcgtgcacaaggaacctagggcctggtaggaaatagaatggccccaacaaacagggcacctgccattcatttgggcgtttttaggaccaaacatggatgtttgtaactggcagaaaatgagcctcaccagtgtcacccctgtgttcagtctaaggtgaccttggacattccctccagatcagctggcctggccagtcctgtctcatccagcctcctgatgagacagtcacagtttgtgattcagtggaacaaaagggctccgtctcagctacattaaatggcctttttttcctggtaggaaaaaaatatataatcattattgatggcaccatatcacaggctgggaattattgatcagtgatttaaattcggatgccagcaaatggagaataacaaggccaggtgccctggctccctctcattacaaccctcacgtggccacagcactgcaagatgttgttgagggtgaattggaggacatgagtgtgtccccatctcgggtcctcctgcctgaggaaatggggccgttccggtaactgtcattgaggagccagctggggggttggggggtgtttgaggagcacggggaggtggggccagcgtcaccggggtgagccagcccagggatggtcacctgctcccagccgcctgcaacttcagcaccagcttgggatcttttctcaaaggtggccctctgagaagtcccatacgtggagcagtaactggaggacatgtcagagctcaaggccaccaagcgcctgcccttgtctgagctgaagctgagattgaagcttgtgcgtttgggtgccttttgagctgggtgatctcagtgacttctgacatgagtccctgtgggaactgctgtgttagaaccagcagtcgctcatcagggtgatgaaaacatcttgggactggggagtggtggtgttcacacagctgtgtggtgtatactaaaaactggcgaattgttcacattaaatgggtggatgctacggtacgtggatcatttctcaatataaaaacgatatgaacaaaaatacaaaaggaggaggaacccactatggggagaggttttcccaaactagtggccttggagccaggtcctgcagagttctccacatagaggccaggccgatgaacaaccacatcatcacttaggaacaggaaccatcaaactctaatgagctattgcgatcaccaaggaatattagcttttccaagagatacaagatcccgcagtgtgttccggcttcatgatagatgcctgaattcccttttgctgttgctgtcacttttctagatgccggatgtgatgttccgtaaacacatttgctgttcccgaccgtggcattggagttcctcacgtttatcctaagtgtttatttgccactctattacatttgtaattgtttatcagtctcctgtgacttattaagtagttctggagaagaattgactttctcttccaaatcaccgtgcacctaaaataataaaaacacctaaacaaacaaaacccgaaaactatcagtgcagacggccagcacccactctagtcagccgtggattcgtctccttgcctaagctcggagggcaggggccacatccagctgggtgaggcgctttggggtcaggcaggcctgggtttgtttgggtcccagccctgccctggagcttcctgggctgcgtgaccatgggcaaactccttaacctctctagtgtcagccttctcccccagtaaaatggggtggcccacatctcattatggggttgtgaagatagacgcagagcatgcatgcagcaccctgtacagggcatggtggtggtggccctccctaccccccagcatccacatcaggagtggaaactgagaacattgcaggtactaaacccggaaagcaatcacacagagccctggcgggaggagcagcagcagctcctgctttaatagtgatcaactcaccaacctctgctcgctggctcagaacagcacgctgtaagtgtccctgaatgaatccagcagtggtcttggctgtaagtgtccctgaatgaatccagcagtggtcttggctgtaatcatccagattttacatagtagggccttgccactgctggcctctcctttgtcccttggggagagacatggtcactttcagaggcactggattgatggagccctatgccccctaacatacatttcccatcccaccgctcctccaggggtcccaggacccctgcactgcacaggaaaggggctgagcagtaccccatgagcacgggcccagtgtgaggggccgcgccgacagccttctaaaataaccgcagcacagaaggcctggaatgcatttggacttatatttggaattgtcgttggaaacagtcctggccaaatgtaatacccatctgttcgggatggtttgagagtaagaaaatgaggtggctcagctggagggggctgggcagccctgaaactcagggctgggagggtatgatgtcccctggcccccacgctatcctggagccctccttccctccagcctaggctgctcctgccttctaggaccatcccctcgtgttagcctgccctgactggaggtatttccccttgcctgcaaccaggctttcttcccgaaccttctgcccgctggtcagtccttcaggagttcgggactgggctccttcctgctgagtttttgcatctccagggagagcagccaggtttggtgcccagcactgaaagcaagcatccgctgaggccgtgagctgcctgtcgcctggctccaccctcccacattcctcatgccgtgcccctgttaatgcatcctggggttgcatccgtgcccctgcagttctgtgatgattgatcgtgagctgtgtgttttccattacattggtctccttcccccacttcctcatgggatagtggattttgaagactaaaaggtagacatttcagtttgtttctgtacgtttcatcttgttccacagtgtgcctgtctggccttttgacgtccagtggatacttgttcttgatatgtttgctgttctcagcattttctgagtggctttaacctatccgagtggctttcccccacccaagattattaactcactcttttcccctggagagtagtcaagggggaaatgatagctttgttacttgaagacaatcttaggaagcattcgcttaattcttggggagaacccaaagagtgctcccccgtctcagtgctcccctgtctgagtgctcccctgaagggaagtgctcctgtccgcatttgccttccttcatgcttccttctgggaaatgtggccacatgaccccagtcctcccctaccctcagggccactgttccagggtctcagggtggcagagaagtattggcaaaaataactccttggagtaattggtcttccttagaattggggtttaaaatctgtctggtttcctagggcagtcataataaatcaccacaaacttggcttcttaaaacaacagaaatgtagtctcttatgattctggaggccagaagtcctaaatcaagatgtctgcagggttggttccctctggtggccctaagggataaaagccgtcccctgctcccagctcttggtggcctccagcagtccttggcgttccttggctcatagacgccgcactccaggctctgtctccgtctttctgtggtgctgtctgtcctctcctctttttataaggacacctgccattggatttgggaccaccgtaaatccaggaggatctcgtcttaagatcctacacttaatgacatctgcaaagaccctatttccaagaaaggtcacattcacaggggctgggcttcagacttggacataattctttggtgtccactatccatccaactacggaatccagatggtggccatggcttgtggtgaatctagtccctgttcagatgtctgtgacacagcaggatgccagggacccagcatagtttctcgcagtggggttcgaggggctcccaaagcccactgccagttctctgagcagatccaaagtacccagaggtgactgagaggccaaaggagtctcttttcatccagccgaggaaggagcgtggcctggctctcaaaggctgtacatgtgactcacaggaagtgaggtagtgagttcactttaacccacctcaaacagatgaaaatcagccgtttcacctgctaggggtgggcttgcctggttggaacagtaggtatgtcccagtttttcctagggattacttcttgatctctgaagaattgtatggaatcagcagattcctcatgaagtgactttgtatttaaaatcaagacaagcttaggtgcttttgttttatttatgagccaaatatctgcaagaaatgttattaccacaaagaaaattctcagtatggaaaccttcagccagtgtttgggtttgtgtgaggtaatttatgtgatggaattccagttccaccaaacaatttgggtagttctgtgggcatctttggtaaaaactgggcttcgaatacttatttaacgtgggattttatgacagtttcagaagcatctgttacttttcattgacgtagtttcttgggctgagccatattattgacaggactcataggaaatgtgtgagccaggaagggtacccctcagaccaattgccacctggcacccctcagtgcacacagccaaaccttgcttgaaggttcacgcgtgtctgattttggcacttattgaccagccatttaggtcatagtaaccatgagcgaccctatggcgacagatgccgtgtttcagttttgatgtgtcttctaattctgaagaaggaaaatagcacaggtgatgttggggacaccagtaataagctgatgtggtgttgtcttggggaatattctcaggcgagtgtggatctggggaaatctactcagtggccaccgagcccctttgctgactgtctctttggacagtttggctggccaggctgtggtagatggaacactcctgttccggtgggtgttttgattctaggaactctgtgggtagatctcaaactgctcaagacttccaagaggtgtcctctgtggacattggccgtggatgaattctagagggctgtgtcagaggcacccgatgtgccaaggtgggctacggaggtggatagcttctgggcctgtccctaagaaatgctgctcctcatatcatgacctcaattagaggggagggcagtggagaaggcgcatttgcaacagaccctgctataagggagcacagtttttgcagggtagtatgtggctgaaggtctgggagcgtttggaagtatggatggcggctgggcgtggtggctcacgcccgtaatcccagcactttgggaggctgaggtgggtggatcacctgaggtctggagttcgagaccagcctggccaacacagtgaaaccctgtccctactaaaaatacaaaaaatcagctgggtgtgatggcaggcgcctataattccagctactcaggaggctgaagcaggagaattgcttgaacccgggaggcggaggttgcagtgagccgagattgcgccattccactccaacctgggcaacaaaagcgaaactccgcttcaaaaaaaaaaaaaacgaagacggaaatatggatgtcagatacctggatgcatgggtgcagaatgagagtcacagaattgccttccctggaaagaggggaagccaggttggagaagttgaaggaatagaaagtatagagctttgaggagagagaagtgtgaccctgtggagccacgtaggccatgtttttcataagcccagtttcacccttggcccagagatgcaggtgtgtgtgcaagaagagagtgggacatatggcaggaaggttgaaaacagacaaaaagggctgcaaggagagatagaggagaaaaaagagtaggaaactcacaccctgaatgttctgttgaagataaaaacacctcttttttttttttttgagagaggttctcactcccattgcccaggctggagtgcaatggcatgatcacggctcactgcagcctcaacttcctgggctcaggtcattctcccacctcagtctccagaatagctggactacaggcacgcaccaccacgcctggctaattttttgtatttttagtagagacaaggtttcactatgttgcctgggctggacttgaactcctaggttcaagtgatcctcccacctcggcctcctaaagtgctgggattacaggcatgagccactgtgcctggccctgacatttattaaaatggcaatgcaggccttcttcaggaccattgtggtaggtatagggactgccatgacagtttttcagtagaggagagagactccgaatacaactaggaaaagtagggattttaaagccgaggcaggtggatcagttgaggcaggagttcaggaccagcctggccaacatggtgaaaccccatctctacgaaaaatacaaaaaaattagccaggtttggtgggcaggcgcctgtagtcccaactactcgggaggctgaagcaggagaatcgcttgaacccaggaggcggacgttgcagtgagctgagatcacgccactgtactccagcctgggggacagagtgaaactctgtctcaaaaaaaaaaaaaaaaaaaaaaagaaatgccaaggagcagggcgagggggttggtggctagaaaattactaaggggaaacatcaagggggaaggggtggggattctggctaaaccaacccgatgggattcttgctggagacaggccaggtggccaggcatctcctgggggtggtggactaggaacctgatcagataagaagggtggtcagttaaccaagggtgggggattctggctaaaccagcatagcagtgtcaacaaacaatattttgacaaatttagtttagagatctcactggtgtttattagcacggtccatgaacagggcagcatcccattcctgtaatacgaaggtgctcctgtgggcccagccaggttctggctttataggcagaaacgggctgaagaagcaaaaacaggcaacggagagtggattgttcatttcagagtgactttccttctagggttaaagcaaaggggacgtctgactggttgctgtgtatcccctggttttttggaaactggcccattccgagttcagttcaattacgtggcacctagcacagatgactctgttctggcctgtgggggcctattgcagaagctcagtccagaacagtagcctctcatacattttatttaacagcaggattcttgctaaaatagggtggtgcagagatggacctggaggtaaaaaagttaaggtctagttgggaggaggatacagaggagcctgaagtgggtcaaggaagacgatcagttcccgtgcggcagcattctgccatacgtgtgtgtggtgtctaggaacagatctgtgtccacgggtaaacgtgtaagtctgcaggtattcctgtgcatatgtgggggtgcttttacatcgtgttaaaaacaaggtccctaccaacctagaaagatacatctcatcatttttttttcaatgtcaggaatgcgtatgcaaagtagtgggaatttcatgcggaattgtaatattgtgagagcaacagatgctcttatttttgttcccttcagtagaggagagaggaatgagaaggtgcataaaattttcatggcttctctttgctagtgtaccatttttgtaatctggtattgtttgaagctccctgttactgtgaaaacagaggctgcctgagatgatagaacaagcaacaccataaaagcggctggtggtttgtgtggggccagtatagacatgtctgggtctggaagagcttaggtggccacgagaagggcgggagctcggagggatgagggaggtggctcatctgcaagggaaagaagaagggtggttgtgcttcaatcaggaaaactagataatgtaattgtacactgattttcattgtcgcccaaatggtgtgattgcatgttcatgggtggtaaaaatatgcatttattttattcacaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgtgtaccccccccccccgtaccccccgagctggcccctggcagaaggagctggtttgttgttattatgcaagcggcattgtgggtttgcgtttcagcataggaacagagagaagcgttttaatgtgcaaatgctgttccccattattcatggatgtaaaagctgaaaactgatgggctcttggtctggctcctgccttcctccctgctggtcacctgccacctccccctcctccctcagcaggaggatgagggtgcctttaggaagattaccatttagcaagacacccagcaattagaatcggcagacatgaggacacccaactctcaaattgtcttaagagcattctcttgagcggtggattgttttgttggtttaaaaaactacccatcaatgattttcaatgcttctttgacagagtctcaattgaaaaacattttctgttgattcctcaatcgtatctcttgttcttccttcagaactatgtctgtaaatttctagcctttttgaatgcaaaaagctgttattggtgaattcagcaccttttagccccgggatagttttccatgctgggctccctgggctggctgtgtacttcaacagcagggcttatgcagcgagcattgccgctgcgtgttccagagtggctttacaagccttgctctgctcagcgtctcgcatagcaaggcaccaacaggcctgctgtggagtcttggaagcccccaggtggtgggacttcaggccaagaggctctgccccctctttcttactacagaggccgtgggatctgggaggcagcatgcaggggcagcaggtgggattccaggctgccctgttggactttgtagtttggcaaggaagatgccacagggacacaggtaaccccagagcctgctctggtgccaggtaggaggagtacactttggaaccagccattggtgtgggtcaggtttccagcttggccatttgctggctctgtgactctaggcagttgtctcagcctttctgagactcagttgctttgtcatacaatggggtaataatgctgctgtaccaggctgttgtgatgggtctgtcttgcattcctgcgttcattcttgccactatgtcccctgcatgacgctgggtcctggggccacagcaatgccaggacaggtgtggtccttgccttcctgtgcagctggcggggagagaagatggaggctgggcagggagctctggccaccagagaaccacctgagaacggggcttcaggcaggttcttaggagagggaatgtctgtgctgaggcctgaaggagagttggccagggaactgagagcagcgtgtgcagaggcccagtggtcagcaccacctaccatacagaacgcagccagccgcctggtgtgggagatggggggcactgaggcagggggcttgggtgcgtggcacatggggccgcaccacctggtctagcctcagaagaagtctagacatcaccctgagagagatgggacccctcagagggttttaagcagaagatagtgtaggagtggaaaaggaatatctcactactgtgttcatggctgaggcacctataataaaagactaacgcgagaaagcacacatacttgtttaacgtaaatttcatgtaacccgggagggagccttcataaggaaacggagacccggagaaacgggaaacctgtgcgtgtttgtgcttgggtttgatgaagagagcagtcggggagagggccatgattgtcaaagggggaatgactcaatggctctgtggccaccgtcacaggggacacagggtctcggagaaactctatttgtgtgtggcttgaccagcacagcttgtcgacccggcttcgtgacccagaaccactctcagctgtgactcttggccctggacccctacggagtgagtctgagagagcaggcagggcagcccacccggtcctcaaggcagctccctgagggcggtctcagggctggggctggcaggaggaaaggggcgctggcatgacgcctcaaggtggggttgtggtttcttccagcactgatcatgatgctgagcagagaggggtgcccagtgtgctgacagacacgaatcaagttgcagctgtgactcaggccaggcccatttcgtgccacatctacactttcctggtgcaggtggctcttccatcctgcaggcctcgcatggaggaccttcagtcctggcataaacagtaatagcagcagctcagagccagggctattatgggtcaaatgccgaggttggcacacaaatcggggaacgtgctcgcggactgggtttccccatcatcctaccatgcctgattcaatccacccacgagtccttttccctctttttcccagtatttctagagagctccactgttctaccctctgctattgccctgattcagccactggccctttcattgtaacctccacctgcacagcttccctctctctgggagacagcccctccccagaccccttctcaccttgatccgttgcaccaggcatctttctaagatgctgaactgccatcactattgatggggttcaaggcacactgcccccaaatataacagcttggcatttgagaaaacagcagaagcagaaaggccattcttgcctccctgtcccctcctcctctgaagctggccataaaatgctcagagcagaggtgccctccctgtacatcctaatctctgaagatccgggggcacagaggcgaatctgaacagacaggcctggctgtgtctcccccagtgcatgaccatgagataatttccctttacagggattcgtggctccgagctcacttctttggctggcactcatgctctcacttaatcagccaatatttataaatgcaaagcaaagagaggaaattccccagcattattaaatgatataattggaatcctaaacaactgtaattacaaacaaaatgtgtgacatcgtcaggagactgtctccaggtgaatttaaagcatggctgggggatttgcctactttagtgtgggaagcaagggtgcacctttgtcccctgagggtcagggggtgcaggacccctccaggaatgaatcttgagggaaaagtccaaggaaaatccaagaggaaccaaataggagtgttgtcccatctttgataggggcctcctttcagggaaggaagagcttggtgcacggccttcaaggcttgtctgaggccagcaccctgactgagggagggatgaggaggaggaaggcattggtggttcccggccccagccggccaggtgacccagtttgcctggctcccttctctgcccaagtgcctcctggtagacaagagccaccaggtggagcctgccgaggaggctgtgtgtgctggtcagagtacggatgggaagtgatggattcagccagtgtagactcagcaccaacctggcactacaccttaacacaggccctcccatgcctggggcttactactgggaaaactgaggctcagggaggcagccttcctctggagtcacagccagtaagcagaggatctaggacccaaatctaggccttttaacccagcttcccctagatgtgtgtttggcttcaacatttccccaaccatctgatcttcagtggttgctactctgcacccacagcgtggcaggccctggtccaagagagaaggtgcaggacggtgctgtgaccagttgtgtgcttggaatgaggcctgtgtctccacctgggcgtttctaccacattgtgccttttgaaactttctcctcttggtgatcctgcgtgactctcaaaacaaacccgataggtgggtgggaagacaggagtcagtcattgtcactgtcagcagatgaggacagtgaggggcaaggtatccggctaatgtggtcgtagaaggtgccagagccctcccctgcaggccctgggaccactgagttctctctgcaggaggctgcctgaaaaggactgggaaaagtggggcaggtgtgggctttgcactggggactcctaggaggaagcggcttaagctgggctgggtttagatggacagggagaggcagggcaggggggaactcctgacccaaggcacagtttattttaatagctttaaatagtgtttcttgctgcagaagagctaatatctaatatgcacgtacagtctgcttgctaccgggcactttgtaccatgcagagtgtgccgactcccatccagcgccctgggggcaagcccttggatagtttctcccacacagaagggagggtgtgcccctgccctcctgctgcgggtcagcactccgactgtgaactggagagcacagctgaaactgagccataagttcatgggcaccatcgtgatcctccctgtgttgtgtatgcttgagtcttcgtgataaaaggtttctaaaactccatctgtgagaggtgaaagggatctaacctttgttcattactgccagcccctgtcccaagccctttcaatgcatcgtctcattagagatcccctgaaatccatccctgttttacaggtgggaagactgaggctcacagaggttagttctcccatccatagctggtatcaggcaggctcaaggttcaatcctgggtctgctggcgtttgacactcagggagtttttgccttccctagctggctcctaaaagcaaagggttttgctggcaggaggcctgggcttttatgctcaattttgcgttttgctgaggatgacaagacagtagcttagcaggtgcctctgctcagaggagatccccaggggcaggctcagtggacaggaggggtgcagcagtaacagattgtcccttaatcttcagtccctggagaactcacacaccagagaaagagccaggcaatcagaaaccctccttatagaggtgaattttcatttctgggaggagaagccggtttccctccagatgtgaatcccagccctgccacagccctgggagggcagctttgtaaggcaccctgggccccggcacaccctgctggagtcattcaccgccttcctgtggcacccggatgcaggggcagcacagacccctctgcctctggccagcccccgccactgttccgcagcacaccctaccctgaggggtgctcagaggggccagtgagcctgcctcagagcagggtcccgagaagcctggtgcctggatgagcagcagccacagcccctgggaacttgtcagaaatgcaaacgctctgccagtcccagacctcctgaatcagaaactctgggtacggggccatggtgtgtttctcaggccctccaggtgggtgtttgtggggtccggttggagagccaccagggctcgtcaccactccctccttcgtgccctctggggtcggggagacttgctccagggcttgctttactctgactgtcttctctctccacccactccttttctccattgcatgcatcacaaggtgatcgcggaagtctgtttctttaccagttgagctctgtctccatgagattgcagcctccctgaggccagggccacttctgttagcagcaaatcaccattgcctagcagggtgcctggcacatggtggcacgagctcagcttatttgccaaatgaatgaatggggactagtggggaggctggctggggactcccaactgaaatccctagtaggggacggagaggctcggcctggtacctgtctggggagaagtggggactgggactgtgctcagctcagccttggctctcggtggggattgcttttccctggggccctgcatgggggacaagctccacaagcacaggtgacctggcttcaggtcctggctccaagggtattggccactgaccctgagtagccccccccgccctgccctgcacctccatgtttctattggtgaatcagctggcacggttaacttcaaaggcttcttgcagctctgatgttttctaattttaagcacattggacacttgccctaaatacgctttttatttttgttctattttgattctctgtcctataccgggaaaaggtgaggggaaaaaaaatctgctgggggctgtctttgtcctgtcttcatggtgcatatggttgcagtagtgatactgcctgcaccagaaactgtcacttcaggtgaccacactccccctgcttggcaagggggctgggggttggggtgggaattgaggggcgtttggagcagatagatcagagggaaggcacaaagcgggaggggagctagccccgggagaagcagccgagcgccaggaggcctttgccgcctgcagcccctgcggtttcctcttttcctccgcttcctggctcagccctgcctgctgaggaggaccatgctgcggtgcaggcctgtgtccacctgagacagcacagggggctctcatgaggatggacacaaacaaggtttcagagaactatctgtcaggtgcaggtgcccagccaggtgctcggacagactacagctgctctaaaacaccccagcctgccacaaacacctggctgctttccttctggaaagttctcctgttgaaaggcacgtcctctggaaaagaaaaacctcatcagactggtctcccctacgagggacggcctacaagcctgccagggagacaactgaaaagccccgggaggcgggtgacttaacagcgagttggtctcgtcatgattcgtctgcgttggaggtgacaacacatgtttatttctgagaccggcacgttctcattttctctttagtttcggcccagcttgaggtcttttttctgagctggcatgtgaggtagcaacagtgtgggttggaaacagctaatgaattttgaaggcaacttatccactctaattgcttttcttcctctccatcctcctccatggttagaaaaataatgaaatgggaaaagaatagttagcatctgtacatattttgcccaatctttcattgtcttattattagcactgtattcagcagttgcacccgagaaccatgttgagggccagagtgcaggctttgcaaggagggaatggtggagaagccacagtccctgccctcaaggtcaaggtccaggtcaagttgggcaggaaaggaaatgtgacatgagagtgtctgcctaaaaaatgggaactccagggaggagcctggggagccaggaagtgctgcatgtatgagaggatgagctggaagtttaagccaggcccaggactttctacacatagaaagccatggaggctttaagcagggctggctgtggccagatcactgctttggaaagcccatgctggtggcagggtgcatatgagagtgcagagaccaggggaaggaggactagccaggaggctgtatcagcttcaggcaggtgtagatggggcataaacaaagggagtggtgtgaactggggagaggtgggagatgagaagttctgggcagacacagataggcagagcagggtccctgggcacttggagaagaggcaaggggagaagccctggagaagggggcctcacagcaaaaggggatgaggctgtttttttctggaagctttgctaagagtttagggtgaactgtggagttagaggaaactgttcctaagactgctctcacttctgacaccagttgcaagttcaggagagatattctccaacccaccttcaggtttagtaattttccagaaggattctcagaacacactggaggctattacactattggttatgatttattacagggaaaggatgaagattaaaatcagccaagggagaggaagtgcagggggcagactccaggaggggcccaaatgcggagctctgagtcctcctctccctgtggagtcatggacggtgttagtgccactggccatggtatgtggcaatcctcgtggagtattgccaggccaagccttgggggtccaggccttttactagggttccgtcacatgcagatgctgtggctgacctttagtctccagtcctaccagagtcagaactgataccatgtggcccaaggccccatcatcaatctcagtgttagcctgcctatgaccaaagccctcaggccaaccaagacacttctgtcaggcaggacatccaggggcccagacatcacccccaggagccgagggaaaggcccgagttctctctgagtagagttaaatcttcaccacacggcttgcagtaaggcacgagagaaggaacagaagggtgaagacccgggaaatgggtactggaaagtagaaaggacttaaatagaaacatcctcctgtgtacttggttcagtaatgattagatgctgaattacacacaccctcacagtcaaggatgttcctctggcatcaggcatttggctcttcactcatgtaggttgtctttggggtgtctgtggttgatttttcacatcccgttgtgtgctgggcatagaggtcacactgggaacagagaaacagccaggatattgtgcgaggaacatgtacaccattggtggccacaaccttgacctcttccctgcacttcagtccttacctgtgaaatggaggcatggcgctacccacagggtgttgtgaggatgaaatgcaacccctaatataggaattctttgcacatgtagcacaaaaccccccataaagaagcaagaacaccttgtgttaaaatccagcttctgaaagtaactttgctaggataactcttttgtggtacagtgaaatgccataccactttggaaaagtgccctatggtgttggggcaactgctcctgaaataatgcccttcttctgtggtcctaggtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctaggtatgagtgtggtgcttagactgacgggccaaagcatgagctccgtggacttgttctgggagtcctctggggcaaatgcagacctggtcagctgggtgggaatgggctgagctgggaggcctggggatgtccttcaggaggcctgttaagtaccatttattgagcactagctgtacataggtcattgtgcacagtatggtgagggattctctggagagaaggagatggtttcccttctgggagcttatggtctagtgaagggagaggaggaagccatagctcacctaactgaatgacaggtaggatgccgtggggaaggtcagcactgtcatgtaaggtatgtgctgatggtttgggatcccagctactgcacggatgaggaaggcttcatggaaggaaagggcctgagagctgagctttgtaggaccaacaggatgtcaccggggggctggagcagaggacttggggcttagaggagggaacagacagatcattgcatcatctccggtattcttggaaattccaggagtcagagccgtgtggctgagttttggctgctgatcatggatgctgggcccctggggcatgagcgcctgccctcagcctgtggataccagcccccccaggggcctgagagtcactttgtggtgacaggccacactgctgactatggtgatggctggcagaggcatgtgctggcggagcgagtgctgcccatgtggacggggcaccgagggatggcttgaaaggctgagcaggctcgaacaagccgccctccttcccagaacgcctcctgcagccctgactaatggtcttgcccgggaacttggttaattgagtatttctgaaaatatatctgcctgccactgggacttgggcctctttgatcatttgattttgtttctcctttttttggagtttgatgagttctttcccttccaaggcttagaatcatctttctttgatttgaccacatgttgactctgtcccattaatgagcttgtcttttgtccccaagatggatagtaaggccaattctgtgtttcatatggccctaggatgctgggacatgctttttctgtctatgggctaaggactttggccagatcccaagagcccccggtaaagaggcttgagcagtgatgggttacaccaagaagctgtggcccagagggcggggcgttggggtcgcagcccttgctgttctgtttcagggcctctcactccagagggcggggcgtgtgcgtgactgacagcccctcccggccttttccagggcctctcctcactccagagggcggggcgtggcggtgactgacaacctctgccagcctgttccagggcctcgcctcactccagagggcggggcgtgggggtgactgacagcccttgccggcaggcctcttctccctgatctccttgctgcagatggaggttcagccagtgggggctctgggcacaagtggcctcctcccagccctcctccctatggccacttcacagcaagacgcacagggtgaaactgtgcaggcccagggaccttggcatgagcagcctgaagtagaaacgatgatggcggaattccagagggctgctgagcaggaaaaccgaaacccgtgggctgtgctcggcaggccgcacgttcctccaaggacgggctgacacccatggagagcagcccaccaagggcaattggaagggaatccttgaggtcagccttagacgctgtatcatcattaaatgccagctgggctcccccgagggtgggcatcctgcacccgccgcagaatttcttcgcaatttcctgatggtgtttccaccttcctccctcagtgcttccaaaatggatccagccaaagaattttaatccctaaatatgttctcttaaaggaaactcctgtctgaatacgaagcatagctgggatttttgcaaagtcccttttacttcctgccatgcctcctgccttacgggactcgtcttcttttattctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagcc

SEQ ID NO: 36329 - DNA, 12277 bp, Homo sapiens
cgcgctcgcggggggcggtggcgcccggcacagaggggttaagggggcggtgcagacgtctccccgcccatcccgcccctcgagagccgcggcgccccgccctatttatagcagcggtgcctagcgcgccgcgtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgagtgggccaggggctgggcaggctctctggggttgaacctcgccggtacgggagcccagctattcgcgggggaagcgcacagagcctggaatcctaggggcgcacctgagtccaagctggggctctggtgactacatgtctctgggcgatacttttaaccttgaagaagggccccttgtgtgagccgggacaagtagctgcttgtgggtctctgtgccccgtgcggccggggctgccaggctgagccaactccgtgcccaggaggtgcctccccacttggttggaagatactggggcattcaccccgcacaatgggtgctttctttttctccttaaggaatccagggacgggcaggaggccgacgcccggtgaggcatctgttccccacaagccggggaatttctccctccctgctgagccacaccgggccccctgactcactctttgtcacccggtgacaaggttcccttgggcttgcacctaggctctgtgctctggtcacatggtgtttaggctgaactccccggagcctgtaaacatggtcacatgttaagaggttttcttccagttacttggcccaaaccccaaaacactgccgagtcatggtaggcgggtcccagtccgcctgagtttgggcttctacggtttttattaaagataaatcccagttcaaacacgaggctacctcctttgtcggggtgaggaagggcggtctctgtgactgctatataaggaaagaacccaccaggcaggcgtgtgaggcggttatcaggcaaggaggtggggactgggatgtcacagctgctgtgcccagccttgcatgttcgcgagagagcccactctgggacgtgctccgagttccagtggggctctgaggtgtcaggtgggacagttgctggattctgttgccacagcttccttagcctgctgctctgagtccagcctctgctgggttctgccagaatctgtgcctctttccaatccaaggttgtccccaagttgattggggaccgtgtccctcccctcttctgaaagtctgaccagtggctttgagcagataatttcttcccagaactggccacactggccccagctttctgcacacccttccataaatgtcccagcagagcagttaatcccttgggtttaggcaggtggctggttcattcctttcagctgcctttcacacagctccatggaagggaggaggccggcagagctcacttcctaagaacaagaacttgcttttctccctttagagctcagggctgtgaaacagaatgtcttgtccgctctgtcctgtggcgccagcctgggaggccaaggggtacagcccccaggatgcttggggtcccttcatgtcctggggtttctaatagacctggtgtaatttacgattacagccagtaccactttttattcttagctttttattgaaattgaaaatacgggccgggtgcagtggctctttgtaatcccagcactttgggatatcaaggtgggtggatcacttcagctcaggagttcgagaccagcctggacaacatggcgaaaccccgtctgtacaaaaaatacaaaaattagctgggtgtggcggcatgtgcctgttgtcccagccactcaggaggctgaggtgggaggattgcttgagcccaggaggtggaggttgcagtaagctgagatcatgccgctgcactccagtctgggtgacagagcaagactctgtctcaaaaataataataataatacaggcagaagaatatatatatatatattatacttacacagcttcgtggatttttctaaaccaaacacagctttgtaacctgcaccagaatcgagaagtggcctcgcagtgtagcgttaggtctcttgcttaaagcaggaagtgggtttccgctcatcttgtcctggcagaaccttgcttggagggtgcccaggaagcctaggagttagtgagcaagtccctgtgtgccctgctgacaagctctgtggctccccaggagaactgtcccaaggcccagggctctggtctgctgaggtgtatgtatggctggggggcggtgtccagaggaggctgctggattcttccagcattgcactcaggacctttgtttggtagaggcttggcagcagtcatctcgctggacagtggtcagcgtgtgctttgccttagccacaacatgtggcctgggcttttggggagagggtgtgcgtctggggtgaagcccagtgatgttaattcctcccaaggcagaggcccttgcggaagttcgggagggtgcaggtgggtgactcacctgagtgggctgatcttctgcctgtcatgcgtcctggcaggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcaggtgagttccaggtgccgagccccactgtgtgtttggtgtctcttaccaggccctgtcttaagcacacatcatggctgttctcccttttccacagatgagaaactgaggcctagctggggttggaggctgggtctgtctctttgtttttgttttgttttgtttttgagacggagtctcgctctgtcgcccaggctggagtgctgtggcgcaatctcagctcactgcaagctccaccttccgggttcacgccattctcctgcctcagcctccagagtagctgggactacaggcgcccaccaccatgcctggctaatttttttgtattttttgtagagacggggtttcaccgtgttagccaggatggtcttgatctcctgacctcatgatcggtccgccttggcctcccaaagtgctgggattacgggcgtgagccactgcacccggtctgtttttttttgttttgttttgtttttttaaaagaagagtttcgcttttgttgcccaagctggagtacagtggcgcgatcttggctcactgcaacctctgcctcccaagttcaagccattctcctgcctcagcctgccaagtagctgggattacaggcatgtgccaccatgcctggctgatttttatatttttagtagagacagggtttctccatgttggtcaggctggtctagaactcctgacctcatgtgatccagctgcctcagcctcccaaagtgctgggattataggcacaagccaccacacctggctcattttttaactttttgtagagacagggtctcgctgtattgccccggctggtctcaaattcctagcttcaaacaatcgtctcacatttcctgcctcccagagtgctgggattgtaggtgtgagcccccacacccagccaggcctggtctttcggagcccacagtgcttgttccattcctttgggtttaaggaaaaccccaggctttcttaagcgatttcacaggtggtggagttgagctcttccagcaagagtaggctgtaggctgagcagcacggagcagagacaggcagcctgcgggtcatcatatgtctgctggccttgatgacctgtctggtcacagccaaatgctgcctccggctggtttctgggcatcaatgatggcacggggcagcccctccctgctgtactccgctgcttgttcacataatcctgctgctccctcccagcctagagcctgcctgaagctctgggtccaggagggaaggggaagaactgaatgacagtccccactgtgccctttcgtgctggggctttgaatggggagcttgggggatgtgagctccctgctccttggccccctgcctcgcactgccagagctgccctggccttggcatctgccccaccatccccccagacaggaggctccttaccaggcttttggagtgagcaccaagaagaacaggggtggcgttgcttgtcacgcaagtagctgggcaccaccacatgcccagaaccaatggtcttgctctgagaaagccctggaatctcagccagctctggtcccattataaaacatcatctgaccctttgcccggctctccctcccccaagttgtgaaggtgtcttcaaagagggggtggagatggctataaatacaacttatcagagggccagaaccttcctttcggcccctaggcagtggttccaggcccagtgtctttgagagtcctcctcccctcccccatctgtcctagagcaagatgtgaagatgtgcgccagggaggtctgcctgctgggttaaccttcccatagggaagcatgagggtctgccccgccacccccacccactgctgacctttccaggggtttcctaagccacttgcacgtgtgggaggaggcagtgctctggaaaggctgcatgcgttcatcttaccagtgtgacctgtgccggagcacagaggaggggcgcccaggctcagcctgagtggaagctgcttgagccctaaagagaaggctaagcatgcaggggccctgcttggggctggtccccctgggctatttgtcccggtgtcactttgtctgcgcactttggctcttcaagagccacataaccctctgcccagaacaccacctgtctttgggcagcttgtgcctaggacgtgccattctcagggaggccacagcctcagccgttgtccatgtgacccacaaatgacctgggcctccctccccttggttctggtacaaaatgcctccttggctggggtgcagtagccccctctgggaatgccggcgagctctgtccagcctctgggctgtggtttgcaagtctctgctggggaaagacagggcagcctagcaggttccagggtgtaatcatcatcatcatcaccaccaccacagggcccacaaactgagggtgactttgacattttgaaatgattgggggcaaaaaatcaggaataacatttcaagttagacgagatgtaaatgtctgtccatggatagttttcttggcacacagccaggctcgtgtctatgcattgtctgtggctggttttgtgctgccgtgtcaggttcacaactactgttgtttgtcttgtagtatctttgtttcttttttttgtttttgagacgaagtctcactcactatgcctcccaggctggagtgcaatagcacgctcttggctcactgtaatctccgcctcccgggttcaagagattctcctgcctcagccacccgggttcaagcgattttcctacctcagcctcctgagcagctggtattacaggcacatgccaccacacctggctaatttttgtattttcactagagacggggtttcatcgtgttggccagactggtctcgaactcctgacctcaggcactccaccagcctcggcctcccaaagtgctgcattacaggcgtgagccacagtgcctggcctgcatctttgcttttcaaggctgtgcctttgagccttttactgtggggatataaagggtgtcagatgaagttgaagggtcttgaccccaaagtgaggggtacttcaacatagtagtgaacaggacagggttgggggctcatagtgatattggggacagtggcaaggagtgttccagggcctgtggggatgcacagtggagcaaggaggcttctttaagatctcaagggagctactgtaggcttggggggtgggggacagccaccttggtactgggtgatggggaggcactgaatgggcttcaagtactcaaaagcctgatcttcaggtttgggagtgagagttctggccctggagccctggctgagtgggcacagggggctgaaattggctcctaagagctggggatggagcctacctggcaagggtgctgctggatggcatcagaaagatccaggtcactggaggagtcagtgacccaggggaggactctgctccagccctgcatgtgtgcacttcctcctcgctctgagcagttgtcctcctgctgccccctccacagggatgactccgctgaggtggacgtgtacaacccgacgaggaacgaatgggacaagatcccgtccatgaatcaggtaaattttcaggcgggccagcattggaagcacaggctggtcctgattttgcaacccaagtgtcatcgtgatgagtgtttgggatccacagccatgatgggtgggtctcatctcaattaatagaaggctgctcttacccttattttgcacttaaggctcactgagacacagatgttaagtaataccctatgattacacagcttagtacacatttgagcagtgtttattgagtatctgctgtgagccagagagcagaaggaagtgagggagcaaggcatacagtcatctggggacacctgttccagagagggacagcaggtacagaggccctgcagcagggcaccctggcgtgttcttagatacaccagcagcccatgtggccggagcagagtcagcatgaggtctgtgacctaccttttttatttttgagacagggtcttgctctgtcacccaggctggagtgcagtggtacaatcatggctcactgcagcctccacctccttgactcgcagtcctcccaccgcaccttcctgaatagctgagactacaggcgtgtgccaccacacccagtaattttttttctcatatgtagatacaaaaggatattcttaaaatttttatagagacagggtcttgctgtgttacccaggctggtctcacactcctggcctcaagtgaccctcctgtctcagcctcccaaagtgctaggattataggcgtgaaccaccacgcccagctggttcctgaggaagtcagtgtgggaatactttttttttttttatacggagtctcgctctgtcacccaggctggagtgcagtggcacgatctcggctcactgcaagctccatctcccaggttcacgccattctcccgcctcaacctcccgagtagctgggactacaggtacccaccaccacgcccagctaattttgtttgtgtatttttagtagagacgggatttcactgtgttagccaggatggtctggatctcctgaccttgtgatctgcctggctcagcctcccaaagtgctgggattacaggcatgagccaccatgcccagcccactgtgggaatacttgtgttgagcacttgctgtgtgttctgaataggacaaccagggtccaccccttctctctgggcttgttgagaagaggggtgcccagcctgacagtgatgggacagggaggcttcagtgccatttggccatgtgagcagtgttagtctgaggtacacatcatattgcctacagccttctttcctgtgtgtctgttaacatttccaaacctacactccgtgacatccagcctcacagcttacatcacagcttaatgtcctggcatttaagagacccagcgttctgttttccccgcagtaagctgcacatagtcatagcgaatttgggaaagatggaaggaatcatccagcctcgcggttcagagcccagctctgccactgtcagccatgcaagcctcagttttcccatctgtaacatggggagaacagcactgctcagcccagagggccactgcagagattctgagagagaacgtaggaagcgctgctcggcacgacctgcacacggggaggcctggcgctgcagcgggcaccctcatcaccatagggaaggcccagctgcctccggggaggcccgttctcctaggcagggtgttggaaaggggttggcctctctgctgctttctgggagagccaaggccacccctctggggtactgacagggcatgccttgtctccagtggttccccaggtggggccctgccctaccctctcctctgacctccactcactcatccctttggcccacaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcc

SEQ ID NO: 36330 - DNA, 92787 bp, Homo sapiens
ccgcggcggcggagaagcagctcgccagccagcagcccgccagccgccgggaggtgggtgcgtggcgccgcggcggccggcggccgagggcggagggcggaagcggaggtgggctggcgggggagggcgcggccgtgcgggcggccggtagggctgcgggcgcgcgcctgaggggaggaggggcagcgcgggcgcgcgcgtcctcaccccctccttccccgcgggcggcggccaggctccctcccctccccttccctctcctcccctcccctcccctctcttcccctaccctcccgcgcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggtaaagcctgggcgcccgcgggcctccagctagggaagtgtttgcgtgcgtccgcggccggggcgatgggccgtgtcacatggccgctgcgggtgggggctggggtgtggtgagttcgggggctgtgggtgcgccggcccgggcgtgcgggttcggggccggagagccgggaagggacggggctcggttgcactgcgctgccgcccaggctgacgggggcgggggctgcctgcgtcccttcccctcgctgctctcacactccatagtttgtggttctgatttttaaagccgaagggccagagctcttgtttcaggagttgtggggaagccttgttagggacgcgtaatactttgcctccactttttttttttggtctcgtaacctttgttaacagtggtagtctcgggttttccatggcttgtgtgtactcacaaacacgcacacagctgataactctgtgatcatccttcactcacttgtgaaagttgttctgcgggtggagcctattagtttttatcacacgcctttggaaagccctcgaagtgatttctcgtatttcaaacttggtttttaaaattgcaacttactttgttctcttggagggggatattgtctttgggtcaggtacttttgtcttttacttatccttaaaatgtccttttgatcctaaacagaaaaagaatgcctgggttggttttgttattcctttctcttgaccctttaaaagcaaaataccaccagtgtgttgtcaaccatacctttaaaaaagaaatttccaggtaaaacgaatttgcaagcagcattttccatcaaagtcatgtcttgtttgttgcaatttggactatcttaaatttgggtttgtgaaacttttaaaacgacatgtgtaaaataattgttaataaataaataacttggaataattacatctttttagaaatggtctttgaaatgtgatttaatttccaaaattctttttctctcttctgacttcatatgaattgaacctgatagtttcgtatgaatgaatcgctgataggatgttttccttgagcctagtaataaatttgctcttattatgctgaaaatttgctattctactttaacaccctttaaaaagtttccatcttacagagaagttagtcaaatagttaaatggagtttcaacagttttaatacatgaattagtgaagcagatgaagcagagatgggagaagtaatttaaaatgggcttcataaatgtaccatagtttgagggtatttaaaaaatttgccttcggaaaacccatacaagatatttaaagaatttcctctgccagaaggtcatttagcaaacgtttatattaaattcaaaagtaatacttttatttttaaagttccttagccgttgccgtaaacttagctgtcgtagtaaatataaatagttcacatctttcggcatttctaaagagtgtgcccacttttactataaatattaaactctgctggatttaattgagttcaaggctgttcactggccaggtttaattaatgtaatgtgattggaaacgttcattttggggttttagtaagaaattgctcttagagcttggtttttatacttagccacaccttctaaagtgcggccacaagcattgtaggtgttcaacaaaagtttgggttttcaaggttgtaacctacgtttacttagtcataagtggtcatgtctctacacagtctgtaagtttcatgaaataatagtcttttaagaaactgtgcagggtaatttcctgttgtttgtgtcttatcaggcttggtatgtgttttaactcttgtgtaggaatattggggatggttttggtatttcaacagaactttagtaggaacaaaggttgtttctattctacttcaagatggccagaggttgttgtccccttttcattttcacattgtaaatattagaatcatgttgctataatctttacttcacatttgggggaatatatgtcaatggaaaaactcggtttagctgtgtaaaccgctggccaaagacctattgaatttttacattttgcaaatactgtcagttttaaaagtctttccttgttcttgtttggttttgattctgttggttttgtgctttagggctccaaaaacctcgttttgtagcagcttttttatacaggtgtttttgtaatgcatataaaagctgtatttagtgcagtctggcagatggagatttattcatattcttaggacaaagagtcatttttagagggtagaggggggcatgtcttttagattcttagtcttttgatgggtgtagaagagccatttttaggcccttagtttctgtgagaggtaagatgttttcccctaagtattccaaaggtatgtcagaaaatgtgaaacgtaaggaattcacaaccagttaagagaggttatgagagattatgcatttatatattttattttattttattttgagacggagttcactcttgttgcccaggctggagtgcaatggcacgatctcggctcaccgcaacctccgcctcctgggttcaagcgcttctcctgcctcagcctcctgagtagctgggattacaggcatgcgccaccatgcctggctgattttgtatttttagtagagacggggtttcaccatgttggtcaggctggtctcgaactcccgacctcaggtgatccgcccacctcggcctcccaaagtgctgggattacaggcgtgagtcaccgcgcctggccgatgcatttattttcaacaaatacatttattcatttattcaacaaacagctttttctgtgtgtcaggctctggactaggcaataaagtctcttaacagcaaacaagtacacccctgttccttaatggagttagaaaagtggaaactcatgtcccttgccctattctccagtgtttagagtaagacagttgttagtgtacaaatcaagggcacatgcattactgagccattcctaaagtgagcttgccttgcttcctgtaacatgtagcagatagcactagggaagatgtgaagtgttactcagtgtcactgggaacaatctgtgtattttggggggaccttggcaccagttttgcacagtctatacaaactgaagatacggccagtctttcagaaacatgtttattgctgaacagatgtacacttgtagagctaagcttcatctgaccttaatttgatcacttattgccctttaattacagaagctggttaaggaaagaaagcagagttgaataactcagtgaaaggatcgggaatagtgtaaaaagttagttaaaccgagacccaggattggacagcagtctcatgtagtggaaaggccttgggttttggaatcagagagccctagcctaatattttgtttctcagttacaatactgggcaatttactaccaaccccaggcccttggttttctgacacaaaatggaagtactaaccccttcctcttattcagtgatcacaattcaagtacctagaacattgcctgagatataagggtcctcccaaatgatttcttcctctcttgtagttgtgggtttgttacttgggctctttctaatccaaatgatttgcctacactgttattatggacctattgtaaaatgtatttgagaagcagacaatgaacaacaaaggcctgggatagccaaattgtcccagtccatagcttaaagcttaggagagccttggagacccttaataagaatgtgttggcatttatttaaagtgtttctaacaagcaaagttatctggcttctaaacctgcactagattagaaacaagtagattatgggtactgtgggaggcttagagggggtgtggtgggggctggggagtaggatgttagcctagtgtctcttgtcagaaaaaacagataacagctcggtgaggataatagagataatctacaagacacaaaaatagtcaaagcctgactagcatgtctggggccattgagtgcaggaccagacctgaaagcatagtaatgaatgttcatcaattagcctaaatcatgtttgggaaaatctttttaagagtgcaataatctacgtaatatactttagattgtcactcaggatgattaagaaatgttcttaaaggggttgaagattgtgctatagcttatggcttatttcatgaaagatcacagtagctgttatgaccaagatgtttttcatttgttttgccattcagacagccattcagattccaagctgaaagggtagccagcagtaaagaaaggctgtttcagtgtggtagcaccctatgtcacccctttctttggtgtaagtaatttttttgtcagtctgcaggagtatcatataaattttcacttgtgctttgacagtagtgtatgcttttcactgtgttttgagatagagtatgctcgagatttctaggataaagcaagagtggatagttggccagtctctctgttgagggtttcttgactcttgtcatgtgacttctgcccagtattagcactgataatttttttgatcccctttcttgtaaccttacctcagggttacttcttaaaccatctacaccatcagataattattggtgaccttgtaatatgtagccttggctgtttttaagaatcaggtttttttttagcagtagtacaaaagtactagcctttttggtttaaaaatgcatagttagaggcttattgcttgtcattgatcaattttgatcattttttcaggttggtgtaattgtgatgtattcagttaggacataattcaatgttgattctagatttacatctcaaagatagctcgcagcttcagttcagcaatttcatgtagggagaatataatttttccaagccaggtggatttagacactgcctttagtttggtcagatagccagaaatattagggcaattctgtgtcttctgtgcttgcctcacattgtacagtgtgagtggttctccttggctcagtgggttcctcttatttgtaactgaggcacattgataggacaggtgcttgatgtatctttaggtttgtagtcttaagaaaatagaaattctgacgtgattaattcttatcaaagtttgtgaatttactgtgaaattgtcactaattatcctaggtagccctgtcatttttcaaaatctggttttacattggcctcaaggctgtagagtagtggaaagcgaggatagactttagttgcttctgtttagtacacgtgtctaccttaatgtaaaaatttgcatttccttgaataatctacagtgtcataccttccctcattttgtggggaagggggatgtagtttcacatttaatgtattcagtaggaataatcttgggtgaaccactggtattccatctgttcattagtttgagtctcttaagtcaaaaaagactcttgatctgaggaagtagcatagtgaatctgtgatcttatagtttgcctatgtttaaaagtaaactacattttcatatgctgcttcagctacttccagaaattctgtagagacataatggttaaggtcttgtaaatatcaaggaaacgttccatcctcatcacgtctttcatttcagaatgtgaggtggtgaggccggaggcagtggctcacgcctgtaatcccagcactttgggaggctgaggcgggcggatcactttgaggtcaggagtttgagaccagcctggccaacatggtgaaaccttgtctctactaaaaatgcaaaaattagctgggtgtggtggcgggtacctgtagtcccagctgctcaagaggctgaggtaggagacttgcttgaaccggggaggccgaggttgcagttagccgagatcccgcgactgctctccagcctgggagacagagcaagactccgtctcaaaaaaaaaaaagaaaaaaaagaaaatgtggggtggcaaatcttttttgcagagcctcctatataaaatcctcataaatgatgcagtggaagctgggcccgtgagccttctgccttgacttgagtgaactattgaaactcttttgttgactagagatactttatctgtggtagtaaatgtaaattttccttattgagatccacttttaaaattctttttttttttttttttgagacggagttttgctcctgttgcccaggctggagtgcagtggtgcgatcttggctcactgcaacctccgcctcctaggttcaagcagttctcctgcctcagcctcctgagtagctaggattacaggcatgcgccaccatgtccggctaattttgtatttttaatagaaacggggtttcaccatgttggtcaggctggtctcgaactcctgacctcaggtgattcgcccaccttggcctcccaaagtgttgggattacatgcgtgagccactgcgcccggcctaaaattcttaatagacaggtagttaggttgtagttcatgttagctgatcaattaaacttttttttaaaaaatgttttagttatcaggagggtccagctttggcctgaggttgtgcattggccatttctgctcgaaaccagtagtagtcagacttaaaacatgtgcacacctgcacacacagcagcaactagaaagcctttagagagaaatatgcagaatttcgaaatgtaaaacagataaaaggagtaaagctgttttgtggaaggaagaataggcagttgttgaagtcctgcctgatcagttttcctctcatcctcaccaccaggaagcctttgaagcacagctgaagaacagtaggtcttggagaaatttttgctgtagacctgctctatcttaacaggtagctgccagccacatgtggctatttagcacttgaaatgtggctgctgtgactgagaaactgaatgttaaattttacttaatctaaatttagatagccatatgcagctgatggctactgtattagacagcacagatacccaaggacatttacatcattgtataaagttgtgttgggtggcactactctagactttgctttaattgagcttttatggcctgaggaccccactcacgtgaattgacgtggtattagttgctgcttcagaagagggtcaggatagactttgggaatttgaagagcaattagagtacttgtactttatatttgtgctgatttgagtctgggcctgtgtagtgttgtcataggtgctttttttttttttttaataatctgggaatgataaaccaatatgtaagttacgtgtttacaagttgattatagagttgtggattccacaaaactcattataggtgataggaatataactcttagttaaaaaaaaaaaaataagtagtctctttacacagcagtccctatttaatgtggacttttgctaaaataataattttcttgaattaaattcaagcttgcattaggtttgacagtccataaagttgaacacatgaatgttttctgtttgcttttgtttaaaagacatgacccatcattctccatgggggccgacctaggtttccagttggcagtgtctttccttactagcttacgctttggagagaacatagttgtagtgagaattgaaaaatctgtttttaaaaaattgggttttatgtattttaatttttttgaggttttctattatcctggttactaatgaattatttatttgactaaaacagttatacaattccaggtcattgatgctgctgtttttttctctgccttgtagtatgtttgaacatagattgctaaaaatctcggtctccacagaggattggttccgggactctcctgcaagcaccagaatatgagaacgctgaagtcccttgtataaaatggtgtagaatttgttttatgcacattttattgttattctttaaatcctctctagattacttaatatctaatacaatgtaaatagttgttattctatattgttttagaaatgatgagaaaaaagtctgtacatgttcagtacagtcacagttttttcctgaatattttttatccatggttggtttaatccatgtatttggaacccacagataaggaggattgactgcacagtgattttatattatttctagtgggaccttagatgttctagatgaggcagcaccatcatatttaaagtatttttgttgaaataattaactttggttttctttctaaataaaaattcacataggtatttggggaatattttgtattttcctgcagtttgaagatttgaaatttctcttccctccataccttttaaaagtgcaatctacttttgctttctacatttaatcactatctgttcttgacttcaactttgcaaacatattttttaaccattctttttcacatttcccttcctactggccttccggatgaactgtcaagtttagcagtcttttctcagtgatcatactttcttcagtgtttgctgttattgtttatactgtctttatctaaatttcttaaaatgacacagacacaagttaggcccattcttcttactgtaaacagatgaaaatgttggataaaatataaaagttttctcttatgtatacagttgatcttgagagagaaagtgcccaggtactagaaacttagaaaaatcagtcaactttaagggaagtgtggccttgggggatttactagagataagattcagtagttggggctgaggttataatgccattcaatgaaaggagacagaactgtgggaactgtgtgcttaaaaaaattaaaaaatgaaaagtgttctggtatcattgaaacatctggggcttcttggagaaagaagcctcagacctctctatggaggaactggaaaaacagtaggctttagatggactttaatatcacagcaaggcaaggcagggtacatgaaaacatctacagctgcatgtggaatagtgaatttttgtatacataatccatgactgcaatccaaaattcagggatacccagtgaagagtctctttactggtctgttctttgccatacagttgccttttcaaaggcaagtagctttactaggtttttgtgtggtgttccagagattttatgcatctatgaacaattttgtgtgtatattaccttttagtacaagtggtcacatatgtcacttaatagtacatcttattttgtgtcagtatgtaatgaatgcctttcttcttttttggagtagtgggttgtataatattcttttgtatgggtgtctgtaaatttttttttgagacagtgtctcactctgtcacccaggctggagtgcagtggtgtgatcacagctcactgcaaccttgactgccaggggtcaagttaatctcccacctcagctacctgagtagttgggactgcaggcgcatgcctaccatatccagctaatttttaaaattttttgtagaggtggggtttcgccatgttgcctagatttgtcttgaactcctgggctcaagcgatttgcctgccacggcccctcaaagttttgggattacaggcgtaagccactgtgcctggccgggtgtctgaatatatcatcagtcctctgttgaatgtttccagtcttgtggtattaaaaacaatgctacaacaaataacttcgtttatatagcattttgctcctttgcaggtatgtctgtaagatagatttctaggagtagttcaaagaatatctacatttgtaatttattttagagaatgtactttattcattttttcgaataacacatgcacatggtataaaagtcaaggagaacaaaatagcaaatactgaaaaaagtaagcctcctttacatctcctacctcctgctgcccagttgtgctttccagaaatgtaaccactgttactagcttttcgtttatccttctagagttgctctgtccagtatgatagccactagccaccatgtggctattgagctcttgaaattgagatggaccacaagcataaaatacacaccaattttctaacagtacaaaaacagaatgttaaatatttcaatggtttttaatacggattgcgaattgaaatagtattttggatatattgggttagattaataaaattattaaattatgatttcatcttgtaattcccgctgtgatggcatcaggaaatgggatctttgggagatattgaggtcaggagggtagagccctcatgaatgggattagtgcctttataaaagagaccgttgttagcattctgtcctccatgtgtagatacctgaaaaaagcggcagtctgcaacccagaagagggccttacttggaacctaaccatgctggtaccctgatctcggacttgcagcctccggaactgtgagaaataaatttctgttgtttataagccacctagtctgtagtactttgttataccgtcctgaactgactaaagcacaccaatttttacttttttaatgtggctgatagaaaatttaacaatatgtggtttgcatcctgtttctgttggatagcactggtctaaagaaatccatacatatataaacatgtactaacataagaattccacttaggcaaaatttttttcttttgcgttgtaatctttggaatcagaaatctgctgagatattggtaaagagtggtacaaagctgttctttatggccccatcagtcacccccatccatttatcatttggctctaatcagtgaaggttatgcttccattgacttctacagtgttcactttggagagaaggctgccgttgttttggcttcgtcttttttagcttgctccgatttgcactggttgcctctacacctagtacgccgcagtcattctgagatttccccctcactagcatattagggattgccttcattttttcttctttgttagatctcctattctttgtgtgtgtgtgtgtgtgtgtgtgtgtgtgtgtgtgtgtgtgtgtgtgtgtatttttttttttgagacaaggtcacactctgttgtctagttggagtgtagtagggtgatcatggctcactgcagccttgcactcctgggttcgagtgtagatcgtattcctttttgttttactagtatctccttttgatgagacatattcttcaggaccttcctggagagtgtgttgggggtggggcggtaaatacttggagatgttgcatgtctgaaaatgcctttgttctggctaacataagtctaggttggaaatttttttttgaaaaattatgaagcccagaattacgaagccattgctctcttgactttgtttacagtatactgttgacaaaaccaaagccattttgattgttttctatataacctattttttttcctccttggaaactttaagccctttctttgtctttggcattctggttttgctaccatgggccttcatgtaggtttgttttcatctgttttactggggtcttgatgggccctttccatctagaaactcccatctttcagttcaggggctttttcttaatttatctatttgactcccctactctgcatctctgtttggaactgttgttgggacattggacctctggaaccagtcttccaatttttttcattttctctactgtttcccatctttcttttctactttctggaagatttcttctactttatcttctagcacttctattgatttttttcccccgtttctgctgtcaagctatgcaagagctgttaagttctctgaatgctgcctttgagagcatgctgctctttcttcagggttgctcagtcttatttctctggccatgttgatgttttaaaaatgttttctttctctgtatagtcttttcctgaagctgaatttttctggttttgtttgacgtttttcctcagataaagtaattcttaagaagtggggatctaaaaagctgatcaaaaactcaacatgtgggtgaaacttgtctcctttcagtttcactggagagggatctgagcaggcaggctgtttgttggtaaactcccaatattagcatctatatgcctttcctcctgggtcggtcaggtaccctagtgaagtcttttgatctgaataactgggcggaggtctggctgctagtatttgggagccaaaacccagtggaggaaggggtttgggagtcgacatttaacacagcgtgctcatgttcattcacaccctcttttcttcctacttatacccaggccatctcctagtccagggattttgttttcccctttgcagaaagtaaacgttgaggcagaggattagttatccagagacagtaggggcggaaatctaagaactgaattcctttctacaaagctcttaacaagtgctacctattattccttcccctgcctggccctcagttcctgccgtgacttgctgttggttccttaactttttgaggtttctgtgttaatcaatggttttcagcttttcctacagctagcctagagttagtagtttctgatctgttcaattactgctcacccattttccagccattaaaattttgcttctgttttctccttacctcttctccctatcctcatgaggtttctggtttttaaaaattcccttggttaggcgtggtggctcatgcctgtaatcctagcactttgggaggctgaggcaggaggattggttgagtccaggagttcaagcctagacaacatagggagaacccatatcttaaaaaaaaaattctttatggttttcaataggctgttttcatctacaatgcaatgatgagttaaagttttccattaaaaatttttttaccaataactctccaaaagaattgaaatagaataacgtataactccaagtcagtggggatgaggggtggaaataaagagaaattgatcactccagtataaggcagggaagaagaaaaaagaaaagaaaaatgcataggtattagaaaacacaaaataagatggtagaaaataagctgaaatatctccataaacccaatatgtaatctcagattaaacttgctggctaaaggagaacaaaaatttaaaaaatccaaccaactgtattttacaagtggagatactcctaaaagtatgatgacatagtttaaaagcaaaggaatggaaaagatatactaggtgtaatttataaggtaaaattggaagaattacaggtataaatcaaatctataatcgtagtagaaaattttaatatacctctcagtaatttatgaaagggtagatttaaaaaactacaaggttatgaaggattggaagagtacaattagcaagcacccaacaattacagaagatacattctgtaaggggaatcgcttgaacccaggaggcagaggttgcagtgagccgagatcataccactgcactccaggctgggcgacagagcgagactccgtctcaacaacgacaacaaaaatagtgtcagcgagactctgtctcaacaacgacaacaacaaaaatagtgtctttgatttagtgcatgtaactaagttgaaaagagtgccaagactgatagaggagaaaaagaatgtacaaatgtattggaaatgaagggatggtataactgcagacaaactgagattttaaaactgcaagaatactgtgaacagttttatttctttaaatttggaaacaggtaaagtggacaatttctagcaaaacaaattaccaagttggcttaataagaattagaaacttcactagattatgatttaaaaacttagtcatgtttagaaatatacctataccaggcggggcatggtggctaccactttgggaggccaaggtgggcgatcacttgaagtcagcagtttgagaccagcctggccaacatggtgaagccctatctctatcaaaaatacaaaaattagccaagcatggttgcagtcgcctgtaatcccagctaatcaggtggctgaggcagagcccaggagacagaggttgcagtgagacaagatcgtgccactgcactccagcctgggcgacagagtgagactctgtctcaaaacaaaacaaaacaaaacaaaataaataaataaatatacctgtaccaatgtaaaattttaagtcctcaagcaaaacaccagactacaaatgaagaccccgtatgggcaagtgcaaccaaacgtgagggattaactctaatcttatacaaaatgttacagaaaaattattttgcaaggctactataatcttgataccccaaccagatagtgtgagaaggggatataggctgcattctcaccaaagaacatggcaataaaaattgtagtttgtaaaatgttagtatttactcaaaacaaaaataccatgactaattagggtttgtctcaggaatgtagggatgattaagcattagaaaactcgtaaatgaaattcatcatgttaacacattaaaggagaaaggccatatgataattttgatggacaacgggaaagcatatgataacatttagtacttgttcatgacaaaaattcttaggaaatgaatacaagagaactttcaaaagggtgttaaaaaacacagaagagtacatacggtataattccatctatatgaatttctggaacaggtaaaattaatagtaatagaagtcagtagttgcctgacgggggaaggtggattgactgaaaaggaacgtaagggagacatctgaggtgctggaaatgttgtttttttggggattgtggttacattagtgtaaacatttgttagaattattgatttcatgcccactcacggttcgcgaccctcagtttagagaaattgtagagtgcagcatatggtgaaatgtcttttttagcaaagtgtgtgtgtatatactaggttgcatgtaaaatgtacttttcactgtgggactttttttggttaaaaagtttgaaagtttgaaattttctgccctagaagagcttttacatggtataaaatgatatataccagcctattcatagcaggttgtgagagaggaaaattggaaacctaactagtcatccagagtgaatggacagtgaactgtgctagtcataaaatggaatgccatgtgacagctaaaatgaatgaactaggatttaggattatgtatgtatcagcatggactgaacagtatcacactttcatataaatttataaaatgtacagaactgtattgtatggatacaatatgtagcaaaactgttaaatgaccatgggggaacatcaggatagtgataatctctgagaagcaagagggagggaaatgttatcaaagaggaatacatagggggctttagctgtattcgtatcttatttcttatgtctgatcaagtactgcaaaatgctaagatatgacagctagatggaaagtacatgagtgttgagtgtaatatttttgtgtaattaaagtccccatttacaataaaaaccaagatacctggagaaataagtaaatttgacaagatgtaagattttttatggagaaaatatgcaacttatcaatagataataaataaatggaaatactcatttgcatagtcggagtacttgatatcataaatatgttctccataaactaatataaattcattgcacttccaatcaaaatcctataggatttttgtagaacatgctaaacttaaagtaaccagcaatactacacatctgaaaaataaggaaggggggtcaccctgacaaatatcaagactaactagaaagcagtagtaattaatattttcttacattgatgttaagtgtgaacaaataacagaatgcgtgtgatcagacctttagtaggaatttgttatgcgacagaagtggcattatgacttagcaaaaggtaagctttaatacacaggctgtccttatgagagatggttagatcactgtctcacctcttaaaaccaaatttctgatctttcttttagaaacttaatatgaaaagtaaactaaagcatccataagaatatctagaggggattctctgtattacgtcagggtatttatttgtgcctcacattcttcatttgtaaataatagtacctaaccccagttggttcttaggattcggaattcttgcttactggactcttaggcttaagcactcaataaatgtttcctactatatttagaggcacagcaagatttctttgaaaagcaaggttgtggcataaaagatttttaattaaaatacagctttgtgtgttccaaaagacaacataaaatgaaaagtcattctaaggatttggagatttttttgtaatacatactcagtgatagggtttatgtcagaataaaaacagtaagaaaaggaccacatagttgaggactctggaaagagtatgcactgttgtttaattaaatgtgcagagaatgctatttgtcaaactataatatagagttaataacttgaaggctttactacaagttcaggataattagacctcttaccttattgaaactttccggtgagtaatcgtagaatcctaattttactaaggtatcatttggtaagctgacttattcagctgtaaagatagtctttgtgttcttttgaaatctgcattatgtaagtatcacttattgctggaattagaaatagtgtctgaacttagatttcaattcttgcagatgttgaaaatttatttcagtagagaacttgctgccacaccattgaaggaaatctgtatattctgtaaatgactcattcacgttttgatagcaacttgattataaatctagttttcttttttgtatttcatttgtttttaacctggaacacattgttatctgttccttgtcagcctacattcagtctatttacacttcaaaaatattggctaaaaatgcttcagtttttaaaataaaagcttaactaattgaagatgtattatcagcattacttacaacaaatgttattttattacataatttaaaaattctccggagatattagacagatgtcagccaaccatggttactgagacatgcaaaggtaaggctggcaactttaagtgttcacttagttccaaaatggttttaactcctcttgtaagacatgggacactgaaatcatgtggcaataccaggtcatgtggccattcagatgacccagaataggcctaaacttaagttagtttcatttcagtgaagaaacaatattgtaaaggttttatagaaaacttttagatccccaggaatacagcttaactcataagaaacatttctcctaacgaaagtgtaacaggctgggcgctgtggctcatgcctgtaatccctgtgctttgggaggccgaggcggatggatcatctgaggtcaggagtttgagaccagcctggccaatatggtgaaaccccatctctactaaaaacacaaaaaattagccgagcgtgttgacgcgtgcctgtaatcccagctactccggaggctgaggcaggagaactgcttgaacctgggaggtggaggttgcagtgagctgaggtcacgccattgcactccaacctgggcaacaagagtgaaactcctcaaaaaaaaaaagtgttacagaaactgtttactctcattcctcctaatgctggaaatcccttttttttttttttttttttttgctgtttatacagaagtttcattttttattctttttttaggctaaattcttatgaatggaataattgaaccaaagatacagatacttgtagggagattcttttattttgctttttctatcagtttttcacaaggaacagagagattactcatgctaactcaaaaagaggttttgttctgaggatataattgtggagctggaacaggcctggacagtcctcagaaaccaagcctagagattggctgctctgcttttcttcaagacaccagttgtctctgcctagctctggcacacactcttacttgtacactgactgctagctcccctgagtctactatattttatgctgcctcctggccatgtgatgaacatagttacttacataaaggcatgtataaaactgaccctttagccttcagggttgcttctctttcctcattcctaatagtgatgaatgtaccattacatgccactcagttacattaggtagtcggtcacattagttgtgtttcaatccttttccctaaactgcacgtccagtaggtcattcaaaatgcaaattgtcactggaataaatgaagtaatactcctatcattagcagtaatttctgtcttcagctctttaatctgcactggccttattttcccctcatcttctgccacagtgcttcctgtgcaccgtattttagtgataacctaaatttttcgtctctcctaaaacgtttcctgtctttagaaaacatgctgaactttctgcctgctgtactatctctctcaatacttgtgctctggtgtcaactttagtgtcacctttcccttccaaaggttgaatcctgttctctgtgctaggataagactgtgtcacatgatactacggtgtctgtagttggctcctctagagcatactttgtggcacagagtaggaatccaacaggggccaaaggtagccaagtacactttttgctgcctgatagtcccaggttattagttggtagatgattacatgcgtttgatggagttttgtgtatttgctttattttatcaagttacatactacagtgcttatttatgtgtcgtattataggtctaccactatagacagtttaaccgggctgttaagttcactgttgctcttttatttgcattacagttccctaattctatgcaaacctcactttcccaccatttctactatattgctaaagaaagttacataatcctattattgactcctttcaaatttttagtgtttgaaccctagttggactcccaaggttgccaatgcagtattgttatgtggcattccatacatccctaaaaagggttgacatggccaaatttatgaaatttatgaaatttggcatgctgtgttgcctcttcctggagggaggccttggggccagtctcctgaattgagcttgaggatgcattgattttttttctgtttcgaggggcgtgagtatgattatattaggttatggccattattttctttttttttttttttccagatggagtctcgctctgttgcccagactagagtgcagtggcgtggttttggctcactgcaacctctgcctcccaggttcaagcgattctcctgcctcagcctcacgagtagttgggactacaggcactcgccaccacgcccagctaatttttgtatttttagtagacatggggtttcaccatgttggtcaggctagttctcgaatgcctgacctcgtgatccaaccgcctctgcctctcaaagtgctgggattacaggcgtgagccaccacgcctggcagttatggccattattttctagcaaattataccaagggctgaatatcctcagtttgaggaccttttttgagaacattcttttgataatttaaagtccttttttgagcttttatttaatgtttcttttttagtaaatatacagttgacccttgaacaatggggtggttggggtgctgtcctgcacagtgaagaatctgtgtataacttttgactctcctaaaacttacgacctactgttgactggaagccttaccaatacataaacagttgattaacccatattttgcatgtcacatgcatgataaactgtattctttaagctagagaaaagaaacctactaagaaaatcataaggaagagaaaatacatatactattcactaagtggaagtggatcatcatgaaggtcttcatcctcattgtcttcactctgagtaggctgaggagtggttggtcatgctgtctcacaggtagaagaggcagactgggagtcaggcacattcagtgtaactttatgaaaataagcaatttttgcctgactttttgcattttcatttctccaaaaatgtttctgtgtggtaccagtcctccttacaccttttgctttagtttcagtgcccatgtaatggaaggatctgtgttataaaagaagtcaaaagcagccttcaataattagaaccctatattatatatagctagattgtcctatgtcaatttgttttctggcactgcttcttctgcatcttcttcctcatcatctggagctagtttagaagcactgatctctgttacgtcgtcttctgttaattcctctgatgtgtggagtctgttagcccttgaatttctctaaaaagatccatctcttgaagcccttcactccccacttttttttttttttttccatatccacaatctcttatgatttcctcgataggctctggtgtaaatgctgtgaagtcgggcacatctggatactgttttctctagtaggaatgtatcattttggacttgatggctttcatggttttttctataacagcaatggcatcttccatggcgtaatccttccatactttgatgacactctatcagagttcttttttgtaacattgacggtcttttccatggagtactgtgtgtaatgagccttaaaggtccttatgactccctgatttagagatgttattaatgtgttcagggacaagtagatcactttgacatatttggtgttggaatcatgggattgtgggttaccagcgacattgtccaatgtcaaaagaactttaaaaggcagtcttttactggcagggtacttgacttcagggacaaagcattgatggaacgaatccagagaaaagcgttctggttgccctggcctttttgttgtggcagccggtgtttatcttttcccttcaaggattggaggtcagcagctttatagagaagggcagtgctgatcataaacctggacatatttgcacaaaacagtagagttagcctgtcctttcctacctcagatctggtgcttgtttctctttttgctaataaatgtcctttgtggcagttttttcccctagaatacagcacttgcgcctgcattaaaaacccgttcaggcagataccctttctcctcagtgattttcttaatggtgcctaggaactaactcatctactttggttgacagaagctcctttcctgttatcttgacattttttaagccagcctgtttctaaattctcaaccatcttttgatttcattaaattttccagctttagatccttcaccttaattttgctttaagttgtcatataatgactccgctttttctcaaaccatgtaatagtctataggtacgcctttctttatagcaatcctgtacctacataaaacctgcattttcaatatgagatcaaaagttgtttcacaaaaggtgcaagatcttcacacctgttggcctagctgcagtggcagcttcacaaattttcttttttttttttttttagctgtagttcttacactggattcatttatcttgaaatggtgggcaactgcagctgcagacctcagtctgtggtacataccaagcaattggagtttttcttgtaatgtcatgatttttctctgcttcttgggagcactgtcagcatcactagtggcacatcgtatggatctcatggtattagtcaaggcttatggtattgcactacacatggtgaaaattacatgagaaatgtgagagatcactttttactgtgataatttactggagagaagaactgctcatgcagagatgattagcctcacacagtggatactcgcaacacttccgctcaccgtgatagcaacaggaggtggcgatgaaattattacagtagtacagtatgtactaccgttaattttatgtagttaatgatttaatacttcatctgaatgtttacatttctcaactgtaaatggctccatgtatggtctgtgtttgtgtaagttttgataaattttaactttttatagtagatttttgtatttcatgatggtaaatgatagagtagtatctacatatcttttatgctttataacatacctttttcttagtttttttcagtgtttctaggctacctggtttatgagtttttttcagattgtctcaaatctccaagacattttgcaatgtttcttgaataaaatctgtgtataaatggacctatacagtttaaacccatgttgtccacgggtcaattatatagctctgttacaacaaccattttgtcagtgcctcatgtatgtttgtgatggctgtcatttgggctctcaatttttgtcctcaaaacaataccccttccaccctccatccacgaacatttgcctacatgtacttgcagaggctatctgcatgttgtggacggaaacttccaagcttacatctttggtcacttgcaacctcctcccttctgaaatttgtaatgtgcattggcatgttgaagcttttgagaagttcttcagtaaagaagtctatttaacttaatttaggaacttcttaatgtgtttgtccaggcaccttttaaatttttttgaattgtaatttacattgctaaaatgcacagacttcaaatgttcagttctgtgagtgtttttgagatagagtctcactctctcgcccagggtgctggagtgcagtggcacgatctcggctcactgcagcctctgcctcctgggctctagtgatcctttcaagtagctaggagtatagacatgcacatggctaacttttttctgtattttttgtagagacagggtttcgccatgttgctcatactggtcttgaactccagaaatcaagcaatctgtctgcctcagcctcccaaagtgctgggattataggtgtgagccactgggctcggccagttctgtgagttttggtaacttgtactcatgtgtgattacctctcaagatagaaaacattcaggaattcaacagtggatttacaggagcgagggaataaaacaaagatagagaacacttttgtcaccgtagaaaggtactttgtgcttctgtccaaacatttccacttctcttccttagtgcctctgagatggtcatcttgacttgtcattagattagttttgcctgttgtgggaagccatgaatgaaatcagtctatatttctttgtcttttgcccagcatgtttttgagactgatccgtgttgtggagtgtataagctcattcatatttgttcctgagcagtattcctttttatgagcacactataattatttgttttcttttgatattttggctgtttttagtttttggcgattattaacatggctactatgaacattcttatacaggtttctttttgtggacatacgtatttatttttcctgaatgtgtgatacagggtagatctatgtttaactttttggaacttgccggttttccaattgtgctatataccattttatactttcatttcagcagtttatgaatgttctagttgcttgatgtggtagactgaatcatggtctccaaagatattcaggttctaatcccaagaacctgtgaatgttgttttatatggcaagagagactttacagatgtgattaaattaaggatcttgagatggagagatgatcctggattatctgggtgggctttaaatgtaatgccaagagctcttactagaaggccatagagggagatttgaatacagaagagaaggcagtgtgacgatggaagcagagattggaatgatgtgctctgaaggtgggggagagagcacaagctaagggaagggagcacaagctaaagactacaggtaaccactagaagctgaaaaaggcaaggacgaacttcccctcagacactccaggaggaatcagtcctgccaacactgtgactgtagttcattgaaactgattttgctaaatttgtgctgtgattgcgattatttgttacagcagcagtagtatactaatacactccacatcttcatcaacatttagtagtgtcagaaaaattttaaaccattctagatggtgtgaaatggtattgcattatggttttagtttgcgttttcctgatgattggtgatactaaatacctcttcatgtgctcctgtgtcttttatgacatgtctattattcttttcctgtttaacaaaaaagctgagcttacctttttgtgtgatttttaaattttgttggtttatgttacatacacagatttgagtatcccttatccaaaatgcttgggacccgaagtggttcagattttttccaatttttagaatatttgcattatagctgtatagtacaatgaccgtttttttgggggtgtcatgttggtactcaagaagtttcagattttggagcattttagatttcagttttcggatttgtgatgctcagcctgtattttttttttctttttctatttctttttttttctttttgagacatggtcttgttctgccactcagcctggagtgcaatggagtgatcttggctcactgcagcctccgcacccctgtgctcaaatgatcctcccacctcagcctcctaactgggagcacaggaggcaccacgcccagctattttttttgtattttttgttttttagtagagatggggtcttgccatgctgtccaggctggtcttgaacactagagctcaagcagtcctcctattttggcctcccaaagtgctgggattacaggtgtgagccaccatgcgtggctcaactgtatttctcttgtggttaatgctttttatgttttaaggtcatgaatgtattctgtgttttcctctaagagcttaagattctgctttcccattgaagatggtatgcacttgtggttgaggcttgttattttccatgttgttgaaaagttgttgaaaactagattgaccttgggccttactggaaaatgagttgactgtatatgtgtgggtctatttctagacttgttctgttccactgatctttttttcttatgcctactctatactcttgattactaagtctttttagtaagccttgaaataaggtggtgtaaggcctccagttttctttttcaagaatggtttggttattctagtttttttttttgtttccatatgaattttatatcatatgaattgcttaactctgctggaagtttggtagggattacattgaatccatatatcaaattggaaagaatggacatttaagcaatatgaatcttcaagtctatgaacatgatctctctttgttcagtgtttttcatttttcttagcaatattttgtaattcttagtgttgagatcttgagtatctttctttagatatgtagaaaatatctgttgtttcaagcgtatttcttgaaatttcattttccaaatcttgaccctttatcttgaaaccttgctaaatttacttactagttccagtaagtagattacttgtagattccatgcacttttccatggagacagtcatatcactgtagaatataaagtcagttttatttatttctttccagtctatcttttctttgttgcatagttgtcctgtctacaatatccaatgcattactgaatagaaagggtaaccgtggacatctttgtcttattcccagttgtaagggagagatttaatgtttctttatgacatatgctagctctaggtttttcatagatgtccttttcagattgaagaacattcttttctagtgttgctgggagttttaaattatagatgagtgttgaattaacattttcagataccttttttctcgctcatttgagagaatcataggtgcgttttctcctttgtactataaatgaggtgcttgatttttgaatgttaaaccaattttgctccttgggataaatcctacttagtgatgatgaccttttctattatgttgctggatgtgatttgctaatattttgtttaggatttttgcatctagtagtaacagacctttgctgtgtattagtacgggatcttgggcccaagccggcttgttgtccctttttcagtatcagacagctgttgcttctcattcctcagcatctgtgtgcctttgtctgggactggtggtagcaatgtttcctcccttcccgtggcagtagaatatggtggttattgttacagagtgaaaggcatgtttgtgtgtgggagatgggcaagtaagttttgctccacaaatcccccaactcagcagcacatgtcttttgctctacccttccctttgaggcaggggatctttgcttgcccttgggtttggtagactttcctgcctctcccgtcatagttgaaggcatttgcttcatacgagatgccaccaaatgggaggaaggagctctcttccgttttctgccttttttcaagagcactcagttgaggcccttggaaaagagcttgtgaatgagtgcagattctctttctatcgaggactcccagggattttaactgttatcctagctcggcctttcatccttacttttatctttaatattcagcaggttgaccatgaatgtgttttctttccatatgtggattaatatctgtcatctcttgaaaagtttatggccattatctcttcatacatttttttgttccccattgtctttcatctttctctggcaccccaattaaacccaactgacatttggttttggatattctgagtcccccccccccccacactgttttttccctctttgtgtttcaatttgcatactttaatttggcctgtcttcaagttcactgctcatttctgttaagcccatctaatggtatccttaatttctaatactatagttttcatttctaacgttttcctgtgatcctcttttgtaactttgatatctgtgatgaagttttttcattattcatgttgctatctcttccatcagtttctttagcatttttattatagttatctgattttattcatgttttgactgtttgctactccctgtatcttgtaatttttgattgaatgctgaacatttgtataaaaacaatggagattgaagtaaataatatttacttttagaaaatggtccatcatttcttgttttgtccaagtgtgattttggatctctttttggtttatagctgagccgtcagctttctgaaccatgagaaatttctctatagctcagctgtcaattccttggtcattcttattttctttccccccaccccctctttctctagtcctgcctccaagcttttgtgcccagtgagacatctttctgctattaataccttccagaggtttcttttagcaatcctaccctgtcttcaagttcgctactcatttcagcctcggtagatcaatgtcctgagtatctgggtgaaagttttctcatctttcctgtcctaccgcagcccttggcagctcaatgtctagactctcttgggatcatctttttctcacctttcttgcctgtccctccccccatcccccattgatgagggtagattttttgcatttatgggagatcttaagctccttaggggatctccctcagctttccagtcctgttccccaagctttgacatactttttgcaagtacttagtggaaacctatggggatgagtggttggggtggatgcacacttgctctgtgggatccttgcaatttaatatgtcatgtcggtgtgcatgtaggctggtttcttctttctttcatttatggcaggattattcctcactagccgctccaccaggaaagagaccatccatgcagcctctcttctctcaaggctcaacacttggaatttagttcttcttaggctgctttgtatcctcaactctggttcagagagaccatgattttgtagcttatctggctagttttgattattagaatgaaagtgatgctctgttgtaactttctacgtcctaatcagaagtggaattccttctatggaatactttttaagtatatagtctgataatacataactgacacgttttctgttgtttcataatggttgattttctcagggctacgtttctctattttttcctgttctcaaatcttaactctccatctctgtcctcaagtggtaagtgatcttgtgtcttattttgaaattaaagtcatcaacaaattatttcaactcatagatttatagttgtggaagacttactattcaaatggaattagaacgttttgggggataggatgcagtagttcttggtagtccaagactcttaataaaacaactagaaaagccaggtaatttacaaaatttatatatttagcgatagagaacaatgggtgtaaaaatgattaaagaaagcaaaattttgcaccctgggggaatacctttcacaagtgagctgagaggtctgcagctgatcattgtttttcctgggtacagagtagaggaggcctttgggctgcagcctgagtggcagattggaaatatgaggggcctttaaacacagagaacgccctcagtatattcctaaattctgtagttcagctgggcggaagagataaaccaaaatctcagaaaaggagattgggatattttctagtcctatggtgttgagataaagattctctaggggaagcgacttgagaacaataggtgagagttgaaagcgtttgaggaagtggtgaatacacactgatgattttcaacacacccagtttcttcccccgtagacatttgccaaattctgaagctgcttaggctagagagctaaaccagaagtctcttaaaaacaaagcaattcttatagtatctaggtacctagaagataacgatctgctagcttttgaaatgaaggctctgcagagtctcatcctaggaacagggacaaaccagaggtagtctccttcatagcaaaactgctactcagcagtgttctatgattctggcattatagaggaagtagtaaaagtatatgtatgaaaattgtgttaagtgaaggatgaataagaaaatatctagggtaaccactaaaagaaaagaatgtaacaaatgaatacagaaaaaaattggatatagaatatgtgataaattcagaagaagacaagaaagaaaatataaaacaagcaggcaactaaattagtaattatgttacatggaaatgggctaaatatttcaagtaaatggcaaaaatcatcagactggacaaataataattacctaaatataagtacctagaaagattgagagaaaatgatgcgaaaaggtataccatccaaatgctaactgaaggaaataagtgtggctataccaatcaggcaaaggagactttaatacaataaacagtagtagaaaaagagaactacattttatagtgtaaggggattgatccaccagagttaccacaatcctttatgtgtacccagtaaaatagcccaaacatctataaaccaaaaattttattttgaactaaaagaaacagacaaatatgccatcacaatggatgcacatatataggacatacatacatcacaattagcaggcttgatctaattgtcatatgtagaacattgaaactattaatggtggtattaaccatcttttcccttgcacatggaaattgtactagaattgaccataagctagggccatgaacaaagcctcagcaaatatcattgattttaataattgaatatgttgtttgtattatagtaaataaaaataactagaaaattcctagctgcctagaaataaaacactatgcttttgaataacatatgacttaaaataagaatttatgatggctattagaaaatattttaaactgattgaaaatgaaggtgaactacaatgatctagattgctgctgctgaaatgctaagatgaaatttatagccttaagtctatgcattggaaaagaaagcttttttaaggaggtagaaaaggaataggaaatcaaacctaaagacagtagaagtaaagaaataatgaagacaagagcagaaattagtgaatagaaagtaatcttacatagagaaaattgacaaagctaagaaaaagttggttctttgaaaagattaatgtaattgaccacttagcaaaactgataaaaggaggatggggagggggagagagaacataaatttaaataataggaattgaaaaatgtcacatcactacggatcctacagccgttaaatagaggcatttatgaacagtttatggagaatatgggataggcagagtaggcagaaattttgagtagttagggctggatcattcaatatgggtaggcagcacctttgtgtagctattgagtacttgaaatgtggctagtcctagttgagttgtcctgtaagtgtaaagtactcaacagattttgtagacttagtatgaaaattttttttatattgattgcaggttgaaatgatggcattttggatatattgggttaaatacatcattaaaatgttgcctattttctttccctttttaaaatgtcattagagaacttaaagtacatatgtagctcatattacatttttatagaggttgttatattggctttaagataggtactgttatccttattttacagctgagaaaactggggtgtatagaggttgccatgcagctagtaagtggcatccttgggatttgaacctggccaattggcttcagaatctgttctctgaagcattacactgtttatgggttcttaaaggatattaagtcattttactgttactttttgcaaatattgaaggatttttagtagtagggtgacatgcagtatgcattttagaaagctgtttgcatcaaagaaggtagaaggtggtgactgaaagactagttaaatgatttgtagattgagaaaggagttggagctaaatgtgtcattctaatcctatctaatggactaatttgtcaggcacagatagctctgttgattgtataaagagctcagcctttaatggctctttttaggtctccagattagcttcagattgttatgtgcaacacaatgcattgacacaattaagtacttgttctctggcatcatgctgcttgatataaatcctagtgttggcacttaaaagttgtgttaccatgttgtgttgctataaattgtcctttgtattcatgacacctttctccctaatcatccactttttttccacatttgataactcctttatatgtatttcttagaatttttttttcactgaacttggcgctttctgagctctcccatataccagcattgcgtttcattaccacatgacagtttgatctctctgctaagctccaaacctttgtttctagctgcttatcgggcacctccttctggaatttcatagtcacagcaaatttagtttgactaacacaacacttatgttccccaaatacttcgtattttggcgaattgtattttcattcaactggtttttcaagcaagaacctgtaatttgtaactttttcttaatcaactctgttccttctatgtccctaatagctattcttccttttgtgtattgcaattctctgctggttgatctctctgcccttaaaaacttaccccttctccattccccactgccaataccttgctacaaaggatttcttttgtcctacccgtcccagctcaacagtgtagtttgcagatgaataacacagactggatttgagaataaacaggtaaatacaggcacaatagacaggcaaaaaaaaaaaattgttgaatgcaaaaaggaatgaataaatggcaagctgccaaggaagtgcaaatatttcctcaggaaaatctttcctgacgcctaaagcaaaatcagatggtgtttctttgtgtacctgtaatcccccttgcaatttctcttaattgtcatgtgtattttaatcatggcagtcttcttcactagtcattgaccatcctgagaagagggaatatttaaaaaaaaaaattattcttccatgtggtgcaaaccaaaataatggaattatggagaggttagagcaggaatgcagtttgtgtacattggaaatgaatcttagcatataatctatgaaaattagccatgttctttgatgggaaataaatttgcatcttgtgttaggatcttctttaacgttaagaatatgtgcaaagtgtgcttaaaaactgtttttttcctttaaaaatgttttatccagttttttgtacacacatacacaaaaacatacacaatggccatatcattcagcctttttcatcttttcacccccttttctgcatattggtatatctgcaacccatattaatatcctagatttttgtttatacacgtataatccagttactagttgtaacacgtggcacattgccagattacttagaataaagctgtcacatttgaccttttcaccagcaatgtggaatgataacaatttcttcacatcttctccagcagtaggtattttaattaattcaatttttgccagctagattgggcatgaaatgatgccttattattattttaacttgtacttcctcctctacgtttaaaaactattgtctgatcattatgataattaaggaacaaactaatgaaaatgtaagcatcattgttttcttaaagatacactttgaaaactacaatttcagtatttggggtgtgtgatgtaaagactacagacctctttactttctaaaaaggatgccttttgggaactttattaaatatggcaaattgaacacattcattttcctttttcctatatctcactaaaattgaaggcaaaggaaagaaaagcgtaagagctaagatattaagagcttctggagcgaaacaatttttaaaccccaattaaaggatcaggaataaaagttatgtgggacttaccagtatcagtagtggagtctagaaaattgaggggacagtgctttctaaattctgtgtgaactgataaggaatgacctacagggaattaagcaaaaaaataaaaataaaaaaataatttcaagatatacaaaataaggaatattatgctacttttgtacagcaataaggtgggaatgtggttagttgtatgtatacatgtttatatttgtaaaatgacgctgaatagacaaaacagcttaataaaaatgattcctatggaagagaaaagacaaggtacaattccttaaattgggaagagaaactatctgactttactcactatgcaaattgttatttagatgaaaatgaaaaaaacatgtgttaaaaaatttctctcaagagcaggtgaaaccggactacagcttttctccacggactctgtttgccatgtttatttctttattcttgattacttcacactttacgcattttcccttcttgtaactgtagattttgcctcctattagttatgaaagtttaaaacccgggggagagtgggcttacaaattttcaatgtatttttgtatagtcttttgagattagagtgaagttctaaaaagtaagagaaccttttgtgaaaatattttaattgacactactaagagtttaaaatagtattggtggtgaaaaatcgttaaaagtatctgattttacttgcaaaattactgtattttcccacaagaggagtccttacaacattcttgtttttagaagggtttgtttccatcattcatttaaattcataaagataacgttttcatgggtggagaagtctattgggaaagtcataattcgaatttctatcttgctttgcagtttgctttctatgataagttgaaattattacttgatgttcaaggtagtctctacatcatcctttcaatatttctgctaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtaagttttgttagatcccaggtttgatcaaattatgtcaaggaatctgaaggaaagttactgaatttgtgttcctttcaagttgcctgtaaaaagtgatgattgaaatatgactgtttttaaccttgtataaattgtttttgctagctgacttgttttataaattattttcttgaatagtgaggtttaatcaagctaaataagatacttagatttattatcttcattgcctacatttgtatgttatcctcatttccgtgattgaatgatacttgaataaagaattgaagctttttctatcactaacatagtagcaacctacagttttctcctcctttagtcaaaactttcatcaggggtgaaaagaggctgctcactttttaatgaattttatatggtttttctttgcgttgcagcattgcttccaagaaagaatagtgtgttaggtggcttcttaattgttgtaggcattagtcagaacctgtcttaaagacctgcctcttaggttaggaggacctgttactttaaaagtctgaagttttctgaggataaatttaatcatttacagataagtaccactgtcataagtattgttttttaattaagtgacaggtgttttaaagtgtgttttactacttgtgtacattacagattttggggagattgttaaatgtaagaattctctaaaatgatagtttgcagtgtcataccgtgggctagcatatagcatgtgaaaccattctacttgactttgaactttgagaagtacacttttgatgcttatagataacagatcccaataacaccagtgcagcctgtctagttgcaaatactaacagtagaatgtttcttgccttgtttggtagaccatccatttctttcccttacttgttttatgtatatcttaaaggttgcttttttggtttgttgatttgttttacaaatgcttattgagtgtttgctatgtagaaggcactgtttctagacatatgaggataacagtgattaacaaaacacaaaactcctgccttcctaagggatagaaatacacgataaacaagtaaacaaattaattataatttgatatggtaatgagtgcaaagaagacaaccaaatgcagtgatatgatagaatgaagaattaaaaagctgctttgggtcggattgtgatgcttgcgtggagcttggagaagcagcagccaactgagggaagagtcttctaggcagagggaagagccagagtgaagacactgaggtgagcttcttgtattagaatatttaaaaggagcccagtgtagatggaggacaagacttgcccaaagcttatacagggcatcctagagtgtggtgagagtttgaatgttagtctgaatataacaggatgcaagtaagtttattctgatggattttaaagaggatcttacatatttttacaaagatttttctggctgcgggagagtggtatgtgtgtagtagggtagatggaagcaggaaaattaggaggctgtgaggaatctaaatgcaagacgatagaggctggactggcgtggtggctgtgctagcacacgaagtaaacagatttggcatgggttttagaagtggaactgaggacttcctggtgaatgggctgagaagtcaagctatatttcattcttcattgtgtagtgcttgggatttcaattaggtaaccatttatcatatgcccactatgtgcctggtgtgctcttcctcactggagttaagatacagtgtttgcttttaaactacttacttcctagtaagggagataaacttagaaaaagatggtttcatgaggcttggtagatgttataaaagaagtatgcttggggctatatccagaggaggcttgtggaaagtttccttctggaggaatactggtgattttgagttgagcggggtaaaggaggaattaggagaagcctgtttcatcacatgtagtgcggtggtgtggagattgggaggtgggggaggattggtgaagcgttccaaacaagttgggtatccttagagtataaagtaaggggtggcaaatggccatagtgtgtataggtagtaaggagtcacttcatgctgtgccagtgttcacacttaacctgagggtgacgggtgaggttggggccgtttaagtgccgtagggtctgaaggctcagaagtcagattaatttcaagtgcaacgtgggttgcagcgagaaaactccttgaggctgtcaagaatggaggccgggagactggtatcacttgattgaagggagctgtgtgatacagcagagatagagccatgtttttgcacaacttcaacaaggctcaagttgccattgcagtgaggttatccagagcagagcctgagagagtctaatcttttagggaggtacagcagtactaaaattggccattgctggtatttaacctgtggaggaggtcaccttagtcatagctcttttccttatttcccattctttttacagcctcttttggagatagagatctctgagagctcatattctggagctgcttcatcattaaaaacatttttttctgccctctcacctgattaatgaagttgaagtgataattgtccattatcttgtttttcactattgaagtttccttgaagcgtagaaatttgcctaatttggtggtttttttagatgttgcaaaaatggagatttgttattattgatcatggtctatcaaaaaaattttaactttttacacactgtagcttagtgccatatattttataaagcttgtttttagtagtagaacaattaaattgtgtcaggttattagtcatttcttaacaactaaatattcttaaatgtaagaaatttagttggaattcagggaactcatttatatgtagagtgtaaaagatgggaagtgggatggaaaagatttgttatggctaaatccaaaccttagcttaaacagaattattcaaaatgtgatacacaatggatttgtaagcacgtttactcagaatttcaagtaaaatgttagtaaagtgcctttatggttttataagccaaaaaatacaactaagttcagctgatgaagaacgggaaacaaattgcttaattttaagaaatggcaaatgttttctgttgaaatgtttactgaacagttcctcctctctactttcagccccttaatattagagtggggttaaagttagggcagaaacatagtcctggctttgtgtccctcccactcccctcatctcattactcttgttgcctctggcagtttaaaagctgtagttatagatacgtcactgtcgctcccttcccaccattttctgtggtgacacagagtaatttataggtagagcttaacctcaataaaagctgcagtgagctaaataataaaaaatttcaggaagctttttcatctcaaacatttttgagtccgagggatgggagacaacttggtcgtgaaatcagaatggcaattgatatttagataaagaatcagacataaggaaaaagctttcaatatattattatccacagtaaagcaaaattgaaattgcagtggggatggaggtctgtaaagttaaaagtaaggactatggggtctaaaatggctattttataatattgattatacataaatgtataggaatgcaaaatttattttcataagcataaattaaaaggactttcctaaggtggtactctgaccatgtaatcacatttttgatctttcatcccaaggaaataatcagaatattgtcaaagattcctgatgtttgtttcagtatcattttttccaccagtccattggaatctgtattgtttttaatatgaattagaaaaaacccagtcctaacctttagtttctttaataaagaacacttaagcttattttataccacaattaaacaagaatagcgaaagaaaagtttatgccactctttataaacatagatgcaaaagtcataaataaaatatcagaaactagaattcagtggtttattaaaaacaaaaccacaaaaacataactaggcatggtggctcacgcctgtaatcctagcactttgggaggccgaggcaggcagatcacctgaggtcaggagtttcagactagcctggccaacatagtgaaacccggtctctactgaaaatacaaaaactagctgggtgtggtggcatgtgcctgtaatcccagctactcgggaggctgaggcaggagaattgcttgaacccaggaggcacaggttgcggtgagcccagattgagccactgcactgcagcttgggcgatgagcaaaattccgtctcaaaaaaaaaaaaaaaaaaaatgtctaggtaatgtttattgtcattcaaggatgactcaactacaggaaatctattagtataagataccacataatcatatttaagaagcactttatgatcatcatggatccagaaagggctttctataaaatttgctattcatattaacaaattagaaataagagttttcttagcttgataaagcatacttctaaaaatgttaacacttaattatgaacttttagagattaattgaccaaatttttagtaatgagtatgggtgacccagaaaagtcctgtatttttttttctagtatttatatataaaagtatatcacttttatagtcagcacaattaaatgtttaaataggacttttgggcaatttaattcgtgtctatttatgacaagactattcttgtcttttttctttgaagtcagttttttctgttaaaaggcaattctattttttttagcattctgatatttgtatgtttatgactgtttttgccttcaaaaagtgtatttctagccagacgtggcagcattcacctgtagtcccagctgcttgggaggttgaggcaggagggtcacttgagcccagaaattccaggctagtgtgcagtgatcacatctgtgaacagccactgcactccataccgggcaacatagtgagagtctgtccctttaaaaaaaaaaaaagttacttaaaaacataaagtagcatgtacataactgaaaaatcaaccatgattatacggtggaaaaatcagtctccctcccacccctgttttttcatcacccagttttcctctgtagtgaacgttgtattactagttcctcatgtgtccttccaggatgtttctttttaatgctgccattaacatttggattttgttttgcctcttagaaacgagacagagttttgctcttactgcccaggctgcggtgcagtggcgggatctcggctcactgcaacttccgcctcccaggttcaagcgattcacctgcctcagcctcccaagtagctgggattataggcatgcgccaccatgcctgtctaattttgtattttttagtagagacagggtttctccatgttggtcaggctggtttcgaactcctgacctcaggtgacccgcccgcctcggcctcccaaagtgctgggattacaggcatgagccaccatgcccggccacctcttacagacttttaaacatcagagtaattagtaactttatgcagactgtcttggaatagagcagttgtcattaaaaaaactgtcatcttttatttctaacctcatgttcatacccttttgcttctctaggtaaccaggaatagctaaagagaagtctttttgaacccaaactgtagtattcttccattcttaagcaactgctttttcataataggataattctttcttctcattcatacataggcatgtgcgtgtgtctgtctgtatcgtaatatgtatgaaacactatggtggagggaactctgaatttcaagtttgataacctgtttttgtgtcagcttctttagtattgatgaatgtagatcctagggaatatgactgtactttttttactgttcacagctgtgaaaggcagtagtgctatctgagtactttcacagtatgacttttgggtccattgaaataatgtaaatgagcttcataagctataaaacattatagctaggaatatgatttattggaaatattcagatattctaggtcttcgttctctatttttgtttttcaggagaactcacattaaattgtagacattaaaatgtattgtctctgcttagaaaaagtttttgccaggcaacattgcatgatgtataatttagtttattaaatgtataaaatttgttgataaagtcagagcaataaaactttataaatatgaattagaactttgaggttatggggaatagggaccttttatcagccttatcatccagtttgtcatatacagtttataaatgtgaaagcacttgtgatgaggtcaagtatcacgtgaaacacactttggaaggcactttgctaagccctggaccttatctggtgcctacatttacagttaggtattttgagggggctcctgctccaggacctggtattcaaagtcccttgtgtatatggtatattcttgcatggggcatttttatcacttaccttatcagggaaaatacctacctgccctaggacctttgtccctttataaaaattactgaaattatacctaaattaatcaatttctgtaattttatcatgtaacacctgatgcaatgaacaatataccctcttttcttgtcctgtttaacatattagcttcaggaaagagtcaacctagctaaaataggcatttaaaaaattacagtaatcttttgttttcccaacatccttggtctgtttccagtccttttttttttttttgagatggagtctcgctctgtcacccaggctggagtgcagtggcgtgatgtcggctcactgcaagctctgcctcccggattcacgccattctcctgcctcagcctcctgagtagctgggactacaggcgcctgccaccatgcctggctaattttttgtatttttagtagagacggagtttcaccgtgttagccaggatggtctcgatctcctgacctcgtgatccgcccacctcggcctcccaaagtgctgggattacaggtgtgagccaccgcgcccgactgtttccagtcttacctggaaccattctaggctacccaggcctttttttttttaaagtatttaccatccagcccaaaatgtcatacccaggacattcttatgtgactacattctgggaaaaaccatactgtttactccttccccttcctgtcttgtagtagagtccttccaggcctgtgtggtcctcactggcaatataagtaaatgtatcactatccaaagtgcctgagatagacaatacccacacatggactatggagagaggtgagataatagtaaaacagcagtttaggatatcttgctttaaatcttctgttgtacttgggctaaaatcagaacgtctcttacagttctgttgttttcatttccttttttttctttttctctttttcaatttagatattttctgttgatctacttttgagtttactgatcctgtttttgtgctgtattcagtctgttaagcctacgtaagttcttaatttcaaatatatccttcagttatagtatgttcctttgatattatagaccccaaatctgttgaaattctccattttgtctatttccttaatatatttataatagttactttaaagtcttctgtgtggcagttctaatgtctggatcatctgttggtctgcttctgttattgtccattcttttctttctcaaattttcctgcattttcatgtcatacagcttttattgtatgccatatgttttgtacattatgtaaaattcactcataaagatcttgcaaataatgctctccccagagtatttgacctttcctacctttaccaggtagatagagagaagctccccttaatctaattagcgattgagctgggtggggctagactgccattttaatttggtttagtctgccactggattatacctttcctgcaaacagcgctccagggattttgattgaaagcttgttagactgtcacctaacccctgaaacactgggagattcacttctactttttcgaagtatgaggtgactttgaaagtatgagctctttagcctcagctttaagatctgataagcgtcttgagggggaatactcatgtgactgtcaaaagttctactgttttattcctcagagcttcttttctcagaccaagcctttagcctgcacctagaatctacacgtgactccaggggaggaagtgataggcatttgtcagttcacctagaaagctgctttgctgcagttttagttcatctggatctcattagtttgatagctctccattgtcttttgagcaagttttttttttttcccttttttcccctctagtaagaacattggactgctgtgacctgcttatattttacctggagttggaactatagcagaatgttataataggaaatgttctggtatttaccaaatctggtatttaccccaaatctgagaacagtagattgccagtaacctgcattcaaaattgaggtgctatagtgttcatgcagaacatgcagaaaagacaccctgagtcaagcattgctacagttaaaacctgttactcacctgtaggctgtataaagatcgtgagttcaagagaaggaccccatagtgaaaagatttttggcgagagtagtatatgttaaggtatttctcccttttgttaatccaatttgaaggacttgacgagaacttctcagtttgacatgtgtctgctgaggtttgagagataaatagactggtacttgacttctatctgaaaaagcctaaaaagtgagataaaggctggagctgcccctgtatcggtagaatgaagaaagggcacaatgggagtgggccagcactttgtcagagtttgatgggtcaaaggtggaagaattacccccatggacaaagtagacgttagtaagacataatagttgaagttggcttaccttgaaaggatcaagaggccatacttggttgaagggtcacagtgatccaagcagacaagcctgagaagttcctgcatcaggaactaactataggtgagagtctgcatttggacttccaacctccacaggactccatcacacattactgtcacatcagattacagtccagccagccacttaagatcgtgccccttttctctcagactccctcttcctgctatttcagaaccgggaggggccttaaaaataatagctggagagtactggaagaggtagcgtgaaaagaattaatgagatagtaagattttggctttgctgtggctggattttaatttctgaagacatttattgttaatacaaatatctggatatgactaggaagtgttgaaatctttttgggattttgtgcagacaggataaaagcagcttgggaagagcttgttggagagcaatgactagagtggtggtggaagggagctcactaagtctagtttgtttcatgagctgtctgtatcctctttttgaaaattgagaattccaaatttagtggttgctggggacaggaagaatatgtggggagaaaagagggatgttacgtgtgtctacgtgaaatacatgccattttaacaaaagccttttctttttttttttttttgcatataatcatgatactggttaaattagccagtgatgctttattttcaaagaaatgttacaactacagttttcttctattatcatcatcgttttccttgaagcggtaggttagtctttactctcaaaatccaacttttaactctgactttgggttatgatgggaagcgctatgaaatggtcttggtgctcttatgaaactgtgatcactaataatacttaaattagaactgaaatatataaggagacttctcactaactccttcaccccagccttttgtcttttagaactttgcttatctttatggttagatagatagatagatagatagatagatagatagatagatagatggatagatatagatatagtttctctgaaatttgctaggacaacggggtttgggggcaatgaaagaaggttttatatttatgtttaggatgatagggacattgagagatactgaacacaaatttataatgaagttaagtaatttaaaagggttttcctgtaatttttatatgatgccttatataatttgcatccacaggtataaaacattaatctatgtgcttaaacatttgcctaaacattttaacatgttatctaaacataacctctatgcataaaagcagtttatcacattcagagtgctatacagatttgagttgatttttattttgtgggatgctaattgtcaaaaattgtcagattataaaaacttttacaatcaaagtcaagcattataaaactgtataacttaaaaagttgaatttcatggaatcacattctgtattgtaatcattgttttatggttgatgtaaagtcatcccttggtatccttgggataccccatatctccaaaatttggagacgctcaagtctcttatataaaatggcatagtattcgcatataacctatgtacatcccccaccatatactttgttttggaggcagtggggagacagcgtctggctctgtcgtccaggctggagtgcagtagtgcagtgttggcttactgcaacctctgcttcctgggctccggtgatcctcccacctcagcctcttgaatacctgggattacaattgtgtgccaccatgctaggctaatttttgtatttttggtagagacagggtttcatcatgttgcctagtctgatctcgaactcctgggctcaagcgatctgcctgcctcagcctcccaaagtgctgggattacaagcgtgagtcaccatgcccagcctgtattcttcattgttgtattgttattttatctagtttttcctctagtattttctgtccatggatgtggagcccacatatacagagaccaaccatgtattccagattttatgcacttattttaagattagaataacatgtacttatattttatatttattttgtcatttatgttactatttttctttttaattgttaaaaacagtatatattggccagacacggtggctcatgcctttaatcccagcactttgggaggctgaggcaggtgggtcacttgaggtcatgagttcgagaccagcctggccaacatagtgaaatcctgtgtctattaaacatataaaaattagctgggccaagtgtcataattccagctatctgagaggctgaggcatgagaattgcttgaacccaggaggcggaggttgcagtgagccaagattgtgccactgcactccagcctgggtgacagagactgtcttggggggggagggtatatgtgtgtgtgtgtgtgtgtgtgtgtgtgtgtgtgtgtgtgtgtgtgtgtgtatatgactaaatctagaaaatcgataagctatgttattaaagtaaatgtacctgaaccctttcagtgttagcttttgttttctttaagtaaaaagtttgtatttggaagggcttgaaatacttcaaccatttttagaattgatatttaaatcttttcagtagtagagactattttgtgtgtgggagatactttgttttttcaggggcagcagaaatatcaaacggtatctcagagtagagtttttaataacagcatttggaggtggaggtggaaaatattgagaaagtttttttcaatcatcacctggtccttcttctaagaaaggctatactatatcaaagatgagtagaagtgtcaattttattcttataggactgtgtgacttacaggagtgtgattatggaagttctgttgtctccgcctattttttatttagttattaatatttggaaacctaagctgcttattttaatttggaaggggctttctcaatttacttgtccaaagaaattttctttcctgagaaaatgtctcttacagtgaaatcttcagtttttataattaaacatgttgtgtaaatgttttacatacctgggatattataccagttttattgttttagctttgatttgctatgtttatattacttgtttctttttagtaactatatatggggcggaataatgttaataattaaaaatgtggcctctgtctcttccacttgctggctgtaggaccttagacgtgttactttgtgtttccattacctcatttgtcaaatggggacaacagtgcctgattcatggcactgttgaaggattaagcggtttaatatgtgtaagagcttggtacatagttggtgcttaataagtgtgaactatatgtgggatgggattttatatataaaatttgattttgaagtgaaactgatgatgtcacctatattacatgcaccaagagggcatgaaaaggtttattactcacataatgatgctgtctgagtagagcatggcaggcttccaagttggtccaaaaatgacttgagagagcagtgataggagactggcttggggttttatggtgattagggaatggggctgtgggctggtttttacactgtacatatgctgagacttgcctggtttgaaatttctctaatatcaacaggtggagcacctgggctttcttaccagcttgcccagattcgaggcagaaggggaagaggaaatggtggggcttgaaacctatcagcagtcaagtatcagaaatggagttggatttcttattcaacacaaacaggataaataaaaagaaaaccacacttagatatatcatggtcaaactcatgaaagagggaatcttaaagcagctggtgaaaaatggcacgcagcatacaaatgacaggtgatcagcaacagagaagattgtaaagtgatatatctaaatcaccaacatcagggagtcataacaataaattgtatctgcttaataaaggaacttaaaaatacatgcagcaaaactgggtagaattaatgggacagaatcacaaatccacaattggagagttcaattagaacaaaaaaatcagtaaagacatagaagttttaagttacattattaagttacattattaactacctacgtgatatttatagaatactaaacccaacatgagtagaaatacaagcgtttcaagtgttcatggtaacttcaccaggaaagactgtttacagggcacaagtctcaatcaattttaaaagattgaaatccaaagtatgttctctgccaccaatagaataagaaattaataccaataagacatctgttaagaattggaaattaaaccttaaaattctgacttatgggttattcaggggaaaaatgaggtaaaatatatttcaaaccaaattataatgaaaatacagcatatcacatatgtgggatgtagctgaaagagtgcctaatggaaaattttatagttttaaataatctgctaggaaagaaagttacctaaaaagataaaatagaaagtaagtagaaagaagaaataataaaattaagagtagaaatcagaaagccaaaagcgagttctttggagagataaacgcttgttagactgatcaagaaaaagacagagagcccacaatcacaaatgacctatattggtactgaaagagggattgtcatggtaggtcctacagacagtaaaaagattataagcaaatattataaacaattttatgccattaaatttgatgactaactgtaatgatgaaatttaggttacccccagctgatgcatgaagaaatacaagatctgggtagccctataacaatgaaagaatttgacttcataatcaaaagctttcctgcaaaggaaacttcaggcccacatggttttactggtaaatttaagcatttgtgcaacaaatatcaccaatcttatagacaataaactcagaaaaatgttgttttatgaggctcacataaccctgaaaccaaaacctgacaaagatgcaactaaaagaaaagttaaagattaatatatcactaacatacatgagaaaagaatacatcataattgagttctattccaacaaggttagtttataactttcaaaaagtaatcagtgtaagccagccgcagcggctcatacctgtaatcccagcactttgggaggccaaggcaggaggattgcttaagcctaggagttcaagaccagcctggtcaacaaagcaagaccccatttctatagacagataaaattacccacccaggcatggtggcatgcccctgtggtttcagctactcagaggctgaggcaggaggatcactcgagcccaggggttcaaggctgaagtgagctatgattgcaccagtgcactccagcctgcatgagacattgggaccttgtcccccacccccgaaaaaagaaaaattaatcaggtcagatgcgatggcttatgcctctaatcccagcactttgggaggccaacgcagtaggattgcttgagagttaaggagtttgaaaccagcctaggcaacataagactctgtctccacaaaaaaaaaaaaaaaaaaaaaaaaaagccaagcgtggtagtacattcctgtggtttcagttatttggaaggctgaggtgggagggttacttggacccaggaagttgaacctgcagtgagcagtgatcacgccaccacactccagtttgggtgacagagcaagaccctgtcgggcaaaacaaacaaacaaacaaaaaaactatgtaatttactgcattaaccaaggagggaaactataagatcacctcacttggtcaaaagcatttgacaaaattcatcatccattcatgataagcattcccagcaaatgagaaacaaagagactttctcagtctgataaaaggtatttaagaaacactaacagctaaggatttacttaatcatgaaatactgtgttttccctcaagaacaagacagggatgtctactcttgtgtccttattattttaatagaagacctagcaagcgcaatgagtcaggaaaacaaaatataaaaggtttaaagatctgaaggaatgtttcaaaattctgtttgtagatgacatgcttatttatgtaggaaatcctaaagaatctataaatatagccactaaaacaaatgagtaaatttagcaaggctgcactttatagattcagtgtctaaaaatcaattgtatttttgtaaatactagcagcagacaaataggggtgttaagaaaattcatgaatagtagcatcagtactaaatacttaggaatacattaaacacacacacacaatgacctctgcttaaaatgctgaaaccttgctgagagaagttaaacaaatgaagagggagttgtgattctcatatggccaggtatgctcttaccagactgacactccctcaataacaaactgcacaaaattctaaaaataacatgaagtactggagaataaacaaaaataggcatgttttagaggggattgacactcggaagaaggaaatggcgtaggcgaattttctgttttacagcttttgtccatgcaaagtgtgcagggtaggtaaaattccaacacaaaaccaagtctttctggccttgaagcaccataggtaagacttgggagaatcacaactattggagagtgaggagtgaatatcagcaaggagagtttcagaaagagagccctggattctgcctacaaactttgccaaaatcacctgctgatcccacatgtgtacggtagacagtacagccagataatcagcctgatttgaattgctccaggacagagtttgtggtttgaatgcaaccaggttagttgtctggtgaaacaaaaatgaagacttttggaagattgtaacagaacctctaactaccatcagataaaattcacaatgtctagcatacaatcctaaattacctaacatacaaagaacaaagaaaatgtgaccctttataatgaggagaccaaccctagaagacctacatgttggaattaccatgcagtaaactgatggatacacttgtgaattggaaaactcagtaataagttagagtacttaaattaccctgacttcaagactcaccttgaagccatagtaatctgtatagtgtgatactgacataaaaacagataagatagccccacatagataaacactgtgtgcctatatgattttcaacaaagttgccaaagcaacccagtagggaaaggaaagtctttcaacaaatggtgctggaacagctgaatatccatgtggaagaatgaacatgactccaccttacaccagtgaaaacaaaatatttctggataaattgtagtctaattaaagctaaaactataaagcttttataagaaaatataggagaatatttatgacttgggggtaaacagagaattgttcaaagtatatagaaagcagtgaccatgaaagctgctaagttagactccattggtatacaaaacatattattaaaatacattgttaaaaaataagtcagagtgggagaaaatatttgcaaaacatttctgaaaggattgaatctagaatttataaagatttctataactcagtaatgtaaagatagcctaattttaaaatggacagtagttggctacttcactgaagataaaggtccagtaaagaaatggaaaaatgtgtaatatcggtaggcttcaggaaaatgacaattgaaaccacaatgaaataccactgcacaatcatcagactacctataatttaaagactgaccacaccaaatgttgatgaggctttggaataaccaggagctctctctcatacattgaaagagggaggactgtaaaatcgtactctggaaaatgatctggcaatttattgaaaagctaaacatgcatctatccactgactcaagattttcacttctaggtgtttacccgagaaaaaaagaaatcatatttctatataatgatatgtactttcttgaatgttcatgacaactttattcacaataattaaaacctggcaacaggtcaggtgtctatcagtataagaatgactaaataaatcatgcttgttcaagtaatggaaaacgactccacacacacacacacacacacacacacacacacgtcatatacattaacatggatgaatctcaaaatcatgctgagtcaaaaaagacccaaaagaatatgtaccatattccattcatacatagactttccagaagacacgacacctatggtgaaaagatcagattagtggttgcctctggggatgagcgcatggatgccagacattgagaaatggacatgggtgatgatcttgacagggttgagaagtgtacaatgtatgcatctgagaaaactcaaatggtaccattaagatgtgtgtttcatgctgtgtaaatttaacctaaagaaaaaaagaacagcgaactctagttatgtgcattcttaagtgtctagatttgtgttatctgcagcttttatttttctctctgagacagggtctagctctgtcattcaagatggagtgagtgcagtggtgcagtctcactgcagcctccacctactgggctcaagtctcggcctcctgaatactaggagcataggtgtgcaccagcacacccagctaatattttgtatttttgatagagacggggtttcaccatgttgcccaggctgcccacatacacccttatttttaatgttccaaaaagtaagggatggatagagaggttaagtagatacatgagagagcaaaagaaaacaaatccaaattacagaatttagctgatcaatgtgtagggtgcttactcgtaactttaatggatgtttgaaattttttatcatacagaactcaggagaagatggaaagcttgttcatggaagtatctgagaagttggaataaatacttagaaactgttgagtttttcttttctgagatattcctctccaaaagtttgcttgattctttcgttttgttttgttttttaagatgggatctcacggttacccaggctggagtgcagtagtgcgtcatagctcactgtggcctgaaactcctgaactcaaactatcctcctgcctcagcctcccaaatagctgggactgcaggcacatgccaccatgcctggctaattttttaattattttgtagagatggggtctcactttgttgcacaggctgtttgcttgattcttaagaacgtatagggatccagctgtacagagctttctgcagtcttttgtaatagaattagttgttaaaattgtacttattacatgagcatcaaagaccttggaataaagctattcctcacatatctggacattatttggacttactatgttaccgattaggaagacttggtattagtttattttttaaaattctgtttcatgtgtgttcttataaaattatacaaataacagtaccacaccattgtgtggtgagctctacttagagctctgtacagcttgggtatctggaatgtagacatgctctgttctgatttgaaacttagaatgaaaccctgacataccggaatgcacatttggtgactgtttgtttttgaatggttactatttcattgctacaagataaaatcgaaaaacattttctacacagagtgaaggtttaagccagttaaggaccctgttaaactgtctccagatttaattactgcccaattatgccttaattatgaaggaatgtgagcacttattagctattgttgatgattcaacctttttgaaataaatttcttaatatatttcttttatattttcaatttttattcaggaatatctcaaattttcaagagatacagttttttgcatctgtaatgcagcaacttaaaaaatcatttgcacctacttatttctcaatcaggattgtctacattttgcaaataaaatatggggaagagactggattctgaggcaaataaaaggctatcattcttaatcattgattaaaaatttaagtttaatcaaagtagtcacattgttttcagtgatgtgataaatgacatttaaacatttgtaattgaatactacaatctattttgtgtctttcaattatatttgtagtcaagataaaatatacagccacacatagtacttgtaattatggagacttaaaaaaattattacagtgattaactcttcattcctgagctgtttaaatctaaacttttagtcttaagtcacatataaaaatgaaaggattattttaagtagaaataattatggatgcatagttacagattactcccctagaagtctgtattaaatgagtagatcagtaatcaagagctggagccttaggaaagttccttttgttgataatattctgctaattgactaattttactgagtgttcagcatgcttttaatcttaccaaggtggcaacttaggttgttatcccttttgatttgttaaaaaaaaaaaaaaatacactgtttaggcaagaagatcatgaaaaataataaattagtaaaacaatggggtttattacttttgttattggttgtctaactgcagcagtaaatcttgcagatatggtaggaacagtaaaactggtttaaagggttaccagattctgtgatgcgagccaccttttgcccaaagttggtagtgttttcttcaacttaattttcactgcttctcttttctttctccataacaaagatgtgaataaatatctatatccttaacgcaaaaaaagtagtaaattgaccaaacataatatctggataattggaacaaagtgcaaaatgttaatttagatgtgtatatatgtaggcgagtgtatactttgtaaattgtacactagatattaaattttaatttcagttttcaaaagtcagcttattcttagatgaagaaaatctttgatgtgttttactgaaatacttattgtaaaagttattactagggaaatttgataaggatttctattaggtttattaccaagtcatcctgttagtttagtgattaatatactgtatgccaacaaaggtagttgctatattagtatgtttatgactttaatagctgttttgcctctcctccccacctctttttaatttaagctagatatataagcaagaacattacacagttgatgggggataatctgtctttaagaaactgttccatgcaaagaactttgggactttgcgtgagataacatacgtatgcttgttcatctgtatattgatgcagggacatcattgtagttagttaatggtctgctacatcttatttcaacatattgtaatatttcacattaatttgttagtaaacagtatcaaatttgttcaggcagaatttatgagaccaatttttgctgatatttttcaatacatgagagttttaagaatatcctgaagttagatggtcaaataaatttaggaaatgttgagccaatgtgtttgggatattgctatcattgttataataacttaataatctctttaggatatgttgattttacatagcaagtagtcttagtttaacattttcagacctattttctatccttagtactttgtaaacagcttgatgttgtacaggtttctgtttttcacatttgagtaatgtacagacatttcttgtggacttcctttaatattatttaaatgtatagaaacatacttaagtgcaaacttaacgctaaccaaaagacaaatttatactcagttatataacccacaaaattccaattaacatcaatttaataggtgatggatactatttttacataacttgcaggttactttgaggtccctaatccatttagtcttacacagtgcttgatataaagtagctagcttatgaagacaattgtcattaaatatttgtttgtaagatgcacatttttttcactttgagatgccccttataaataaaattgaaagaggattttcaagtgttacacaaataatgttgcattttaaagtagataatcttagattagtgaaatttattgaatgtgtaaaaagctttttatatagttgttataatcagtgctacttctctaaaatttttcctgcatttgtttcttttaatattttttagaaactggccatacctagaagttataacttacactttttattaacaaaatgaaaacctgggagatacagtttttccccagtgttatttaggatgttatgatttaatgtgataaggaatattataatccacttttgtactatgaaaataccagttgggtcaccaaatatgttgtttgctgggtggtacacaaagggctttgggagctcagggtgttgttgggaaatacattgtggttagacagaatctttaaggaagagtgggtgattaaaactgcctcattaaaacctaccaaaggcatcttaaaaattgacctcgtttgttagacttattaaagaattagtagtaaagttaaaaggtggctaggaaggggcagttaacataaattgcacatggaagaaaattggtaccaaaggttcatgtgagacagaaaggacattgtgtgagaaaagaatgatcagggctcaggctggcatgttattatttgtctcttatagtaatgcccaaactgcgctttaaatgatgcagtataggaagtaatgtgcctctaatgttttagaaccatatctttttatagaagtgtcaagatgacattgacttgcattttattctctggcaatattttcttctgttttatttttacaattttggtgaaaggcaatatacattcacatggctcaaaaatacgtatgtttatgtatgtatacacatacaagcatgcatatacacatacattggaacctctcccttcccactctgcacctcaagtaactactgtccatgatgtatgtgtgtctttatgcatatattagtgagtaattacagatctttttacctgtccttttttaatacagggagtagcatattttagacctttccatatcagttcatagggtgccttcatcatatgctaaattgttctatgaattttttgttgggactttttctgttttggtttttacttttctttgcattcttttgtgtttttccttttttcaggtaaattttttataggtgaagtgcacaaatcatatattcagtttagttagattcaacaaatgcatataccagtgttttaagataaagaaatttcaatcatccagaaagttctttcatactctttcctagcggttcttctggaaacaattactgttgtttttcactttgaatttgttctgccacttctagagcttcgtataagtggagtcattcagtgtagatactttagtgttcagcttctcttgatcagaatattcccaagattcatccatgggtcagtaattctttttcaagattgttttgctattcaagatccttagtatttccatatacattttatatcagcttgtcagttgctacaaaaatatttttgctgaaatggtcactgtaatagatataaaacaaataggcaacaatcattagggaattaggtcagatggacatcttaatattgactcatctgtgaatatgctgtatctctatatacttagcttttaaaaaatatctttgagcaaagttgagtttgggcagagttcacagtcacattgttgatgtttttcccttgtgcctctttctttacagggtatcttccttcttttttcaaactctctggcagccccaaatgtgtcctctgattctaggtcagtaaaactgcagttttctaaaaacaacccccctgcagtgttctgtttgaattctagttgccctgcctagctgtggctggggagtgcccttgggtacacagccacagaaatgcagctctcatccagtacagtttgcagctttgacagttggacctcccttcagcttttgtctgtttttgatctgtgtctgctattttcaaatagttgattattttgttcagagtttatcattgttatatgaaggaaagttagcctaattgaggctgctctgccattactggaattagaacctccattctgttttgtgtattcttttactaattgcatactgttttaattattgagaatttattatgtgcttcagaatctggtaggacaggtctttactatttgttagaattttctggtcatacttatttgttttggcttattacagtatttggactaatacctggatttttaaaacatttatttttattgagattgcatcaaatatataaatttggtagagttaatacctctatgatggtatcttcctgtgtagggacgtatgtttttcttttttgctcagtgcacttttgtgttctttagttatgtttaaaatgtttctttgtatagtttgacacagttttaattacatttatctagatgctgcttatacaactctcactatctaagggggattggttctaggatttcccactcataccagaattagtggatgctcaagttctgataaaaaatggcattgtaagcctgggcacgttgacttacttctgtaatcccagcattttgggaggctgaggtgagaggatcacttgagtccaggactcaagagactttgtctctacaaaaagtgttaaaattagccaatcgtggtgacacacgcctatagtcccagctactcaggaggctgaggctggagaactacttgaggctgggaggtcaaggccgcagtaagccttattttaaaaataaaatggcattgtatttgcatataacctatgcacattttctcatactttaaatcggctgttcccaaccgttttggcaccaggagacagagtcatgaaaggcaagttttccactgaccgtggtggtgcggcaatggttttgggataaagacgttccacctcagtcatcaggcattagttagattctcttaaggagtgcccagcctaaagccctcgcatgtgcagttcacaatagggttcttgctcctatgagaatctaatgccactgctgatcttccaggaggcagagctcaggtggtaatggtctctcccctgctgctcaccttctgctgtgtgtcctggttcctaacaggccgtggaccggtatcagtctgtggcctctgagactcctgctttaagtcatctctatattatgcataatatgtaatacattgtaaatgctgtgtaaatagttgttataccatattgtttttaaattttgtatttttcaattgttgtattttttagttttaaaaatttacttattttttctactttttgatccacggttggttgaatccaaggatgtggaacccttggatacagagggctctatgttttattataaattggcttattttaaaaaatattttttattatgtaaacaggcaatgattttactagctagaagcaaatttaatgttttaaaataaaccttccaattttgttaggcatgataatgatggaactgaggcttaaatataccctatggcagcagttggaaagtggccgaattagggttggggtctagatctgtctgcctctagattgattgcaagttcttaacaattactgtttattcttctctgattcctttcaaggattaaataaagtacaatgtaaacttcatgctctattttagattctggttctcatgtgagtcccagaataacttgagtgaaatgttctgatacagagcagaatagcctcttgtgctacacttttgttaattattttcaaagaatagtctcctgtataccatttctttaatagactcagaagtctgtagaattgaggtgattctgttgtgatttaaactacatcatgctatatgtttccaatagatatttgaaaatatcttttaaataaaccattaatgtcatggtttttaaatcagtatatctttggaaaaaagggaaaggtctaagccttaatttacctggctttttctggcttttatagtctggtaaattttgcagcctgaaaaagcaagagaatctataaaatacttgaatgagatgctggaaaatttcagaacaggttttgttttgaactgtcgggtcactgtagcccccaaagcagggcatgatgtgttcctgcagcctgatagctatgtgacagcacctgtagtactaaagccaaggatgccaggtggttctgttgcctggccacaggaagccagcgcttctcaccattgccctttgaactgttgatccagttaagctcactaacaatgtgtaaatatgaaatttaatcaattgcttgattcattttcaaaagatgttttgaaatactcctttatccgcattgaagttttgatgattttgtaatatgtaagaaatggacttttcagaaaagtacaacttagtacttgagacattggctgtcaaagttccattccaaaacttccttttaagctctctttcccttctctcactgaccagaagttactatgaaatgaaataaaggtagggaaaaagggagaattatctctgagctgcccatattctggagagaaatgtgggagaaaatttttaaggtggtatactaaattagaatgacttcaaagtctatttctttatttattctagagatgagaacaaaataattttcagtaaaacttaaaaatatcatgaccagataacctgaaaatcttaactgtggatgcatgtctatttttattgggatttttttctatattaaaaatcagttgacatctgtttttagataattttttaaaaaactggattataaaatgaagcacttagtaaagctgatggcagaggttttagatcttttgaatacaggaaagtggtaagggcattataggtatgattcattgagctagagggcgttggtgttcacattttaaaaacataatcatgacttatctggagtcacatgttccattttattggcttccttcatatagaaaatatagtaaccagcactacatgcctgtgaaaaagtgaagcaattgtatattttctgggtgaaggaagtattctgtacattctccatgttttacatcatggtattttgaataaccatgcttccatgttcacatcaattttttgtttttcaatttatgcacagcacttgctctgaaatttggggactgagtacaccaaatacgatagatcagtgggatacaacaggcctttacagcttctctgaacaaaccaggtgaatattctgccctctgtcgaatcttagagatcttgtgggaggggggtatattttgaaagacctatatggggttgcttagtataattttgcctaggatgtttccttaatgtaaaataaggcatagcatttaaaatatctgcttgccagtataaaaaatatattaaatgtttcagctgatgttttaatcaatgcaattctagtttgaatcttctttaaattactgtatcccctaaagaataataattttgataactatatatttattttagcttgagatcagattataatctgttgttggcctaatttttaagtagatacatgatgagttttgctaaatttcttgttatcagaatctcatctttatactaataaatacatacttaatgaaccccttatatcacaattaacagtaggttaactcatttttatgttactttttttaatcacttcattttcttttttgcgtatatggtatttgttcatttcatctcatcatattcatcaccatccacatttatttgtgaactacataaatatacctcagttctcaaaacagtcacaactgggtaaagagttgcagtagtctgaggaagttactatcacatcattgttggtatttatcattcttcacactagttccttttctgactcttcagtcacctccagaattaatatccttagaagcatctctaaaatgagtttgatttactaaacatagaagttgacaaagtttttcaagtataactgcataaactctcttttttaaaaaatcagtttttcccaagttgttagcctttcattggcatttgagtcatttatgtgacatatttataagaaacatctgctagtgctgctgcatacttttatcagatccattaaatagtacatttttgttcttgattctcactaaaactaactaaatggctgtcattcttttctttatgcttttattgtactaatttagcccatttgactgcacttttttttttttttttttaaagttccctcctttcttttccccttgcttcccaacaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccaggtaggaatattgcaagtttttttcttggttttgaattaaatgcctgaacttcagtatatttaagtactcttgtgacccaggaaaattttagtgtaaattctaataaattaccttaaattgtgcatattatttggtggtaattaaaatttttttatttttaaaaatttttaatgagaaaacatatctgtttcttggaatagcatatgatttggcatgaaagtgcatatccaggaaatcctgtagattggcagtctgctcagcgctatgctgatgtgcttctacatgtccctgctgcagtaacattttcaagcattttgcacttggagtgcttttagaagtactttaatgacatcatttgtatgtacaccgtttagtaaagcttgtaacaagacttttcatttagttagctgtctacctgaaactattaaaaaatatagcagtagctgcgtttttggaaaatttcctatatctgattttacagataaagacaatgttaagttttccaatggggatttatgaacttttatggtaatataatattaccaggatcacattgttcccaaaagtttgagataaattagaacttggaaatttggataatagactacctaagttagagccataatcagatttgtcattttctcagtaactagtatatatcgagtaggtggaccctagctttaaaaattaagctacaacttctcttcttgttgaaaactttaaaaaaggttcccccactcccctttgctctttgccattaacttggatttcttgaactttttcagttttgcctccagtattagtgccccgacacaccgagatcctaacagaacttccgcctctggatgactatactcactccattccagaaaacactaacttcccagcaggaattgagccacagagtaattatattccaggtatttttgccttctgaatctcctaaaacttggatagatacaaattttgttcataagcattcaagttttagtaaattgtggtttcacttttttaaaaatgcttttgagtttttaatagaaaaattggattcgttgggtgattattttgtgaaatgtataagcctagtacattaaacagttttgtttggagaagagttttactttatatttcattttcttttgcagtgactttaatcaaagtactgtgagaagcagaaaagaaaagatcttagtaagtttgtcttagttgttgaagctaagcgagatgcagaatgtaagcaaaacaaatggtgtaggagaaaagtaccccccaaacacatgtaactgaatatccacccaatgatcactttttcttagataacttggtaatatttaacagaaatataacatttctataagaaatataatacttagttctatagacatagcaacacttacatattataacacgaacgtcagaaaacctcctttaattatgtttcgtctgcatctcagtaatttctgatgaaaattgaattcagctacatggttctcaaattttgttctgatgtattatgtgatccagtaatactccacgatatgatatctggccttttcgttttttatggtttcttttttttttttttggagaacaactaatactttgttacttttcttgtatgttttcctttttgtttggttgatttttctccctagcagaaacagcatgatgttaggatgaggattaagctgtagtgtctcgatttctttcttccttttgtaatattcttttattccactcttattttatacactaaaaatatgtaaggaacttaagagcatttacaaaattcttaaaatacagttttagtacatttaaacaattatttctttcatgtatccatcatggaaataatgcttattcattgaagataattttttaaatgtaaggaagaaaaaaaagaaaagataactaagaaagataagttttttttttaaatagctggttttacaaatgggaagtggtttttgattgttttaatgtatatttctttgattactgttttattccagaagaggatttaaagctgctttatgggttgctaggaaatacaaacttactgaagttaagagagggagagggtgggatgtagtatgataacactaggaggagggaaaacccgggactatgaaacagggcaattgctaggtagaaaagggagtggagttgtgtgaacgttggtgtggggaaggggaggcattttaagtcgttagtgtgggaattactgttattcagccagcaatactaaccttaggtataaacatgcagtcttagggacaacacgcatatccagtaattatttggaaggctattcaccagaatgtttagtggctttcacttgtgaagatgtttgggctcatttttcctttcttttttattcctttaattattgagatttgagtattttataaagtagaaaatcagaagtggattatacccatttgcttttctggacagtggggctttatccggtttcaagcaacagcaaaaccaaagggttcacattttattccacttaaaagaaattttaacattttctcaaaaatgctaatagctttattatttattacaataatggaaaaaataaacacagtaagataacgtattttaaggttcagcatttctttctgattagatctttgaaatacaggttaaactcaaaaagcttagcgccgtttaactttattagctttaacttttaaaatatgcataatatgtacccttatttttatgttctttgagtatatgaagataatttattcttagaatttttgttttaaaaatttgggggtactgacacttaaatgaaaagtttgatacttaaagtttgtggttagtttattgaatagatattgtaaaaggttattgaaggagacccttaacctgtatcttctcttcctctttttttttttttttttttttttttgagacggtgttttgctcttgttgcccaggctggagtacaatggtgtgatctcggctcaccgcagcctccacctcctgggttcaaatgattctcctgcctcagcctccctagtaactggaattatagggatgcaccaccatgcccggctaattttgtgtttttagtagagatggggtttctccatgtttgtcaggctggtctcgaactccccacctcaggtgatctgcctgcctcggcctcccaaagtgctgggattacaggcataagccaccgcgcctggcctcgttcttttgataattttaaaattgtttggatatgtgtctttgttatcttgaatcgctcaaaactgttcagtgtaaatgtaaaactgatgaaagtcttctgaacttatttttcctccctggaattacagttgattaaattgtatacatgtttttattttacatgcagtttattcagctattcagatacctttctgaacataagtgttttattcagacaacatgttggaaataatatattagaatcctaatggttattttcagggagcattttacctctttatacagtagtctatatttgaattgaattttctgcttcaaacacttagactttaccagttaggaatccttggagaaacacactttttagatagaattcagcctggaccaatccggaaccatactctaccatattttaccctatagaacttagtgtaagttgtaagcctgtattatttaatacttttataatccaaaatcttgtgtgttttttaattttctaagtactcataaaataacgatgttcattagattaaacaacaacaacaaaaaattgtagttactgatggttttgcagcctactgattcagatctgaggcatttttaaagttacgtttttggctcttgccccagaatatgtacatataggaatgagcaagatacgtacataatgtgtatgtccagagagtaggattttattaaaagtggatgttaaggattcactgcaaaatttggacaagatcctgaattatacaccctcagtatgcaatattactttttataatattatataacattattatttgttatttggagtgattcattggttatctctggtagctgagagaaaaggtagtgagattatgttgcagctgtgcttgatttgttttaaacttttgtagaaacgccacctcctggatatatcagtgaagatggagaaacaagtgaccaacagttgaatcaaagtatggacacaggtaaaaaaaatgtctttgaaaattcctcagttattagatatacatttcttgtattgtttgaaattcacaaaagatgttactcttaaatttagagaagttgagacgcataccaaaaaagatgatcttctatcttgatttaacatatctgaactaccaaagaggtccatgttgtcactgaaaaattataacgtatgctactctgcagaataattgttattttttattagagtaaatgaaaatttgaaaacatgcacatacttttatttctttttaagtatttgcttctgttgaaaattttagtaaccctatgactaagtatctctctgtgataaaaaaccataattactcaaataacagattttcagaggaatttgggggtgaaggatggggatcagcttttcactgcttttttaacctaatagtgagttttgaattatagtagattaatttcttatgcttagctatcaactccaaaaagtgatgaagaaaaaaattaaagctttaaatcacgtcttacgtaataaaatgtataactcagcagaactaataaactaccagtgaaatcactttgatgtcattgtaattgtccagtttgattcattttacctgtctgtatcttaactgttggacaccttaatatcacaacctgacaaattataccatcagtctttctccacatcttaacactaatgcattcttggttatgataatctaaattatttttaagtggattaacattggtgggggagggaggggttacaataattctcttgtttaaatccgtttttttggactcccaggtaaagaagtttctgctgtagctaatcatacatttgggtgtttaggagtaccagataactaagaaaggtagataatctaatgaacgttggaaataacgtgttatacatcttaatgcaaataatatttgactttccacatatgttttactaaaattagatgacactcttcttgaagcaataatattcttttttgcctgtgatggacagctgttactgtgacatttaaaagtgaatgatgggaaaagatactgaacgtcataaaccacagtgagatactacctcacacctactagatgctataatcaaaaaaggacaataacaaatgttggtgaggatgtggagaaattggagtcctcatatatcgctagtaggaatgttaaatggttcaacactttggaaaagtttcctgttcctcaaaaagttaaatacagagttaacatattgtggccagctatgtatccaagtgaactgaaaacatgtctactcaaaaacttgtacatgaccatttatgcaggcattattcttaatattcaaagttagaaacaactcagatgtccatcaaatgatgaatggatgaataaaatgaggtatgtttctgcaatggaattattcaaccatgtaaaggaatgacagtatagcatgacgtgtggcaacatggatggaccttgaaagcagtatgttaagtgaaataagccagaaaaaaaaggctgcagggattctaatttagtgcacagacacctattcagcaatataactgaaacacaggaggagcaataatacaagtattcgttatgtatgataaatgaatcaaagtacaaaagtggagaataagctgaatcagccagctaaaataattgcagtgttggggctaactttgaacccaacctaatatttctgtttcagtggagcagtgttactggctttctgaatgacaggtttaaaaattactgtatggcaatgggaatatgtgattcatgagatgccaacagttagtttggctgccagcctcttacccaatatcagtttctctcttggggccatggcaagaaacaattctgactgatgcagggctccaatttagaacaaagttggccacctctctaactctggttcataccttccagaaggaaggacataattaaattcatctttcataacctgctgttaaaaataatgaattgaaattttttaaaagggcaaccagaggataaattaggcataataagtaagtgtacgaacaagcacttgttacttttttctttttttttttgatttagattttgctggtcaagactttattcttcctttatagtggatattagagatcaggctggacatcgtaagaaatttataagttcgattaacctttgtagtattgtataatcagtcccttttcaagtcatgatttttatgaacatatttgttcaaacaggtatatagagaaatagaatataatagatcataagatgtggatttcataactcacaattcagttttgtatcttctacatacactgtgcttggtccaagatacacaaagagacttaaagggttttttaatctgcctgtgtcccagaagataaaatgaggtgctaacctccaatacctcagaatgtggccttgtttgggagtagcatctttgtaaatgtagttgtttaagatgaagtcatactgaagtacgatgggccctaattctatatgactggtgtctttataagatagggaggaatgtgctatatgaagatggaggcaggtaactggagttagcacctgcaagctgagcaattcctaggattgttgggaaacccaaaagcttaagagaaaggcatggaacagattctccccttgagcctttgagagagcatggctttgctgacaccttgtcttgggacttaggtccttcaaagctctgaaaaaataaatttctgttgttttaagccacccagtttgtggtattttgttagagcaagccctaggaagctaatacagtgagtattaagattttgagagtatcctactaatatgtacacttaattatttgtaagttatatacaggtacttcaagtacatttaaaaatatatacaaaaattagaaattgaaggatgagattaaataaatagaaaatacattttaattttttcttcttgtaaactactagttttttgtactcctagacagttttcccatacactccacttacaagacttactcctcttaactaaatgcatataatcaaaatagcatagtgagactctgagctagactatctgagtttgaaatgttcctcttacatatgctagctaggtaacctagtttttaaatctgtaaaatagggacaataatagcatttaactcatagagtattaataggactgatatttataaggcatctatgtgttctaacctgtaataagcactgtatgaaggtagttaaaatgttaagaggagttaaccattaagaaaaaggaagatagtggattgcacaaagatgtgaaggaaagtgaagaattgagatccagacacagaagcacttgatttttgtggtttaggatcagctctataaaataggaaagtaagatttttgtcaaaaatgaggggtcaggtttgacaacttcaggataatagtcttataacaatgccttttctctgccatgtgttaaacagtttttgatgtagatgtatagcatgtctttcattagataaattttttagtattttatacttttagtgctgttatacgtttttgtttttacattttattttccagttgttcctaggatatgggaaatacttgatttttgtatattcttttctcctgcattcttgttaaattgactttttggttctagaattctgtagattcttgaggttttctgcatacacagccatgtcatctgttgataaggacagtttttttttgtttgattgttttttgagaaggagtttcactcttgttgcccaggctagagtgcaatggcatgatctcagctcactgtaacctgaacctcctgagtagctgggtttacaggcatgcactaccacgcccagcttatttttcgtattttagtagagacggagtttctccacgttggtcaggctggtctcgaactcccaacctcaggtgatccacccgcctcggcctcccaaagtgctgggattacagccgtgagccactgtgcccggctgacagtttttctttttttccccagtcttcatgcttttttctttttctgtcctaactaagacctacaataaactgttgaagctataagaatggacatttttgcattgttctgattataggaagaacacatttcacaattccccctttaagtatgatgttaattgtggatattttggagattgtatctgattgaggaagttctttttcctttttgttcttaatgttctaattgtgttttataaatggctgttgaattttgtcaaattttttttctgcgtttataaagaggatcatatagtttcatggatttgaattgttttatttttgagaatttttccatctatgtttatgagagattggtctgtagggttttttcccttgtaatgtgtttattagttttaatatcataaaatgtgttggaaagggctttctcctgttttctcgaagagtttctttaaggttggcattatttctttcttaaatttttgatagggctgggcatggtagttcttgcctgtaatcctagcattttaggaggccaatgctggagaattgcttgagcacaggaggtcaagaccaacctaggcaacaaagcaagaccccgtctctacaaaaaaaaatttttttttttttaaattagccaggggtagtggcattcacctgtggtcccagctacttaagaggctaaggtgggagggtcacttgagcccaggaggtggaggttgcattgagccatgtttgcgccgctgcactccagcctgggcaacagcgagaccttgtattcaaaacaaagtttgatttttccagagaaaccatctcttgtaggaaaaggttttttaaattgagaattatttacatttttaattttgtgtatgtgtttgataaacttggattttgttagaaatgtgttcatttcatttaagtcataggattgattaattgagacaggatctcacttcgttgcccaggctggagtgcagtggcctggttggctcacggcagcctcaacctcccaggctcaggcaatcttccccactttagcctctcgagaagctgggaccacaggtacatgctactgcacctggctaatttttgtgttttatttagagataggatttcaccaggttgccaaggctggagaatgtattgatataaagttatttctgatatttgttattcctttcatatatgtgagatccattttaaaatttataatgttagtaatttgactttttaattttttattagaatgtcttgtaatggattaatcagtagtctttgttgtctttgtctcttttctgttttgtttgtattcatctttttgtctgcttacttttcatttaatctggtcttttctagcctcctgtggtgtacatttagatcattgatttgtttataatgtacacatttaaagctataaatttccctctaagctttatgttagctctatattacaaattttatgttgtttttaaattatcacttattttctaattcttcttgattcatgagttatttagaagtttgggtttttcttaggagtgtgaggattttctagatacttcatcaatttctaatttaattctgttaacagtccagcatatagtgtgtgtgactttagtccttggaaatttatgaaaattattttatgctataacttgtaacttatcttgataagagttccatatatagttggaaagaatgtatatactatagtgttccaaatgtcatttaggtcagggtggttgatagtgtttacatcttcttaattctttatgattttttaaaatctccttattttgtcagttatgataagtgttaaaattttcagctctgattttagagtcatctgtttgtgcctttagtcctgtcagtttttgcttcgtgtgtctttaacctctgttattagatgatacacatttggaattatacatcttccaaattaatttgccctaattataaaatgcatttcatattaacatcaccatatcttctttcttacctctggttacatgatatatttttaattgtttcagtctatccgaatctttatatttatggtgtgtttcttgtggacagcatatttttggttttatttaatctaacaatttttgtcttttagttggaaaatttagtccgcttatatttagagggattattgatactggctttaggctaccattttgcaattgtttgtctatttgttctctctggtttttatctgtttgttttcctgccttttagactaatcaaataatttttgtttcattctgtttactctcttggccttttaccagtaacacttagtattattttctcagttggcattctcgtgattacattgtacttatgttatacctagaagtttatttaagttgtaatattttacaacgtcatgtaaaatttaagaactttacaccactctagtttcattcatctacttctgttgtttgtactattattgacatgtattttacttaataaaaatatataaaccccaaagttcagtgttattttttgcttttgatatcaagttgatttttaaaggaaattagaagggataaaaagaagtattttatattcacctacatatttaccagtttggctcctttttgctgctttttattcctttactacagacatttctttcagttgttttagcaccattttgcagagacattcctttctccattgatttacattggctcctttgttgaaaatcaagtgataatatgtatgtgaccctgactttgagtctgctcttaatccaattaaatgaatttttcatttcagatcctttattttttagctatataatttccattttaaagtcttcgataatttgtgtccagttaatatgtaacatggcctgcttttgttgactgttttatctcttgattatggggtcatttttttccccctccatctttgaatatctcttgttttttaattggatagtgggtgttgtatatataataatattagagattaaaatagataacactttctttggaaagaccaactcttttctctatttgccaagttgaggagctgatcctttccctgcccttaggatttgagttggaaaggtgataatttggtgctttaatgtcacatcactcaggtttcagggagggtcagttccctaccttatcagaactttcagatacaaatatggcaagactgcatattcttatttctttccagccttgcccaggacttcctatgctaacatgtactcagctaaagacatgtattaaaactgactggtgaagaggagctctgtgcttgcagcttcttcgattcctgtcgtctgtgcatggccattgaaattttagttggcttctcctttggcaagctcagtcctttgtctgtgtcctgacttggcagatgctgtcagtagtgaaagtgattaccactctctgttaactggggaggagctcatccctctctgtaaattagttcctatggacttatttggatctatatctgtgtgataactttaaagaaaaatagaatttttctttgtttatccactgttttcttactgctatttcagaagcaaaggttttccccaatcttctacatactaactataaggggaactctgtaggagtttctaataaaaacaaaagcagccttttttctcattatgaacagaattatgctctcatagaaaaattggaaatatgtaaaacctaagatgctatcgcactggggattaagttttttaaaacaagaaatgaaaaaatgatcattcatgcattatatatttcataagctgaatttgatgattataatgttgtatcactttggcagggaagcttaatctcttatttctaccattattctgtgtcagataaaagttaaacagtgttctacacataagattatgatacagcatttcaaattatacaacaaatggatgttcattataaaaaattagcatagtcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaaaaattagcatagttaggcaaaataggaaaacttaagcattatatgtaattgcatctagcaaaaaattaaaattttaaaaggttcaacttttaccagaaattaaaaaacaatgctgtaatgaacctcattaaaaaatagctagaaaatgacagagaaattcagtaggatgtcagattctagagttcctgttcttgtttattacactatatgtctggctggttttaggtgacatgggggagaagtgggtgcttttgatacatattgctgaggcttagaatatgactagtgatcatatttgggttaaggttgaagaagcaacccaggatgattcccagttttctggaaggtttgtgaacactttagtctgtattcagtaaattagactttttaaagcatacatttttattgtatatgtttaaggtatataacatgatatttggtgtatgtagtgaaatggttgctgtagtcaactaaatccatcatctcacatagtcacctttttatgtgtgtgataagagcacctaaaattgacttactaaatttccagtatacaacacaatattgtaactgtagtcctcaggttgtacattagatctctgggcatatcttacatatctgcaactttataccctttgacctataatctccctattttccccccaacctgtaatcaccattttattatgtttctatgtatttggcttaaaaaaaaaaaaccccacatatgagattatgccatgtgtctttctatgtccacctaatttccttggcataatgtcttccagattcatccatgccaaaagtggtaggatctccctttttaaggcaggataacattcaattgtgtgtataaccctccatttctttatttattcatctgttgatgggacacttgggttgtcttctgtatctttgctattgtgaataaaagcagcaagagtaaaagcaacgtgccacataacaagggagtcttcattagacaatcagctttttcagcagaaagtttgcaggccaggagagatgggtggtgtatttaaagtgctgaaagaattaaaaaacaaaactgaaattagccgggtgtgttggtacacacctgtggtcccagctactcaggaggccaaggtgagaaaattgcttgagcctaggaggtggaggttgtagtgagccaagattgtgacactgccctccaacctgggtgacagagtgagaccccatctgaaaaaaagaaaaaagtacccctgccaaccaagaatactataaccagtaaagctgtccttcagaaatgaaggagaaataaaaaatttttcagacaaaagctgagggagttcatcagtgctggtgtggtgaggatggggagcaacaggcacactcatttattactggtcagaatgaaaaatggtatagccactttggaagacagtttggtgatttctcacaaaactaactatattcttaccatatggtttagcagtcttgcttctccttggtatttacccaaatgaattgaaaacttaggtctacacaaaaacctgcagattgatgttcatagcagctttatttataatttccaaaacttggaagcaaccaagatgttttaataggtgactagataaataaactgatatatccaattaatgtacaacaggtcctcaagtaataatgtcatttcgttacagtgttgatgattggggaatgttggttttgttgtacaattattttgcttaagtcagtttccaaaaacctatggaagatgttaaatgaagacttactatatatgacattctggagaaggcagaactatggaagcagtagaaagataagtggttactgaggctttgtgggaggtaaagaggactaggtggagcacagggcatttttagggcagtgaaactactctgtttgaaactgtaaatggatacacgtcattatacatttgtcaaaacccagagaatgtataacatagccctaatgtaaattatggactttcagtgataatgatgtatcagtgtaggttcattattataacaaatggaccattgtggtttgcggatgttatagggaatttggggaagcagggcaggggtcatatgggagctttttgtactttctgttcagttttgctgtgatcttgaaactactctaaaaaaaaagtcttttttaaattaaaacaatttaatgtcaccttaaaagatataacagattttttttaaaaaaaaacctgggtgaatatttgcaaatagatgacaagtctaagaactgatttttaagtttaaaaacttacaaatcaagaagaaaaagatagttaatagaattggctaaaagaacagaaatacactgtttacaacaaaaacaagaaattaaaaaattgctccttttaaacctatcatattggcagatgtcaacatgtagtgacacggtgtgaagaaacactagcttataaattcttagtgagatgaaacatttttgagagggtattttggcacttataaaagtttaacacattttatttgacatttgttaatttgtcaaaggtttgacgaatgtatcctacaaatatatgtgaatttgtatgcgaagatacatgcacagggatttctgtagatggtttagctgtaagtagacactgctaattcacactggatctcaaataggatatttataatattctaagtggaagacctgtggtaggtgagactccaatagcagcatttatgtatgaataattcataggctaatcatcagttcgttgcctctggtttttttttttttaaaggcttctattaattgttagcttattttaagtttttaaaatttgtcttttttgtaatctgtaattctaacctgtcacatctgactgaacgcctgttaatttaaatgatcctactggtcatttctaagtatttaatagaggagtaaacagttaaaagatatgaatagttgggcagtttcctccatttctaatagtggctttgtttattttatgttggtttcaggaaacagcagtgaattttagctcattgttccaaatatgttttgacctatcttagttgtacctgttgtgacttgccagcagatttgtgacttgccagcagatttgtgacttgccagcagatttttcaaactgagaaaaaaggaacataacttaattatgttgtggaagaccgtactgtcttctaaaaactaagcatcccttctctgattcatttatttatctaggggctaccatttcacctttattgcctggtattttatgtcatggttataatagtgtgtggtagggaggaggtgtgtaagatggtctgacctatcttactcttttttttttttccctctcgagacagagtcttgctctgtcgcccaggctggagtgcagtgggatgccctcagctcactgcaacctccgcctcctggattcaagcgaggcgacctgcgactccttgactttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccattcttctgccttagccttccgagtagctgggattacaggtgtatgccaccatgcccgactaagttttgtgttttcagtagagatggggtttcactatgttggccaggctggtctctaactcctgacctcgtgatccacccacctcagtctcccaaagtgctgggattacaggcatgagccaccatgcccagcctgacctatcttattctacaattatgctcttggtatacatttgaagcttgggtcatgctcttttaggtaactgtgcctaaacgtgtagagaatgatgatcataaaagaaaatatattttatatttttaataagattatttaacaatgtttatagcaaatgtgttttaaaattgagttgcatggaactgagcagactagttgcgccatgatttttcatatgttgtctgtggtggttcttattttgtatgtttgtgcccccttattttcttgattagatttagcctgtttacccaaaagaagaaacagatcattttctaagaaagtgtaatttaccagaactgactccagaaaatagagctatctgaacaagtcacccttcatagaataatgtctcgtagtaaaccctagaaagttactaactataatttcacagaagaattctaccaaacttttaaagaatatgctgttataatactatttaaacctttgcagaggataaagctgctagattgtcataacattgaccacagagccttacaaacatagcactcatgtaaatcttcaggcttgtattgcttgagactattgatgcaaaaatcctaaataaatattttattactgttagcctgaaagccaatgccatgcttaatgggaaaatggtagaaacattaccctaaaagtcaagagtaagatatccaccgtcatcactgttttatcccaaagtgtgacgctaacccaaagatgattgataaatcttgtagaagggcttttattttagtgctacatgatcaaaattaggattaagagtcaaaagaccaatgattaaatatttgtagctcataccataagaagacttacatccctaatacacataaagagctttcaaacaatcagtaagaaaatgatcaacatcgcaaaagaaaagaacagactatcacaggaaggaaatataatataaacatgtgtaaagctactcaaaattaaaactgtacttgtgaccatgttttcatctagaagcaataacacctcaagcatccctttactatgttgtgactgggaatgtaaactggtacaaccttgatgaatgataattttacccaaatctatcaaaattgcaaatacacaaacctttcgacctggcagtttcttgaagaatgtatctttcagatgtgattggaagcgtgcaaaacggtcaagattagttattgcaatctcaaagcattggttcttatagcaaaagattgaaaatagcttgaatatccatcaatgtgggatcgcgatgttatgtgactaattgatatgtagatagacaaataaggaaacacattgtgaacaatctgatagaataatatagaagatgaaaaacggttaccacttgtatatgaaaagaaaggacacagaacaaaaatgtatttgcttatgtggttcatagagtattttggaaagatacccaaggaaccgtcaatattagatatctttgggaagatgaactgttgggctagaagccaaaactgttgcaccttttatactggaacccccccttctcttcccccgaccccccacaaattaaactaaatttaagcacttacatattctgaattcttggtatttaaattatctttgtattattgttgataattataaccagataaagctagttttatgattacttgatcagaagttctggaaatacttcatttatttttaaatccttttgttttaggctctccagcagaactatctcctactactctttcccctgttaatcatagcttgggtaagttgcacatatgttcccctcatcatttttatactgtatcacctacttaataataaaaatcatctctaggagttattttttatatatccgagaaagggatcctaatgaatagccaaataattatgtatgtggttaaagtagtgctttttaaaaagaatattgacaccatccctcaaaattattaagtcttttctgctggcacatataagaaataggtataatctatttattattgaaatcatattcctcatagaaaattatataacctgttatggctagatttttatggttatgtttattttatgatgtaattaataaaaggtatgtgtattacatatatacacattgacataaatatgtatacatgtatacgtagtatggggatttatatatattatacataatatatataatatatataatatataatatacataatatatataatatataatatattatacataatatatataatatataatatatattatacataatgtatataatatatatataatatataatatatattatacataatatatataatatatatatagtatataatatatattatacattatatatataatatatatatagtatataatatatattatacataatatatataatatatatataatatataatatatattatacataatatatataatatatatataatatataatatatattatacataatatatattatatatataacatatattatacataatatatattatatatataacatatattatacataatatataatatataatatatattatgtataatatataatatatattatacataatatatataatatattatatatattatacataatatataatatatattatataatatatataatatatattatacatattatgtataatatatataacatatattatacataatatgtatataacatacataatatatattatacataatatatataatatataatatatattatacataatatatataatatataatatataatatatattatacatatatataataatatatatatactatatataatatatatatgagagtgtgcacatatatgtacaaatgtgtatgtgtatggtcccttcataaccatgagttcagcatctgcagattcaaccaactgcagattgaaaataatcgggaaaaaatgaaaataacaatacgacagtaaaaactaatacaaattgtatttatttttatttattttttgagacagagtcttgctctgtcgcccaggctagagtgcagtggcgcaatctcggctcactgcaacctctgcctcctgggttcaagcaattctctgcctcagcctcctgagtagctgggactacaggtgcatgccaccacacccagctaatttttgtatttttagtagagatggggtttcactatgttgcccaggctggtctcaaactcctggcctcaaacgaatcacccaccttgacctcctaaagtgctgggattacaggcgtgagccatcgtgctgggcccaaattttaaaatacagtataacaaatatttgtatagcatttatattattaggtattataagtaatctagagattatttaaagtatacaggatgacgtgaatttaagttacatggaaatactacacccttttatgtcagggacttgaacatctaagggtttttagttagggggagccggtcctagaaccaatcccctgtaaatgccaagggatgactatatatatatatatatatatacatacatttctgtattactattattatttttgccctcattttaccctatttcacaatttctcttcggttgttacatgtttggaatttattctacaaaattgtgaggtttttttcttttgcagtattccttatgatatgttttagtcaaactgcagaagctaaatatatagttttccagtgaaataagtagtcttttgactctatggtctgtttctacttgcatgatctttgtgtgttactgctttctggttcttatgtatgagtgggttttctctttttgtagctagggtatctcaccaagagtttgatgttaaaatagacaaatgtcaaaaatatgtcatattttgtatccttttattattactgtttttctttgtgtggcttttgactcattaatctttgctctggctttatcttaccccactttagcttttttatgtgctttagaaatgcaccaagtatggcaagttgactgactttgcctatgattgttttgtatttgaacaggagctagactaaaactactggtaaaacaaagaatccaacataaagtgatttaatgacatgggagaaatttgaaaaaatctggtatgatctatgaaactggagttttgtgtgaaaaatactgaaaatctggtatcatctgtggaaaccgatacagatactatgtctacttcctgagcttttgccagtgcaggctggcatagagcatgtaaagatgattatattaaatctatttttggcttgaattgttcacgcatttcttccttttattatttttttatttttttctttttcagatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggtatgttttattttccttgttgtgaaaaataaatgctgtatactcataatgtaggcattgcatggtgtgccacatcaagagcttgtgtgcagtaaaaccagctttctctctggtggtttaagtgccgacacatttaagtgcacaggcttcactgcttctaatagatcctggtgatgcttcagctgcaaactcttcaacttttatttggcacccttggtactggaaagttcttcaataaatatgtgttaagataagtttaatttgctgagtctctaccagtcataaaattgccatgttcagatttgggggttaatacttttttataaatcatgtttttttgttttgttttgtttttgttttttttcagtttctttatatagctcccaggttttttccccctttggtgagtttatatattaaatgaaatctgcttgctgttcatctgaaatgagatatctaaaacaagaactgcatttaatatagttcaaaatataattcagggacatctcaaaatgtggtctggggacttctggtagtcccagaaaccctttcagctagtttgtgaggtcaaagctattttcatagtagtactgagatgctgtttgccatttctactctcatactctcatgactgtacagtggagtattccagagcctacatgcatatgattttgcaagagatgaaatgtagatttgataatgagactccaattctgttacactagacatgaatgttgaaatgttgccactctatttttttttttttttttttttgctttggaaatatagttgtttttcatagacaaaaatggtgaaatgttgccactctattttttttttttttgctttggaaatacagttgttttttataaacattgttaatatgtaatggatttgatttttaaatgaattttttaaatctcagtttttatatctaatatggtcattttccataatattcacataaacaaaagctctttggggtcctcagtatttccttaacgatgaagtgaaaaagtgtgagaaccattcataattgaacatcattctcatcaccttaaagtaacttcttttaacagtagtttgcttctgttttttttctaattaaccattacctcctgtgagaagtaatgctggttatcaaagtgtgattttgatactgcaaaatgatagtgactagaagatctattacttggttccaagtggaagttctcaaatcttgcttgatgtataaatttggataatcttattaagatacccagtgtcgctgtaggtgctttaactaaaatagttttttgtttttgtgacttaattggggttctgcaaaaaaatttaatgggttttctctgccttattctcttctccctccaaagttttagattgctgtcgttattggatttttttaaattttttatttctagttttataggtgatattgatcagggaatatagcctgaaaaatctctactttttggacttagtgttttcccaatgaccacgtgcatgactgttttacagatattccatagtcttaacagaaccaccgtaccaggttctgtattaaatctggagtgttagttgtttgattagttttcttttgctgtgtaacaaattaccacaaactcagtggcctaaaacatcagttttttacctcacggtttctgtgggtcaggagtccagacatgggttaggcggtcttttcagggtttaacaaggccaaaattgaggtatcagctggcttgtgttcttatctggagcttgaggtcctcttctaaacccacatggttgtggcagaattcagctcctagatgcctcctgaattccttgtcacatggtgccatccatcttcaaagtcagcaatggagaatgtctcttgtgttgaatacctttcatgctttgaatcacttagcctatgacagtctagtcccttttaaaggattgcctgattaaggttaactgatttgctgccttaattacatctgaaaaaatccttaacagcagcacctagtgtttgattaacagagaatgtatgtgcacctcagggctgagactcttaggtgtcatgttagaactctgcttctcacaattttttttttaattcttatatctcatattattttgcatctgtgatctctcagattctgaaagaagtatattaaaaatctcccagtagaattttttctcacctaatcatgcttatacatctagaggttgggtttccaccataatatatagtttttaaaatggcaaatgactttttgatgtttttacatcttttttcttaacattaagtgggatctctaagaaactacagttgtaatgaagatatatttctccaaacattagtgaattccttcaaaattaactcaatcttttacttatcttaatatatatcatttgtatgaaactattttactatgtgtactttttctacattgtttaaatactttcagtcagtacacatgtattttaaaatcaataaaattattgttagaaaatacttgggagaaatatacagtagtatatttaaagttagacttcagaaagacattatctgtgaaaaagatcctggaaataccttatatcattttagaatttttccaagaaaatgcttccaaagtcacactgaaatagtaaatgttacaaaactaatctcatttgtattttgtttcaggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggtatggattcaataatgtacataaacctatcatgtcaacttgcttagtttttcttgttgctaattttaggaatcagtagatgattgcatgctcatattctaaaacttgtaacccttttaaaattactttttaataatgatactcttttgacaatttcttttaccttttttaatcataggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccggtatgaaatacatatttggttcttaaatttccacagtgtaattatgtttcattgcattcttgcatattctggagttcatttgtatctattttcaatgaggttatagagtcagctgatctttatgtaaaataaagttggaggcctccaaattcaaaactgttgcaaattactgagctgccattatggaagatattaaaacatgcacaggcgtgcattttaacgtaattcagagtgttaaatatcataaaaggggtgtatatgaagggttatgtcagtttatggaaggagagatgtttgcacacggtgctcaaggaaaacttgatggcacatgatctagttgtaaaaggtgcattggatttcaatagtcataaatggggtgggcagagttgggaagtgataatcttgacaatagcatagcaattcagtttggagaatagaaaaataaggctggacaattaaattgagacaaactagatgtaggttaagaggaggaacttcattcagaagtagaaggaatacttgctaatgtgccaggcactgtgctgttttaagtgtagtatctaaaaattattatttctgttgtcaattcattctttgtaaggttgaaatatatgaaattgccatcgttgcaggtaacacatggttcaaactaatacatatttggaaatagacatagaaagctgataatttgcccaaggttacattataagtggttgagatgggactggaagatagttctcctggactctttacctcttttataaggatagtagtaacaattatgtttaagttttacaaaaactaatttgtcatcagtggataagatagtctagattattgatgaattaaacaatagattggatttcacatcaaagagagagaagacttcttgaccatatttaagagtaggaattaagtaaaatacttagtctttcttcaattcgtattgcttactccatatgcctgcttaagaaatattcatgtaatatagtgattgtattcctgcttcttccagcaatttagtcccttccaaatttatttgttttggacttgcttgtctatcttaagttttgtcagaaatctgatttgagattgtgcaatgtgaggtctacttgttgaatacatttaaaaatatatggtatatatttgtatcagagaatgaagacttgtcactatttttttctgagttatattggtagaataattcattttgtgattttgctgtagttctgttttgattattacccttttgagatgttgttacctgttaagaatgctgaatgccgttttttaaaattagacttgacctgagttgatagcaaaattagatttaaattatattgtctaataagatttcaggtcagacttttttttgttcttcagaaggttagaataatgcaaaatatggtaggaatttagtggaagtaagagtgaattacagagagaattccatgtgtatctatagatctgctaagaacagttttacttggtaaagatactgcccttcttcattcactgtggactctgctgttctttaactcacagataaagtaaaatctgtaattacagaagcagtaatatgcagtatgtttttatgagtattgggagtcaggtacatctgactttggaaaatcaagtagtttcctgtaacatttacaaatcaaaatggcaaatatccatctatctgtggatatgtgggtagctaccaggaacttactgtctgtaatcattctggagctgaggaaatagacctaatgtttaggtttctaaaactattttttttaaatttccttaatgtcatcttggttgttagcacaaaaatgaggaaatgtagtaaacaggaaatttagatgtatgaagaatttgtatttaatcgagtggcagccttcttaaacctactccccttgggtgacctggattatggattattctagaaagggaagtgggacaggggagaacagggcagccaggaccattgttaagccatctaccagagtgggtgggtcactagaactgacacccttggggaaactctaggaaacagtaaacagtctacagaattatcctacccaggggaacagaagtgctgggcatgtaaatgtcaatttctgtttccttggttgagggctgctcctggggatgcttctttcctggcacctctagcctttttgggtatatcagagaagttcctgggcacagaaatgcagatacctgcagttggaagttgtctagagcacactgaaaaatccaaagggtacagtggggcactgataccatctgcctcagaaagtgacatccttggaagtacagttttaaattacattgaacatgtgttgcttggagatgaagagttgataatgggcttttctcatatttgaagggctgttagtttgtagaagcaagtggatttattgactttattctgtatagcaaataagatggaactaaaatcagcgcatggaagtgacaggatgtcattgaataatttgtaattctcttagagttgccccttttgttgaagcactattaaaagcccgaatggtgttgctaagagggatgttcattggctttggcagggaaagttgaattccagcttttaacactctctgtggtgtgggtttagcttgggccaaaattttgtttttgctttggtatacttttacttagattctgtttgatatttgagtatctactattctgtggttgatttggtaagtacagttactttatgtcttggtttgcttggacaatcctgattcacgtgtctccttttggcctgatttttttctgccccccaccccgagacagagtctcactctgtcgccaggctagagtgcagtggcatgatctcggctcactgcagcctctgcctcttgggttcaagtgactctcctgtctcagcctcccgagtagctgggactacaggcacacgccaccacgcccagctaatttttatatttttagtagagacggggtttcaccatgttggccaggatggtctcaatctcttgaccttgtgatccgcctgcctcggcctcccaaagtgctgggcttacaggtgtgagccaccacgcctggccctggcctgatattaatagtatctacattctctctcaggtgttccattttggatgatggtgaataataagatcaccttattaattttagtgcgatgagaaaaagatgttcttgtaaatcacttctaaaacaaggtcatcagaagtactttgactttgaggatcaaccattttgcggaataatcgtgtccaaaattatatacacaaccttttaatttctgtaaatttttaatgcagtgtacctaaacatagccattttccctgcctgtggacttgaatttcataatcattttcctgtattcttttaaacagaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatataccca

SEQ ID NO: 36331 - DNA, 78280 bp, Homo sapiens
ttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggtgggttctcggcgctggacttttctttctccagggtctggaagccttgctaaaaatccgatgggtggaaaatggttatggctgcgattcaggcggtgtcaggatattggaaaaggcatgagctagtgatgcaatgatattgttaattataaaaagctgcgcctctgtaatttccatcttgaagcgttcttttgggagtgggtattttctaatacagtttcaaaagccagcatcagagagggctgcgaaattctcagcgcttcattcctctttcttttctggaaagggcagcaactttgtcgttttaagggatttttgtatgtattttttaaatttcgggaggccaattactagttcactagcaattactgcgccgcatcggctgatagacaagcagacaggctagctgaacaccgcggggctggatttgctctatgtttgtgtgggattctcacagaagtttcaagccaatgagaagtgggaactgcagacagagatacatgtaagcaaatgttttgctattctttaaggaaattgcaattacagttaagtaatccttaagtcttggagaactttacctaaatgacacccacagtctttattcagcgagctcttgaaaacatactgctttgaacaaattaaccttgtgtgcgtatgtatgtgtctgtggggtgtgtgtgtgtgtgtgtgtgtgctgaaaactaagctgtaacaatgtcatcctggattggggaccagcacttctgtgacaggcagtcctggtatttggttggtctctccggctttccttgtgtttcaggctgaggcacaacaccggcgaacccacctgctttagaaagttcccaggaccggttatgagcaccaacctgcctccccccagctattcttatagttagttcatttttggagtttccagggttttttttttttaatcacaaggtgcagctattcgtgatgctgtgaggcagtagtgcttgggtattctttcattttaggaaaatcctattagcctggaacctgtttggcccccaggactcagctgtggctcttccaagaggctgggcttgaggcaagacctgtcccagggctgcctctagccaaagggaatggggctgcggggagtagggggaaagatggggttagcatgccttttcaactagctcttgaagtccactgtgttgcagtcagcctgttctttctccaacataaacgagacagggttttataaccaactgaaaggaaacttcatgtgaagaaacaggaaaacattgaaattcataatacacagactggaaaataaatttgttattgttctttcattccttccagatataaatctggccatggcaaatatcaaaaagccctgggatttggctctgcactttataaggtcagagctgtctccagcgttctagaatctggctcacccaggcacttacatgaaaacttgtggactctcagcgtccttattttttggattggggactcgataaaggaaatggcctcgcatctcctaagatcgtatcagggccctattccctctggatgtcagcttaactccaggtcctctaatacccagggttgctgatgcagatgggccatgtgtcctgaaagggagggattatattgttgtggtgcacgtttgtagtaacgggccccagaattcagccatgtccccaggttcactgctctgttgaagaagccttcaagatcaccttctccaggaagtcttgttgctacccacagcctggttgttatggcacccaataggtatttctttccatgcccttgccaaggtgtatggacattgtcgtggctccccaactggttctcaagggtagtggttgtttcacagttctgtagctcctccatctggcatccacacccacaagcagtagttgcttggataaactgctgttgaactgaataatagtactagataacgctctgcttttgtttagattttctttttttttttttttttgagacggagtctcgctgtctcccgggctggaatgcagtggcgcaatctcggctccctgcaacctctgcctcctgggttcaagtgatttgtctgccttggcctccagagtagctgggactacaggcgcctgccaccacagtcggctaatttttgtatttttagtagagacggggtttcaccatgttgcccaggctggtctcaaactcctgacctcgggtgatccacccacctcggcctcccaaagtgctgggattagaggtgggagccaccatgcccagcctgattttgtctttttttctaccataaccattttgaagagtctagttcagtagtgttaactgcattcacattgctgtgcaatctccagaactcttttcaccttgcatgactgaatctctgtacctattaaacaattccccatcttcccctcccactaagcccctggttaccaacattccactttttgtctctgtaatttcgactacactaggtgcctcgtataaatggacccatgcagactttgtcttttttgtgagtggcttttttcacttaacataatacagtcagggttcattcatattgtagcatgtgtcagaatttccttcctttttaagactgaatactattcccttgtgtgtacagactgcattttgtttatccatgtatccatcgaaggactgcgtccacctttaggctattgtgaataatgctgctatgaacacaggtttacaaatacctgtttcaagtccttgcttttaattttttgagggtatatacctagaagtagaatggctggatcacatggaaattctatgtttagtgttttgggagtcatcatactgttttccatagagactgcaccatatttacaccaacagtgcacaggagtttcactttctccacatcctccctaacgcttgctcttttccattttttaatagcctcatgagtgtgaagtagtagagattttgtatttttattttgtttttattttttgagacagagtctcgctttgtctcagagcgtgtaccaccatgcctggcaaatttttgtatttttagtagagagacaaggtttcaccatgttggccaggctggtctcgaactcctgacctcaggtgaccttcctgcctcggcctcccaaagtgctgggattacaggcatgagccaccacacccggctgcttttgtatttttaaagcaatcttgctggccacaatcttactggattaaagcctgtgcgtggcgaagggcagagttgcagactcccagagcatcactgtcttgtgcatggcagaactgagcccagggtgcgtgactcctcctcctgttttcccgcgggtttcattttccctgggctgtgcaggttccccgagtcctttcctccatcaggacctgctggcagcagttcccgcaggccacactcttcaggggacagggccaccccaacccatccactgatgggggattttcacacatgtggactcaatgctctggttcagtgacttcctgtgacacctttctttggtgccactcaaagtgcctcacattctcactttcttttcctttcactgtttgagggcatgatgatggcttattcactctgtaatcatgtcagcataaagatgttcaaaagtcaagcacatctcgcataaagaataaagaccaaggaactggttaataccatagtgggaggttttagcttttttggggggtggggggaggacaaggtctcgctctgtcacccaggctggagtgcagtggtatgatctcagctcactgcagcctcaaaccccctgggctcaggtgatcccacctcagcctcctgagtagctgggactttaggcgcgtgctatcatgcccagttaattttttttttaattttgtagaaatggggtttcaccatgttgcccaggcttgtctcaaactcctgggttcaagcaatcctcttgcctcagcctctcaaagtgctgggattacaagcgtaagccaccgcacctgaccttagcttttttttttgaagcagccaaaccctttattaaaaagtgtgatctaacacatgatcccaatgcaggaggcaagtagaagaggtgtggttctgcttgggtggtcgcggtgtctggaaccaccatgacctccctggagcacaccccaccccatacaagcccaaggtgatatcaccgttacacgtcacgggccgcatgcgacccacactcccctagacctgaatctgtcttgggcatttatatttgacttttcacctccacaggatactcactgttaccattctggctctctgtcttccaagccctgggaatgcacaggtaagatttttatttttaaaaaatatctacaagcgtattaaaatccggggtgagggagtccagccttgcgctacggaaccctaggtttgtgggggtgggagtggctttacagttgacctcatctgagctcttcattctcagaggttaacagtggaagctcagagaaagtgagacttggcccaggtgacatgacttgtaagtgacaaggctggggctggtactcagtttcctgactcccagtccaagactcttttctattttattataagttctagggtacatgtgcaggatgtgcaggtttgttacataggtaaatgtgggccatggtggtttgctgcacctatcaattcatcactaggtattaagcccagcatccatttttaatcagatcacatggcctcatttgtgcccctcacagcaggcctcaacctaccttcagtgttgaaaagtaaaatatgctgtagtgtttctgggcaatggcacctgaggacccccacgggtctgcatgtgttgccacagacacacccctcctggaggaggtgggagaggaagtgggtgttacccaaacatcccagcatgtagtgttgcataattcagctccaaacctaggagggcccatccctgggctgaaacccctcagaggagtaagaagggggtgggtgaggccaggctcagggccttaggggttctggaagaagcttgcagcatcctggactttattttaagcaacaggagagatggacccctgtgtgtcagccctgaaatgtgggcagatccctcctgaaaactccgagtggcctctctgtgtctctggctcaggaaagaagtgagagaagccctatctctgagcaggctgagggctgcaggcaggtaggggagcattttctctcttcatattaagaattttgaagcatattcaggccactggcaatgggaaggattttgggaggagtaacaaagaattttagaccttgcggttttctaaggcagcctcatggtgtacacatgaagacaggtaggccccaagggcagaggttcagggtcgtgtttactgcactttaggcacgttatatagattaacatacatcgtccttaccaccattttgaactacgtacatacccccccattttacagatggggaaactgaggcatagaaaagttacgcagagagtaggggctagagtgagaatttgaagccatgccctggtccagcagtcttgaacctatgccagtccttgacaaccagggctggaacctggatctcctggcctcccagcttcccggcacagcttcctggctcgtctgttccacttcctttgccccaactccctgggacccctgaaccctctcccgggagtgcaggccatatacatcatctctgcaaatcaaccaacagctcagcgaagcccaacctccgaagctgtagaaaaggccagggatgggagctcctagaaaatgtcaggccctggggtcttcctgaagagtccacccaacacattttttttttaagtacatacatttgtagctcaagttgtatgtaaaagctacaaccctctggaattgttgagatctatctctttctggaagcatctttatgtcgtcatcttgctgaggttgaaatggagaaatttactcaattcaacttttcttagaaaactgaccacatctctgtgtagcttttatttatgtacagacatcaaaatcaggtagaggatttcatgggggcaaataactcatattcgacactctgaaggcgaggtagcacctaaagaaagagtcattgcccttaaaagcagtcttattcattcccagaaaggggatgaacagggagcatgccacattaggctcagcagatatgattcctcttgctcttcacaactacagcattaaaaaccctgaaacctgtctgctaaaaatgggagctatgaagcaatggtacagggagtttttttttaaataaagtttttctaaaaacacagagatggggtcttgagggcggtctcaaaatcctgggctcaagaaatccttcctcctcagcctcccaaagtgctgggattacatgcatgagccactgcgcctggcctggtgtggggagtttagaaagtagttctaagtataaaataattacaaggaaaaattttagaagaacaaataggggttataatacaggtattggtattttggaggcctttcttttttgctccatttccccaactttctgtgttgcagcaataagacttttatggtgtgaaatgaccttgcctgtttctcctctctccttccctgcaggcacagtgcacgaatggctttgacctggatcgccagtcaggacagtgtttaggtatgagccactgtggatccttcattggggtggaggcattcagcccagttgcagtgctatttatttctttctctgttgttcaatgattagccatgcccatgggagaatacagtgacatggaatgactgaagtcagtggtgcccttttattgatcaccttctttgtgcctggccttgagctaagcactgagaggggtgaaagaattgatctctgttctcttgaaggtttctattggattggtgtttcctagggctgccgtaacaaattaccaccaacttagtggcttaaacaacaccagtgtatgattttacagttcagtaggtcagaagtttgacttgagtctccaccagaatagaattaaggtgtcagtagggctgtgtgctcttctggaggctctaagggagacttttattcccttctggttgttggcagaattgagtttcttgtggttgtaggactgaggttctgtttccttgctgactgtcagtggagggcaattcctaccttttagaagcctcctgctttccttggctggtggctcctccctccatcctcaaagccaacacagcgagtcaagcgtttctcactttgaatctcttctttttctgttgtagcatctctctgaccaatcagcctcttcttcttctacttttaagaactcctgtgaatatatcgggcccacccagaaaatccaggataacctccccatctcaaggtcagctgcttagtaagcttaattccagctgctaccttaattcccctttgccgtgtaacccaacctattcacaggttctgaggactaggaagagattttggagtgtttgtgggggtcattctcttagcatgccatcttttgcaatggactctgcaaaagaagaggagaaagtaataccttatgtccagggtcaataaagcatcgatggggccgggtgcggtggctcacgcctgtaatcccagcactttgggaggccgaggcgagtgcatcacctgagggcaggagtgcgagaccagcctggccaacatggtgaaaccctgtctctactaaaaatacaaaaaaattagccaggagtagtggcatgtgcttgtagccccagctactcaggaagctgaggcaggagaatggtttgaacctgggaggcagaggttgcaatgagctgagatcgcaccactgtactccagcctgggcaacagagagagactctgtctcaaaaaaaaaaaaaaaaaaaattaatggaggtcacatttgaattgggtattgaaagatgaataggatcctaagaaatgccattccaggtagaaggaacagcattaacaaggaccaggtgtggaaaggacactcagagcatggaatagtttgttgttgacagagcatagggcatatgaacggaagaagacagccctacttgcccccatcttaggggaagtatttagcttttaaattatatttaatttaagcaaaatcatttgtcttctctgagctaacgtcaccatgctccagaggggagatagatggtttgaaaaatcgatgaacagtgaggaataaaaccctgtcctgggaaatctgggcttacgttttgattttaaaataaggtgttttgatttgaagatttgatgaggaatcaagagtagagcagtggccttcttttctggccccccatttcagcgatggcttcaggcttcaagctggagaacaggctgttgcattctgcaccttgccattgcttttacctctggtaggattgggtgtgagtttctcagatgagatgctgggggtgagttgtcgggtgcaggcatgtggtctccagtctctagccccgcacagagcagactccaaggctgctgacatggctcggtatacgggatcatgtctactgctcgctggagccacagttcaggcctcccctgtctgtaccctagcaaggctgattttctagagagtccacctctccccttccagacataacaagcagagcccagcctggctagaaattgttggctggcacagagctgacttgaaagcaaagctctgctttcttaacaagcaactagctgtcagtcaagccttttcttttttttcttttttcttttttttgtttttgtttttgttttgagatggagtttccctctcgtcgcctaggctggagtgcaatggcgcaatctcagctcactgcaacctctgcctcccgggttcaagcgattcttctgcctcagcctcccaagtagctggaattacaggcatgtgccaccacacccatctaatttttggtatttagtagagatgggatttccccatgttgggaggctggtcttgaactcctgacctcaggtgatccacctgcctcggcctcccaaagtgctgggattacaggcatgagccactgtgcccagcctaagccttgtcttttcctgatgcaagagactctttctcccctgaccactgttacttgaagtagaagtggagacaattgttaggcccatcccagtattttcagagtatagtatgtgcacacgaggatccttgatgtattagatggtacatctgcagataaacactctttattttaatagtgtatatttatttttactgttaccttctacttatgctagttttcacttgctgtagtcatgtaagactttaaatatacatttatttgggcttcaaatatgggcttacttaaagaaagagtatgtgcaaatgatagtacaggtttgttttagtccgttctctgttgcttatacctaaatacctaaaactgggtaatttataaagaagaggaatttatttcttacaattgtggaagctgagaagtccaaggttgaggatctccatctggtgagggccttcttgctggtgggggctctctgcagagttccgaagtacgcaaggcatcacacggtgaggggcctgggctgctagctgaggtctctcttcctcttcttagaaagccaccagtttcatttccaagataacccattaacccattaatctatgagtagattaatccattcatgagagtacagccctcaggatccaatcacctcttaaaggccccaccactcaatattgcaacactggggattaagtttcaatatgagttttggagggacattcaaactatagcaaggtttttgtagatatggtcaaaatcatgatggtggtatttgaaaggctgatgtttgagtgacactggttactttgatacacttcagccaacatttggggtaccttaccgcgatgagttgggaccaccctaggtgtttgggagtgcttcctccacgcctggtaccgagttctgcttaaatatgcaccggacacaaggcagttggggtgccactaatgctcgccctttctgtgcctttcagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtgggtgagtagcccggccttttgttcctctccgctgtgctttggtgaagacatcgtctgtatctggcatgctcaccacaaatgggttgttagttgccattcaatgcaccagtgaaacaatgacttactctctgcatacttatttcactcttagcagcctgtatctctgggttcctgcccaactagggaggttattttgctgttttgttcacagttctccagaaaaccaatttttttctttattttactttcatctatctacctacctatctgtatctatctatctataactcatctatatatttaaagaccaaggtaatattttctcaaataaccaatacatctggtcagacttattacagtaagtaaatctcagaggaagttctagacagggccaaagctctgtcctcagcccccgcacccttgattggaacatgtgcttctgcaatacaagaagccttgaagggcacggccaactgttctggaaagaaaattaggttacttgggttggaactaatgtgcttgtgaccaaaaggagcctcactgataggaactcacagcaagaatggacctccgggaagaagcaggcacaaaggaattggcaaggggtgtgaccaaggtgcgctgtgatcgcgcctgtgaatagtcactgcgttccagcctgggcaacatggtgacaccttgtctcttaagaaaaaatatatatgaattgaagttttattacttttttcctctaccccaaaagtttgagagaccattggtctagcaagatttttgtttgtcccattttgttttttgtttttcccatttttgtttgtcccaagattttgttgtcccatttcagggctctggagtgttgagctgtaacccactattagggaagctgtgttggttaatttaaggtgtcttctatatgcttatatgaaggagtgtgcattctctttttaatacaataattgcagacaagtgtcttcagagctatgagggaacactgggtatgcttgaacccaaacttctgcattttcgctggtctcaaggcgtgtggtctctgtgtgtgttggcgtggggagagagaaagagtgagaaagacagagctggttaatgtttaccttaaacgtagatgactgtgcaaagggaatgagcgcagggtccggtcaagccaactttggtggagaagatggtaacatgcttccttataaccagcatcaggaggaaagacctttgtaactggaagggacttttttttaccaatctttaacttcaacttcttcattttgtagaaaggagagtgtggactccaaccagttaggtaattacagaggtaggatgccagtccagctcccctaacttctcccctgtctacaatctcctaactataggaaatgacctctcctatctggtagaaaagaaatgatcccaaaagaaaatgcagagatagaggtgggaggtgctgctcttccaggatgtcacgtgggggctggataagccaagtgatcagcccttacgtgtcttgaggtgaggaagagggtgtaatgattctttcgaggcactctgcggttttggcagggggccttgggtggtcgtggtgcagacaggtctagctgatgcctcgggcaagctcagcggcctcctttgcagaacggctgggaactgctgcggctttctccaaagtgtctccctccttcccctaaacctctttccagggtcccagtgcccttgacaatgaggacatggctgggaaacctattcctcccctggtccctctgacgtcatgccatttatggctctgaacctgtcacacgggagatgcggaactttcataatggcccttttgtaaggagaatacaatctaggagccctagtgaggactggcaccaggcccatccatttccaaaaagttcagcattatgcattcataagtcctgagttctttctaacttcccttcaccccaccccatggtttcctggttttacacagggctttcaaatggccctcgctgaggtccctctgcgtattgtaaagagctggcattgtgggggtggggggaagtaagagaagggatgggaaagggaggctctttctacctaccgctccttccaagaactgggatggaagagaggtgggcctgggagcaggtggaagggaagcaaggcaccgtggcggaaggtgggagggaaggaaaccagatggggggatcattgagaaaagacaaggaggtgagtgtggaggtgtcactgcccagagaatgtgggtgttttccagagcacagctctgatcctgtggaggaggcattgcatgagcagtgggtaagtcagggagacttgggaaacatttctgaaactttagtgttctaggagaggaggaaacatctccaaaggtgtcttgtcctcttcatcaaaataagaatagcgatcaacagtaacatccgcagcagcagtggtaataatatcaaacacttggatagaactcgtgtgctaggacctttacaataattaatgcgcttgatcctcataaccagctacaaggtaaaactattatcattcctattgtacccatgaggaaaccgaagcagagaaactaagaaacctgttcaaagtcacacagcaagtgaggggccgagccatgatttgaaccattcaggctttgaatgagaaaacaggctcagtgaggtatagatttgttcgagggtgctcagagtcagtgctgaagtcaggattaaaaacaaggtccttctcttgctatttttgttttctgagacagggtctggctgttacccaggctgtagtgcagtggcacaatcactgcaacctctgcctccttggctcaagcgatcctcccatttcagcctcccaagtagctgggactacaggcatgtgccaccatgatcctcgatcactgcaacctctgcctcctgggctcaagtgatcctctcatttcagcctcccaagtagctgggactacaggcatgtgccaccatgcctggcttatttttgtatttttttggtagagacagggttttgccatgttgcccaggctggtctcaaattcctgggctcaagcaatcctcatgcctcggcctcccacaatgctgggattataggtgtgagccgtggcacccagctatctctctttttttttcataatgaaactttttgctctgtaaaattttgaacctagtcaaaagtagaaagagcatagtaagcacctacctacttatcacccaacttctgtagttatcagcacgggcacaatctcctttcttctttacactctactcagtgcattaatttaaagcaaatcccagacatcatataatttcattcttaaagacttcagaattatctctaagagataaagaaattctttacaaaaacaaatttaaggccaggcacggtggctcatgcctgtaatcccagcactttgggaggccgaggtgggtggatcacctgaggtcaggagttcgagaccagcctggccaacatgatgaaaccccctaaaaatacaaaaattagttgggtgtggtggtatgcacctgttttcccagctactcgggaggctgaggcaggagaattgcttgaacccaggaggtggaggttgcagtgagccgagctcgtgccactacactccagcctgggcgacagagcaagactctgcctcaaaaaaataaaaaattaaaataaaaaaacttccaaaaagcacaataccattatcaaacctacagaagtcaataataatctctttttatcattaaatatccaggtagtgttcaaatctctctgattgtctcataaatgccttgcaatttcatcacaaatggccagaagaatccctgcagtccccggagtagcatggctctaacaaaatcctgctttctcagccacaaaacatttcactaacattagttattggagtccctacatttgccactgagccaagttggttagcaaagccagaacttggaatatccacccagagggatgacaagctgagccccaaaggggccatgcatacgaagccatctcagcagcctgttgtctgttggtttgttgaaatcagatccatgcaaattctgcaaattgcattggttgacaagtctcttaaatgtcttttagtctttactgtttccctggccacttatttgttgaagaggctgagctgcttgttctgtagaatttcatacgtttcggaggtggctgattgcactcttgccggggcgcgggttatcttattccttcgtcccctatattttcttgtaagctgctcatagatctagggacttgatccaattcaggttaaatttttgggcaggctattttgcaggtagcatctttgatcttttgccctcttcatgcactgatttcttctcaaagtgtaagacagtctgccttggggaggcaaatgagcatcccctttcacggcggtttactttttctagggtttggacccactttcaaggaagcacttcatcccttggtgccgcatgaagccatgctgtttccatgggctgggcggggccgggctcagcacctgggtggccagtccctcagagcttcctcctcaatttttctctttttggttccactttggaggtgactagaccctgtccttttggaacaatgtttggccttaggtttgagtccacaggcccctaggtgtgcacttgggacatttctgcagacacagtgaacagtgacctaggaattatagtccacgagccaagcaagttttgtgttgttcagaaaactggcatcttggcatgacagtgatgggactcatggctcattagagtgtgtcacccagatcctggacccttgggagatctggtgaccagattctcaggggagggagagccagacagacatggttaacgggtaagcagggaggggctgctgaaggagagcctcacccaacagctcacaatcaagacccagacagaggccaaatcaaacacatacgtagagttctgagctggccacatagacatcccagagaaggacggtgtggggctgaggatggtgtggtgctgaagcctcagggggtggggtgagctggtgccgagtggctggggcacccaagatgtggactcccattcaggaaccttcctctcatggcacgctgcctctaagaccgggtccctgaacgtggccgccactcaactctgtcaactcattcccttgggggctcaacttgtcatctctctgggtggacattccaagttctagctttgctaaccagcttggctcagtggcaaatgtagagactccatcagtaactcatgtttgtgaaatattttgcggctgagaaagcagccttttactagagccctgctactccggggactgcagaaattccggccatttgtgaaattacaagcaatatcttgattctctcttctagtccaggatttttgttattgttattgatctgagaacaggcagagagcaacacatggaatccttttggaaggtgggtggtgttggtctgaggctttctcttgagttatttttcctgaaagccagccagtacttcttcagtcaaccaatgtgtacagagtgctttgttggtgccaggctctggcctaggcaccgagggggatgtggagttttgcatggccacggagctctctctagagcttgtggacaaggaagggagattaaacgcaacacaagcacaagcagctgaaattcaagacggcctctgatgagttcctgagatggtataaaaagaaggcagagataagaagccttctggggtggaggggactggaactgggaagtcagacaggctttgagtctcaccttggtttggccacttcctacctgtgaggacgggggttggtttcctcatctgtaaaatggatataacaatgcctgtctcacagataacatgtgcaaacaccttgcccagtgtttacgcagagtatcccatagtaaacgttaactgggaaagatttgtggagaaggctgctagggtcttgagatgataacccaggggaagagtcacagagtctgaaaatgcatcaaacgtctaattcttcaaaacctttaaaatgacctaaaactgagcctagtacacatttaccttgcaggcctcgaacggctttccccagctaagcctgatgtggcttcactcggaatctgcttggaaatggcagcagaacctgggattatttaaattgtgagacagaaaagtgggaagtgggaacaaatgtggcataaaggccggggcaagtaggaacctcagcccctaatgctgacaggactgtggttagcaaaaactagggaggagaaggcggccttcactccaacagacttttcttagtttttatacagtcctctggcttggtctgtaacttgaaactcagtcctcaggctgagaccagaaggaaaatgcgtgaaacagatctggaggaaaatgcgtgaaaccatgaaaccgattctttagctgctgagggcattgggactacgcaggcccagagaggaaatgggatcgcattgaggtgggggttctgcagctgggttcgctcagatgtctttgtgaattggccccagcaagcttgttcatgggcatggcctccccaggtttcccaccttgctgcaagtctttccctatcattgctgggatgatgggcaagtggcttcacttctctaaacctcagattttcctcccgtaaacagggataacagtaccaactgccacaggaaatttggagaattaagtgagatatgcatgcaaattgtctaacatcgaggctggcttatcataggggcttcctaagttcgttactgtaattattgttttcattatctcaaatctcatcattccgtgatgacttctcctgctccaaacccctagtcctgttattccattattttttattctttcttctgggaattagatttaatagtgtgtgtcgtttagggagttgaaagttgaattcttgccaattttcagcagtaggagttggggttaacttgtgcttccagggagacacaaacacagacaggactccaggaagttgtccaggacagctgttcccaaaagtagctgtgcccatgaatcacctggggaaaatgcagttctgactcaagaggtctggggtgggccccaagggtctgcattttcttataagcccccaggtgatgccacgctgctggtccagggaacaccctttaattagcaaggccctagttcatctgtctatttttcgacagaactgtgtttaaagaaaggtagaaggtttatttttttcatgcaatttgtatattgtttgaatttgttagaagaatgtgttacttatttaaaaacaaaacacaaactggaaagaaatgattttaaggcctagattgaggtagcatggtgtagtggtaaagggatgagatgagacattagtaagaactggattttgatcccagatttgctacttattagctgtgtgacatttagaaagccacttggcctctctggcctaagttttattatctgtgaaaagaaaggatggtattatactaagggtcgtaatctggggtctgtggatataaatcaagggatctatcgtcatatttttccccactaactttgaattgagatttagcattactgtccattgtaggcaacaggccacaggactattagcagtacctgggatggtattgacaagagaatcagatatttacatatcacattacagctgtggcagttattttgaaatacttggaagtattttgaaatgttttgaaaccttcaaaatcatagaagatactagatctgcctaatttttttttaatgcactgataaacaagtatctatatcactgtatcatgtgtgtgtgtggggtgtgtgtgtgtgtgtgtgtgtgtgtgtgtgtgttttgagacagggtctttttttttgagatggagtctcactctatcgcccaggctggagtacagtggcacgatcttggctcactgcaaactctgcctcccacgttcatgccattctcctgcctcagcctcccgagtagctgggactacaggcgcctgccactgcacccggctaattttttgtatttttagtagagatggggtttcacagtgttagccaggatggtctcgatctcctgatctcatgatctgcccacctgtgcctcccaaagtgctgggattacaggtgtgagccactgcgcccggcctgagacagggtcttgctctgttatccaagctggatggattacagtggcatgatctctgctcactgcatcctcaacctcccaggcataagtgaccctcccatctcagcctcccgagtagctgggactaccagtacatgccaccatgcccagctaacttttgtatcttttgtagagacagggtcttgctatgttgtccaggctagtctctaactcctgggctcaagcgatcctccttccttggcctcccaaagtgctgggattacaggtgtgagctgtcatgcccagccatacattcgttttttaaatattttgatagctgcatttcaatacaattgttttctttcgtaatcctctgagttttattttatgcaatttagggcattattctgagaagggagtacatgggctttagcagtctgccaaacaggttcaaggcacacacagaaaagtttaaattccctggttctgatgatttctcaggtttcctgcaactcaagaatgttctactattctaaatcttcccaatctttaggaaacataattttttgcgttagccctttcccacctggattgcctaggtgacgtggctcttctctgttgcgtgtgttttaacagcacacatgcctgctgacacctgccgggaccctaccaagtctccacttgtgaggaagtcccttccaccctcagtggtagatggctttggttattggcactggtctggtgaggttcagtgcactgactggcctcatgttctgggtggggtcccactggtgggccatgcccagcccttggtgcctttgtgtagtaggtcacttccccagtgtctagcgtggcagtcttttcaatgacctacaagtttttcttggctctcatcttatgttccttggtctagtcatgttacttttatttctactccactctggaattagccagttgtgtgtgaaaagcgagtggtgttgcagaggagggatgaagtgtggactttttaatggcaggaccattcagctctggtctggcaaaagtggctgcattaccaagtctccagagagcactgcctggagggcaggaggttgaagttacctgccaggttgcaaatagcctcgaatgccagggccagagctgagctgactgtttagcacatgtcttttaagttagtaggaggtgcatgctatgatactccttagagaagtgcagtcattctaaatgtgttgagatggagcaaggtgatcacaccatctcttttgttgtcaaggctagttttagatttcttttcaaaatccttctgatgtaagtgggttgaatccaccactggaggactctagaacagaatgactcacataggttctgtacagaaattcgcagatgttctgtggatgttctccgcggctcttatctgtttatgtggatggtgtctgcatagcatctgcagctcacacccccaaccctgctgtaatgcaagaaacagagggatttgggggatttgggagatgtttatgttatcagggatgttaaatgaaagaagtaaaaataccatatgaatgcaaggcattcattttatggagagtgtgtgcctgagtgggataaaacggattgaaacaataaatgaggaatcctgtttgatgttgacgacaacagcttcatgtaaatatcatcccataggcccaagctatttcttttgtggggaaaaatggagatcttcatttctcaaaggatctgaagtgagcaattcaatgatgccaggcactagtggtagagagtgtgatgcagtggaacgagcatgggcttagattcacacagacgtgggttcgaatcctatcactgcaccgttacaaagcctttaaatcctttgagtgtgtcccagctacaagatgggacaatgatgcttatcttccgggaatgttttgaggcttagtgaaggcaggatagtcaggtcttcaccctctaagcaatcgcgttgtcactcccacccgtccactgccccccgtccactccccccgatccactccacgtacctgcaagctctttatctcacaggagcagcaactctgtttgctttacatcttagcagtccctgccagtcatagggtcagacacgtggcaggtgcttgttggctgcttatctcaagtggggaagtatgtggaaggagcattagttggggagggagaagaagagggacctctttcaattcgtgatcatgtcttgacacttcaccccctctgtctccactctgacctcacacaggccacagaggcagctttcgagcctttctctggggccctcttagactctgggagtgctgaagagctacctgggtaccttcgttctcctatccgttgggctgccatcctctgtggacacatgtaccacacaggccacgcggtgcccaggcctggcaggctgggactggggaagtgctggtggtactgggctgacccgtcatcagagagacccatgagccagacagcctccctccagcagccagccctgggccttgagcatggaggcacagaggccagggcttcccagcagccccaggtgtgggcaccgagggcaggcaggtgcccacaggctcttgtctttcataatggagggcatggctgtcgggggttcagggaagtgggtggggtgcctggcagggggattcctgagacaaaggcacagtgccagcctccactgtttatccacagcatctggcagagtgaggctctcgtggagtgatttttgaatgaatgaatggcggaaggaagagtgcgggcaccgatgaacccaggctagccagaggggagcgccactgccttcctcactcagtctcccagcactcacctccagcacaccctctgctgactcctcccactgtactgggtgtcaagcagggactaaggtgaccaagagtctccttgttccttaagcgccttgtgggctggggccatggtcgctgtggctgtcctgcacccagcaagacgctgggtaccacggcagctcagtgagtgttagatgcaatctaatgtacagaagcactgacgggctaatggaaaaagatgcctgtgaagaaccttccagtgagattaacttgcaaagaaacccacgtccactgtccccttccttaaggggaaacgctgtgggaggctgtgcccttcgtaccttgaagccacagctttgttttcctgccatgggggagactggctcccagggcttcaccaccagccagcgccagctccttgcacaactccagagggcaccactcaattgtattacatgtcactggcaccccctggagcccagcaaccatcccgaggctcctgtttgtcttggaaacagaggagcatgcttggggaagggtctctgggccatctccttgggggctggcagggaaaggacattcacaggattccttccctccagagggcctcagacaacagactagatgtcaaggactgaccgcctgttcccctccagcttgtcggagccgggccagaggggagatggggacagccagtgctgggccctgctgcaggcagccagcatccacagactctggggccggcgggtatgttggggccggggaagcagaatacttggggtcttgtcaatgctgtctgactttctttcaaactaaaacatttgtggaaatctagccagagttgatttatgagctctacatatttcacaggtcttaacacgtcccccaggaatcagtgaggtcagacagaacagactttgcatccggaatcagtatgaaattggcatcttcaacagtttccatgggaggaggggtttaagaatttgagggagattatatgaaacaatgcaaagacacaaaaaaccctgactctgcttcattccattagggaaaaagatgggtcatctgttttctgcatctgagctgagtgaggggtggccttctccgtggggacagggatgaagtatgatgggacaggactcctggggcaactgagagctcagagtggactcaggggtgaccacagcaccctgtacttattctccagctcacactccatagctgtgataaatacacatttgtgattatttatttaacatctctccacccaacagagctttctgtcttattcgccattgtattttttttttctttttctttttctcttgtgcagtggtgctatcttggctcactgcaacccccatctcctgggttcaagcaatcctcgtgcctcagcctcccgagtagctgggactacaggtgtgtgctaccagctatttttttgtattttagaagagacggggtttcaccacgttggccaggctggtctcaaactcctgagctcaggcaatccgcccacctctgcctcccaaagtgttgggattacaggcgtgagccaccacacgcggtctcaccatagtatttttctagtgcctgataaatatttgttaaataagcagaaaagctacatgagtgaattatatatgtgggattcaaatgagaaagagaaatggattatatattaggtacagtttctacataggttaacttatgaccactgatggaattcatttatccatttaccatttatgtgttgaggtctgagctgtgcatgtaaagattaacccatttatgcctgatgttgcaatttttaaaatttttgcaatcagaccttggtgatgaccttgaacaggagaatataaataactcccacatgcttagcgttccaataatggaacactaggcataatttatcagatatcatcaccccctggcgagttcacagcctcttggcgggagtcgggtggtttggcaggaaatatgaaacccaaataattttatgtagcccagtgaaatgggatggcaacgaacgtaggtatgggacactttgttggctctggctggagtggtcacagaagctttcctaaagacagggttgcatatctgtgcgtccatttgattaaacaatattgactgatcacttttctgtgtcagacactgccaagggctaggagggtctaaggatgaacgagatgctgtccctgccctcaggatctctctgctgagtgggtgtgagtgggggttttggaggggggtgtacataactcatcagattctcttcatgagccagtgtcagatgtgactgatgagagcaatatgtcccaggtgctatgggagtgcccacgaggaatgtgaatgcatatggtggcctttagcaagtctttgcaggattgaataggatttccatgtcagagacgaggaagggcagtcagggttagggaacagcatgggcagagacatggagacaagaaagttcactgcatgttgagcagtcttggtcatgagtcaaccggtcacctgcacacttatgacacccagtgtggctgcagcatggacacatgttgtgggcagggcaggcacagaataagagatgaggcttagaaggttggcactcaagattccccaccagattgtggggccttgaattccatgcagttgacttgggctttattctgtgaacactggtttttgagcaggggagtgaaatgtttacaagcctatttggagatttctgcttagcctagtcttagcactgccacaagctcattgggtggttgtgctccagttccttctctttctggggcttcagttcacatctgcatgagaggggctgggccattatctgtgaggcttcctccagccttgaccactcaggatgcaaagatgcttatgacaaccaggtgaagggtggcttctggagacaggcagctttcggagatggtatcttctcatttgaggcattgattttgcatgtagtctaagctgtaggggctaattactgggtcacctcataattacatcacctccatgttctcagggtcctggtcaaagtctcctttaggcttaaaacagggatgagccctctgccgagacccctgaaaaaggggcatcagtggatggatgaaattggctctcactgtgatgatagggcctggcctggtcctgtgagaaatctgacactgcctttataattcctgggggaagtttgcaagcagctggagcaaaacacaagctccttaggaagccaagaatcctcccagattgaccaacaaggtagagatgtaagcgatcccaccatcagacgtctctggaaaatcccacctcagacctcagacctcctcaacagatcctttttccaggattgtctcaatctcatttctctccagagagcagacagtggctgggggccaggtggcactggcctgtggtctgttgtggtctccacttctccccatggaggctgggtcctgcggttactgccatgagtcctttcattgtagtaattcccactggaacactgcttctcgcttttccaaatgctttcgtgtccaccagctcatggaattctcaaaatagcccagggaggaaggcaggcctaggaatgttcttcccttcattttatttatttatttatttatttatttatttatttatttatttactttattattattattatttttgagacagagtcttgctctgtcacccaggctggagtgcagtggtgcgatctcggctcactgcaatttccgcctcctgggttcaagcgattctcatgcctcagcctcctgagtaactgggattacaggcacctgccaccaggcccagctaatttttgtatttttagtagaaatggggttttgccatgttggccgtgttcaaattcctgacctcaggtgatccgcccgccttggcctcccaaagtgctgggactacaggccaccgcgcctgtctgccccttcattttagagaatatgtggaagggctccatgactgtcccacatcccagagtttgcttgtgatttaggctgaccagcatgtgggcccgccagctttaggcccttttaggccatcccacgacgtgccctggttggtcataggcaccatgccagctcctttctctaccccaaatataccaggcccttctggacctcagggccttcacactttctcttccttctatttggaactctctcctggctcttcacattgcgggctcattctcctctctggcttcagctcagttcagatggcaccccttagagagtcctactcaggctgccttgtctgaaattacaccgcagttactcccaatcacagccttatcattttccagcacagtcttcagcgtgcattaaatccaccggaggccttcaaacacagattgctgccgagtttctgactcagtaggtctggggtggggtcttttcttctgagtgatgctgacgctgctggcccgggggctgcactttgagagccactgattggtggctttttatgtatttgtttgttgattttcccatcccttagctgtaaacttcaagaggggaagaaacgttgccttgtaacctgctgcatccccactgcctggcccatagttggtgcttgctaagtacctgttagctggctattggctgaaggctcagctggaacctcttgcttcataatcaatcgtcttgcacctgagagggaagaaggacaagcattggcagaaactctgggagctacttggtctcagctcttctctgctttactacctttttctttaactttttcatgcttgagccttttctaagggtcattattaattttgggtaaagattacatggataattttcataaaatcccaggtgacggattttactttctgggttcagaattccaacgaagccgcaggacatctgggtaagagaattaaaatgtcgtgactggcttgcatagaacacctcgtagaattcccaatgtggtactttcagaaccctctgtgtctcaggcctactagcctttggcttcagaagaacaaagttgaaattttgccagattggagttgggttttaaccatgaaatgttatctatcttccctgacaaagaggagttgaagaccagttctaatgatagatcccctgaagatattgctttggccaagggagtgctgagggtaggcttgggctgacctggtccatacttcgtgctaccattgggggccacaggcaatggagtatgtgggttggaggcttgccaggaggagggttggcaactcctgcataaaccaccacaaggctgctatggactgagaatcgtgggaacagctgattctgcccaagggggttgaggaagtctttaccaaggagggacatttatagtttggttgagaaatctggaggataggtatgtgatatgacaggatttgtccaagatcacctggcaggccattggcagcgctgaataaagcccaaagtctctggtttcttaatctccaaaaatcatgagttgtgcaaagagatcagattcagcagctgaatgaccttgagcaagtcacttctccgtggttgaaggatgatctttaagattcgtttagataattcattcatttcgagacactggggatagtaagtgaccagtcctctttgtaaatcatacagccctattctttccatattcaagctcaataaatagttgtacattgaatgaatttgactgctagcatcatctctttccaaagacagaaaatatggggcaggagaccctggtgcattagcaggcagacaagccacaaatgggttaataaaatagagtcattaagacaacaggagatagtgcaacttggcttttgactctgaggaggagggaaggcttgccaggattgcattccagcacagcctactgaccgtggggaagagtgtgtgggactccaagtcaagccccaagagccacacgcacgctaataagttctagtcaacaagaactctgaaaccagacaggggagggagaaggacaaggcagtctacttccctctggaagcttgggaggtgctcagggccagggggaaagcccacacaatgtactagtttgctaaggtggccataacagagtaccacagactgggcagcttaaacaacagaaatgtattgtctcctcgttctgctggccagaagtctgggatcacaatgttggcagagttggctccttttgagggctgcaagggaaggatctgttccttgtctttctaattggcttatagctggccctgtgtctttcctttcctttacttgactttgtctttcctctgtgggtgtttgtgtctcagtttcctcttcttaggaggacactagacattttggagtagggcccgctataacgggctcattttaactgaattacctctttgaagaccctgtccccaattgcagtcacattctgaggtactgggggttaggacttgaatatatgaattttggagggacacgattcaccctataacacaggacacagccctcttcctccagtggggacccttttgaggtcagagacccctggtaatccttccttccttccttccttccttccttccttccttccttcctttctttctttcttttcttttcttttcttttcttttcttttctttttttttttcttttttttgagacagagtcttgctctgtcacccaggttagagttcagtggtgtgatctcggctgactgcaacctctacctcccaagttcacatcattttcctgcctcagccacccaagtagctgggattacaggtgcatgccaccatgcccagctaatttttgtatttttactagaggcagggtttcaccatgttggcctggctgacctcgaactcctgggctcaagtgatccacccatcttggcctcccaaagtgctgggattacacgcatgagccacagtgcccggctgccattcttttttcttatccttaatgaccttaatctgtgatttcttcccagaggccttcttagatctttactgatctcatcccaagcccattggaacctcctcttctctgagttcccaaaacactgtgcttgtgcctctgttgggacatttctcaccatctaccttagacttaggaatgtgcttgtgccacttactcattaaagcttcgtgtcctgttatctttatgtctctttcatatcccctatctcctgtcttgcagatagaacagggtcaataatgtttgctggcttgttgataggtcagctgtccaagaaagttgggtaataagtgctggataaacaggaagatgaggttgttagaaaacagcaacagcaacatgcctttccttagattttgtgcactcgtagacaaagtcaagctactggatttataaagaaaagatgctctttccatccttccatccttgtttggccccagtaggtcaacagaagaatctacaaactgggtgctcagcattcttaagcccccagagttcaaatcgaattcctcttttggccagtcttggagagactcttcaatcatatcttaaataatggcattcttttggctcagctctatggatactcctccttccgcccccagtcccctgaccttctgccctcttgtttcttggctgaaaatctgggtctgctgtagagagcaagagcagtttcagcagagctggggtccttcccacaaatccagagccacacactccagaaagcctgactatgcagaaacagctgggttttggcaggctgattctgaaaagcttcgaatcacttagaagcactttgttcccaaatggtatgtggaggatgaggaatgtaccatcagatgaggcaggtcacccatcttgttatgagaggactcatttgaggactgtcccttgaaacagcttccctgacctcccacctttaccttattctagatgtgacactcccaactggttcatgggtggtacaggtgcctggatattgatctcttcagctcttgggttggggggcaggggcttcagagggaggcttagtccttgggccaatttgcccattccattgtaccttacacacttgtgtaatgttctatgtgtgcctcaacatgaaaaaggttaagaagggcaactttagactggcgtgctctgcagagatttctaggaacatagagcaaatttctcatttaccttttaaagtgaaatacattcacttgttactcttggtgctgtggcttttgatgaagcaaatgccaacattaggactctgtgtctccataaagctatagggaaatttgattaaattcagtgtattagtcatcaggactttttgattgcaactgacagaaacccagctccaagtagcttaagcaaaacaacaataaactacctaaacgtattttgttttttctttctttctttttttttttttttttttttttttgagatggagtctcactctgtcacccaggctggagcgcagtggcttgatcttggctcactgcaacctctacctcccgcatttaagcaattctcctgtctcagcctcccgagtagctgggactacagttgcacgccaccatgcccagctaatgtgtgtatttttagtggagacatgtttcactatattggtcaggctggtcttgaattcctgaccttgtgatccacccacctcggcctcccaaagtgctgggattacaggcgtgagccaccacacccagcctaatttgttttttcataactgaaagctgagaagtagaactagcttcagacatgcctgagggcaagggcttaagtagtgtcatatggccttcatttttttctctctctccaatgactatctctaaaacataggcttcttcattctcagggcaggatctctcaagtggaggccgctggcagctccaggcttatgtctttctagtttaacaacccagagagattgccttaatctcgagctctggcaaaaggtcatagttgggctctagtagccagcatgggtcacaagcccatccctgagttcgtcacaatgactagcaacccatgggctttgatttagcaagcctacatcacaagcccaccccggaaccagcagtgggtccaaagctacctgccgtgcatggaccaaaagtgcagaaaggcagttccttaaaggaaaattagggtgctgttaccggatgaaggaagtttggatggtgggagggcaagagctgtacctggaatcctaacttttgcatggaaagagaagaaacagaaggacccaaagtttgttctgagcccacagtgacagataacaaaggatgcactcactcactaaaggatgcactatctcagtcatacacacacccttccatgacattgggggatggtcactagtaacaaaagtaggggcctagagctgccatctgagctgctcacctgtcctcaggtaagcaagtactgatactgcccccaaagaaaactaactctccctttcattgaaagttatcaggtagataataccatgaatcctctttacagaacatctgaagaaatgcctagtccctcacctgaattcttttttgtttgattttgagacagaatctcgctctgtcacccaggcaggagtgcagtggtgcgatctcctctcacggcaacctccgcctcccacgttcaagcgattctctgtctcagcctcctgagtagctgggattacaggcaccggccaccaggcctggctaatttttgtattctttttgtagagatggggtttcaccatgttggccaggctggtctcaaactcctggcctcaagtgatccacctacctcggcctcccaaagtgctgtgattacaggcgtgagccaccgtgcctggccacctgaattcttttgagctgttctttgttatcctgcccttaggaacaacaaaaaataaaaggcaaagaatggtagatttttaccatatgtaaccatcattatctttggtcatgttatagtatgatttgtttacaatatactgctggatttgtttggctaacattttatttaggatttttgtcattaatgtctataaagtagaatgacctgccacatttcttttttaatattactcttactagttttggtgtccacatataagcttgatagagtgagatattgttccttttctattctctggaaagttagaatggtctaaccttaggtcattcatggaaattttattcaaattcaattcatggaaagtttatttgaatttgcctataagatcattgagatttggtatttttgggtgtgtgagtgggaagatttttagctactgatatgatttctttttttttttttttttttttttttgagatggagtcttgctctgtcgcccaggctggagtgcagtggcgtgatatcggctcactgcaacctccgcctcccgggttcatgccattctcctgcctcagcctcctgagtagctgggactacaggtgcccaccaccacgcctgggctaatttttttgtatttttaatagagacggggtttcaccatattagccaggatagtctcgatctcctgacctcgtgatccacccgccttggcctcccaaagtgctgggattacaggcgtgagccaccgtgcttggccgctacgatataatttcttaaagttaggggactgtttgcactttctgtttcttcttaagtcagttttacatagttacctttttctaagaacttgtctacttaataagtttttagcttcatttgcataagctttttcttaccattctttgtgttatctatttgatctttgctgactttgtagttctgttgtattttcattcccaatattgtgctaactcttttttttttattattttttatttttttagacagaaacttgctctgttgcccaggctggagtgcagtggtgcgatcttggctcactgcaacctccactccctgggttcaagtgattctcctgcctcagcctcctaagtagctgggattacaggtgctcgccaccacacccagctaatttttgaatttttagtagagatggggtttcaccatgttggtcaggctggtcttaaactcctgacctcagatgatctgcctgcctcagcctcccaaagtgctgggattacaggtgtgagtcactgcacccagccttgtgttaattctttaattaaaaaacaaaaaacaaaacaaaacaaaacaaaacaaaaaaaaaaaccacacagatattgccagagtcatatcagtttgctgttttcaaaaagaaatattttgctttgttgctctccccgatctctttcttttccttttgcttttatttcatcaattcctgttttttattcttttctttctatgttttggatttgtttctgtttaaatttttttctttttttattttttcgagagtctcattctgttgcctaggctgtatgcagtggcatgatcatggttcactgcagctttgatctcctgggcctcaagtatctgggaccacaggtatgtactatactgcccagctaatatttgttgttttttttttttttttttttttttgagacagagtctcactctgtcgcccaggctggagtgcagtggcatgatctcggctcactgcaagctccgcctcctgggttcatgccattctcctgcctcagcctcctgagtagctgggactacaggcgcctgccaccacgctcggctaaatttttttgtatttttgtagagacagggtttcactgtgttagccaggatggtctcgatctcctgacctcgtgatctgcctgcctcggcctcccaaagtgctgggattacaggcatgagctactgcgcccagctaatatttgtattttatgtagaggcagggcctcgccatgtttctcaggctggtctcgaactcttgagctcaagtgatctgcctgccttggcctcccaaagtgctaggattacagatatgagcaactgtgcatggccccttttctaatttcttaagctggttgcttagctcattaactgtaagcctttcttctttcattaagtcagcacttaagactacatattttttggtgtgacctataagtttggatgtatggtatttattgctattaagttgtaagaatttttaattttccctgtaatcacttcttgttatccatgatttatttagtggtgagtttctgaatgttacacatttatggggatttaaattatctttttgttattgatttataacttaattgcgttgtcatcaggacatagggtcttcatgatttattcactttggtatccacaatgcctagcacaatgccaagaatgtagatgtcatttagtaagtatttgctgatataattgaatgatagttgagtgaacatctattgaccaggcgttagaagaattatctctgctcaaattgtccaatccttccagctacttgatattccaaaataactccacaaatgggcactggaaatataatggcccctcaaaattgtcttctatgctgctcactcctttcctcctttggcctggaaaacaggcactgagtgggtgagtgagaggatagtaaaactggcagtgtgagaccatcacacccagtctcatacataatagatttaggtaacggttctccctcttatttcttatatgacccagagaaatgcatttcttctttaatagtaataggctctattaatacattttaggtggcatttcctctagtggaatctcttatctcattgaatcctccaaaatattcaggcatgatattcccattttaaaaatggggaaatggacataaagctagttagtggaggggctggttgggttcgtgatgtgtattttttgttctgtacacgaaccatctccacctcatttttatcacttataatgacagggtagtaacaccttagacttccctaagggaatagaggtagataaaaacttgtgattgaattatacttgtaaaagggcgtttgaagacaaataatgaaaaatacgaatccattctgcactactcaatatggagtacatattgagttaatacacattggttaatacatattggttaaatgaatgaatggatgaatggatggatgagtgaacagctcttattttgatgagtacattttctgctttttggatcaacaacctctttagcatattaaagaagaaaagtgtctcagtcttttcctgagcccctaagaactgctttttttttttttttttgagtcagagtctcactctgtcacccaggctggagtgcaatggtacaaacatggctcatggcagcctcgatttcccgggctcaagcgatcctccaaccttagcctcccgagtagctgggaccacgggtgcacaccactatgcccagctaatttttttcttttctttgagatatcgtctagctctgtcacccaggctggagtgcagtggcacaatctcgactcactgcaacctccgcctcctgggttcaattgattctcctgcctcagcctcccaagtagctgagattacaggtgtgtgccaccacgcctggctaatttttgtatttttagtagatacagggtttcaccacgttggccaggctggtcttgaactcctgacctcaagtgatctgcccacctcggtctcccataaatgctaggattacaggtgtgggccaccacgtcctgcccagctaatttttctattttttattttttgtagagacagggtctcgctatgttgctcaggctggtctctaactcctggcctcacgtgatcctcacaccttaaccttccaaagtgttgggattacaggcatgagtcaccatacccagccccgaagggccttttgaagatgcctacttaaaaagtcttgaaagaggtccaaagggaaatgttagaacttccttattttagagcaaatctcaggaaatatggcagtgtttatacattataacatttagatagtacaacaacatttataacaatgtttgtgcattaaactaatatgtatacaatgtaacaatgatgcacagtgtaatattcatatgacatgagacaaactggaaaataaataattgtgctcctaaatgctttttaaagtaacatcagatgaggaggtcttccgctttcaggttaccctcttagcaagttttcttcctacttgctaataggtctacaaggtcatgccctcattttgtgtgccgaggcacagcgtgggcatctcccagccgttttttttttttttccgtcttttccttttgcatcctccagagggcctccttagccctgcagaggtaagaggtttaggcagtgagtagtgagggcagggagctcaactgggccccagagcatttggattcaccaacctttccagatagaagagacctcagaggccttattttctcaaacgagctgagaaagacttgctggaaggccactgcggagctagtggaaggttccggactagaacctgactttcagttccttctttattttttcttttaggaggtgggctccccgccctcacactcccttctcttcctcttcttcctcctcctacttcttgagatgaagctattgccagtcttgactgagggccaattctgtgcctggtactgtgtaaagagctttagttatgtgtgattctcacaaaaccccatgaattaactaccatcattatcaactcctttcacaaacgaggaaacgaaggtttttaggggcaagtaaacaaccaaccaaaaaacttgtttaaaattacaaagctggccaggcgtggtggctcacgcctgtaatcccagcactttgggaggctgaggtgggcggatcactggaggtctggagtttgtgaccagcctggccaacctggtgaaaagcccgtctctactaaaaatacaaaaattagctgggcatggtggcatgcacctgtattctcagccacttgggaagctgaggcgggagaatcacttgaacccaggaggtggaggttgcagtgagctgagatcgtgccgctgcactccagcctgggtgacagagtgagactctgtattaaaaaaaaaaaaattacaaagctaaaaaaatgagggcagcagaatttgaaccagatccgaccccaaagctggtgttcccacttgcctgtgttgtcctttgaatcgagttactagaggctcaagatgcccacgtcatagtccagacctctttgttcctgcttctttccttccctgcctccccttctctaccttcatctttctccccgccatccctttctccccagcactctaccctgattccgtgatgcttgaattttaattcctctgtggagatggggttacagaagagatgtgggctgttggggtggagttaagtttctcaggagcacaggatggctgctggacttttctttatggggttttgtttttgatcacagatcgattatttctttcagtgggaacagtttatagaacttagaatgcaatcaatgaagaaatatgttttgatttacagatattcacttttttattgtagtaaaaatgcgtaacaagaaatgtattatcttgaccgttttcaagtgcacagcgcggtagtgtgaagtgtatttacattgttgtgccgcagaactttttcatcttgccaaacaaaaactccgtatctattaagcaactttctctctttccccttctctctagcccgtgataaccaccattctactttctgtttctatgaatttgacctctttaaatatatcatataagtggactcatacagtatttgtctttttgtgagtggcgtgtttcacttagcatactgtccccaagcttcattcatgttgtagcacgtgctagagtttccttcctttttaaggctgaacaatattccctcatgtgaatgtaccacattttgggtattcattcaacggctaatagacatttgggttgcttccacctcctggctattgtgaataatgctgctatgaacataggtgtataggtatcacttcaagatcctgcttacaattattttgtacgtatatccagaagtaatattgctggatcatgtggtaattttgtatttaatttttggagaaccaccatacagttttccatagtggctacccaattttacattcccacaagtgttcagtttctccacgtcctcaccaacacgtttttttctattttttgttgttgttttttgtttttaattgttgttttaaatcatatcagctgtcttagtccctttggtgttgctataactgaacaccacagaccaggtaatttataaagaatagaggcctatttagctcatggttctggaggctgagaggtcctaatgcatggtgccagcatctggtgggccttctggctgtgtcataacacggtggaaggcatcatgtggccagaaagcaagagtgtgaatatcagctcgggtctgtctttgtcttcttagaaagccaccaattccatcatgggggccccatcctgatgactttatctaattttatttacctcccaaaagctccagctgtaatcgacctaagaattttagttgcatttcccacacttttaatactgtcacagtggcaactgaatttcagtacatgaactttgagggacacattcaaaccatagcagtagtcatcctaacagttatgaggtgagtgactgggttttaaattaatattctgtattaggcactgtgcttggagtaggggctacaaagataaagtgtgtttcctgccctcgcatcactcacagtcttatggctaggctagtgtttctgtgggtgtgaacacttgtgctagcatcagcttgatgttggtaaaagtactgattcctggccgggcgcggtggctcacacctgtaatcccagcactttgggaggccgaggcaggcggatcacgaggtcaggagattgagaccatcctggctaacacggtgaaaccccatctctactaaaaatacaaaaaattagccgggcgtggtggtgggcacctgtagtcccagctactcgggaggctgaggcaggagaatggcgtgaacccgggaggtgaagcttgcggtgagccgagattgcgccacttcactccagcctgagcgacgagtgagactccatctcaaaaaaaataattaattaattaaaaaaaaaagtactgattcccaggactctttctagacctcctgaatcaagagctctatatttttagaacaagcctccaaagacactcttatgtacaccattgggctaggtcagtagttctcaatttggctgtacattcaaatcaatttctgggttcctcccaggggttctgatttaactgggttgggatgggctcctatgttttagaacttcccaggtgattcaaatgtacagtcaaggcacatttggcgaaacactggactaggtgatttctaaattctttccagatgtaaaattctgcccccagcagcatttttttagttcagcaaatatttattgacttgtctcctcctttcagggctctgggtcagccagggtgtgagggtcaagaaaagactgggctcaaataggcggccttgagttcgtatcctgactcattcatgctgactaccaggataacctttgagaagtccccaaaccaagagagggtgatagaagcctaatgaagaaagtctctgtagaagatgagagaggttcactgtgccaaatgctgctaagaaggggtgaaggatgaagactgggaatgagaaaggattgttggatttgtcattgaggaggccattggtgactttgatgagagaggctttaatggaataaaagagaaggaagcctgattggagtcaagaacgggaggtgtgcaggcagagcagtgacaatagacagcaacttctgggaagtctgtggcagaggagtgcagagaagtgtgaagtacattgcgtcagttgttttttattagaatttcctccactactgctaacactgattggaaaagcatttattaagaacccaattgatcaggcacttatgagcagactcttgacgcaaccctttagtgtcagtgaatatattttggggagcttactttattatggcatttgggttttttggtttttttttaatatgagagtcaaattgttctgattgaagctaactcagagacattattaaagcataaaacttattgccagtttttttgctgaactacaaggggctaggactagtgtgtggggggcatctcactggagaaaacatttcctaagactgagaaccagtaccagttcccacatgcaggagaggatggctgtgtttttactccttcttttctctctacttttccttcttcatccatctcttttcttttattttcctctttacgatccattccgcctccattatcctcctcgttctcttttgcttcctttgcttggcacacgatgcctttatagatgggctcccatctcatcctccacccccagcccagctctcactgtgcactcctacgtgttttaactgctccagtgaagctccccccggctctctgactgtacagtgcctctcatgtctctgtgctcttgcacgtgctgttccctaccttcttcttttggcgaactcctactcatttgtattagggtactcactaagccactgtaacaaagagaccttgaaaacgctggtttagataggagagaattttatttctctctcatgctgcagtccagaggcaggtggtttcgggctggtagggaggctcaatgtgtagttttcagctctggttccaaaatggctgctctggctcttaccatcacatctgcatcccaactagaaggaggagagaagggacaaggggactatgcaccaattctgtttaaaggcatgacccggacattgcacatattacatttacttatatctcactggccagaacttagtcacatagccacacttcactgtgagagaggcttaaaaatgcagtctttggttgggagaatagatattggcagatgatagtctctgctgcaggatccttctagatccatgtggtgtcttctactccaggaaggctgtttcacctgggagtgcccccattcttctctccagcatgacattcaccatcctgagttgggattacctcgtcccttgtctgttttcaactagactgtaaacagacagggcctgtgtgtcatttatctttgaatccctagtaccgataccagtgttgccgcactggtatagcataaatgactcctgagcagaggcattgggggcagtgggactcgggcactgtgcctttatggtgggagggagggcaagggtggtctggcaggtcagccagctggttggccccacatgtagctccctcgcctccctgccttcctcactggagacatccaggaagctgctggtgcccatagaggggtggctgggaaagggcagccccattcctcagccaggtaaacatgcaatcctgaaaagtgtttaatccaaatatttattttaggttcatgtcattgtatctcttaccaagtccaaagggtgatggggagcagggtgtggctgtttcagccctgcactgtttgtgggtgtgacccgcacttctagactcccagggcatgtggccacccctcaactgggaggtggtatgtttcagggctctttctctcttgctccctctccctcacctctatggtcccagcaggctttagcctcttcccctcgtttcctgggcttccagttcctgttgggtcgtagcctccacactattttctgctactctggggtcgtctcctagagatgaggagcaggaagctttggaccctactggggtagaagcgtggggagagggcaggggattggcagagtgggttggtctgtaaccaaaaagttcatattctcagtcgggcatggtcatgcctataatcccagcactttgggaggctgaggcaggcagatcacctgaggttgggagttcgagaccagcctggtcaacatggcaaaaccctgtctctactgaaaatacaaaaattagctgggtgtggtggcacatgcctgtaatcccatccattcgggaggctgaggcacaagaatcgcttgacccgggaggcagaggttgcagtgagccaagatggcaccactgcactccagtctgggtgacaaagcgagactttgtgtgaaaaaacaaacaaacaaacaaacaactcggccaggtgtggtggctcacacctgtaatcctagcactttgggaggtcgaggcgggcagatcacaagatcagaagatcgagaccatcctggccaacatggtgaaaccccatctctactaaaaatacaaaaattagctgggcatggcggcatgtgcctgtaattccagctactcgggaggctgaggcaggagaatcgcttgaacccaggaggtggaggttgcagtgagccgagatcacaccactgcactccagcctggcgacagagttaggctccatctaaaaaaaaaaaaaaaaaagctcatattcttagttacctaccggcctgtttctcgtaacttgttattgtgaaagagccagctggcacttctgcaccttgtcctaggaggttttgggctccagaaatgtgtgtatgtgaggggccccttcccctaggtcatcgtcagtgtctagacctgttctcacctgttagcagcttcatgacacaccctgttgtgtgttcccagccctctgcagcgccctcacatgcttgtttgtgtgccacatctgccctcctctcttgcctgcaagctctaggggggcaggtgataggagttccattttagacataaggaggctgccatgcagaaggtcactgatgtgtaccagatcaccctggtgagttgtgatgggatcggaagtggtggcagggtcttctcactgcaggcatgggaagggtgcacgtgcgtatttcatgatcatgctctgagagtgacccagctgggaatgtttgctgctgctgatggactgattgagtccaagggctgaatttgcacacctgggtattctcacggccagcttgaaaaatagatttcctgggtatcccctgagaggtcctgttgatgtcaattttcaggccaggaaggtgtatcttttcccttctatgatgctcctccctcctatgattgttgagaataaagttctttcccatctgggatgtcaagctgtcccaggaggaaagaggaaacatcacttactccatcaggccaagcactttgctatggactgaacatttgtatccccccaaatccatatgttgaagcccattatccacaatgtgacgttattacaaggtgggtcctttgggaggtgactgcgtttggatgaggtcacaggggtggagcccccacgttgggactggtgccctgataaggggatgaagaaccctgagctttctctccgccctgtgagggctcccaccagaacctgactgtgctgcttacctgaccctggacttccagcctcgagaactgggagaaataaaagcctcgtgtttaagccacatagtctatagcgttcttgtcagagcagccccacaggactaagacacgcatagtattttagaacttctggaagttgaggctgctttcaaatcagccctgggccattgctagggtgggactaggcctccaggcactgtgagcctcagcctgaggctctgtgggatttggaattgtcagccaatgtccactagatattcttcatcctctgggaatgagagacgggccacaataaggtagatggtggacttgtctcttccgatgtgtctggtggcttaactgaatttccctcttgctttcggaagagtcttagagtcaagtatcttcatttccagtataattcgctttaatactctctagtatgccaggcactgtgtggggtgcttaagctatgattgtgaataaggcccttttcctgctttcaagaaactggaggttccgatgcacgtggctaagtatattgtaggaagtgaactgctataaaactagatgtgctttgcccatatgtgagtaggaaagtaggcttaactctcagtgttgccaaagtataaagcgcatgccttgagggttctagggaggaaatgtaaacttgccatttttgtgttttgaggtggttctggaggtttaatatttagtgtactttcaccagggagggattggagctgccagacaactgatgaggttattacaatcatttagagaaaagacagtggggacctggagtctttggggtaggggatgtaaggaaagtaggaaatttgcaagattttcagaagaactgcctggccatggcaattgtatgagagtgggacgtgaagggaagatttaaggatgactgtggtctctagcctgggccactggaaaacggtggcactgttaaccgagacagggctctgggaatggagcgctggtgtggggagcaggtgggaggggcaaggagttcacagactatgatacaggtcaggatgggtgaggaataggctcagagggaatgagaagaaggagccctcggggagatggggagattacaggagtcaggatccacagcatgtagaaactatgttcatgagtactcagttaaaaaagggatgctctgtgttggaggaagtatgttgtcctttctcctcactgggatcttttgtactttttgttatctctttatgggtagtcagggaattgagttcataggaaatcaaaaccccaccagtgatcaagggaggagaaccttctggaagcacacaatgccctggccaaggcattgcagccataggcacccaactactacagggtggagttaaagaaaggctctgtccgtacaccagaaaagcattctgttttggctagactgtgctagagtctttaataagactccaaaaataacaactctgttataaccagcaggctttatcttagagagagaagaatccagttaagaatcgctgcttgatttttttccccattaaaaaaaaatagtttcaacttttatttgagatacaggggtacatgtgcaggtttgttgcctaggtattttgtgtgatgctgaggtttgaggtatgatggatcccattacccaggtactgagcatagttcccagtagttagttttttgacccatgcctccctcccttcctcctctagtagtccccaatgtctattgtggccatcttcatggtcagttcccacttataagtgaacatgctgcttgatttttgaaaacttaaattccctcttagactctcttaaatattgcagttacttatgcaccaacctaatagtttctgaaactctgagcaggctgcatggatacagaaccaaatcccacttggaacagtctagcaccttgttactcaaagtgtggtccctaagccagcagcattggcctcatgtgggagctagttaggattgtagaacccaatgaattagaatctacattttaacaagatccccactgagtcatacgcatattaaagtttgagaagtattgatttggcacagtggattttagatacagttttgcattggattcatttaggtaaaatgtgtcattaaaataacacagctttccaagcctcagccctggaaattctgatttagtcaggcaattctcttgggtaaccaggtttggaaactactggcttctaaagattccaaaatttctgtcgatagacaaatggcaaaaattttagtaaatggaaatctagtttgaactccacgtctgtttgctttacattcatgataatggccaaagcctcatggctttttgaaaaaaaaaaaaaaaaaacaaacaaacaaacaaaaaaacccatgtctagattgacattagacatgacttgtccccttcctctcaggacatcttgatgcatgatgctcaagaggacatgtgtttcccctggccccgtggcagggaccatacactggcaaaagttgaatgggcttggccaattcactgcccagtttgaaagcaactaaagtcagctgatgtttaccaagtgctctggggatgaaagtaattacccaagaaccaaacaatgtgatctccattagttgcatagtttgtctctgtagaagatcatagcttgaaggggcctttcagaactctcctccagctctcgctttagggatagagaaagagaatccatggagaggttgggacctggattccagctggtttcattcaagagggaaggatattttgttgtttggaaaatggatcacatatttgttgcctaatcagaggcgcaaaatgaacaaactttgtattccatgcttaatctcaagtgctggggaaagtgctgtaaacacagaaagatctggctcctagagattggccaggaccgtaagacacatggagtgcagatgccctaggaattcgacagcgagttctccaacgctgagatctttaattaaacaggtgtttgggaagtaggtcctgtgtagcttccagccttggctgggctcgtcttgctgaaaaatggcaccgacccagcccagcagcaggcctgaaactggcttcacttggaggtgtaggaatgtgccattgttgttttcttctttcttatcaagccccattagcttgagcaaggaaggaacaaaaatgggctgggaaaacatgttatttcactgggtaaaaatttactaccaaggaaatgatttttgccatatccaaaaaaggaagagtggaggccttggaaaggtgtgtcttccaagggctcttggaaagcttctcccagtgtcacccagtgagaatgtttccctttggctgatggccgttctcacacaagaactgagatattcagccgacgttaggtacacaggctcacaaagtcagaccttgcctgttcacagtattggagcaaagaaggcatgggaagaggcaagaatcagattgtgaaaaggttgatcatacatggccattaggcacacgtacctttatgcttttggatgcctacaattatagaatcatagatgggcccagagatgcctgggtgcagaggtggagatggagactccatgaaggaatgtaccctggctttccttacctcttgtccagatctcccgccatatgcctggggctcaagggggagaagtccctggctttggctgtagttgaatcacagaactaaccatgcttatagcccatgaaacccctgggctgtcatcctggtgtctttagtgaattctagaacagcatctgcaggaggcagagaccaaccttcttctatcttccacagctgtcagaaacagcacctccccggggaagggagctatgtgccaggcagtcaggctggcacctgtgctcctgttaattcatgaactctcacatctacctacgaggcaggctacatcagccctgttgcagaacacccaaggatccagtaaattgccctgccttatttagttaccaaatgtgggagcctggattcacacccagctctgtctgctcccaaagttcttattctttaacctgctagtcttttctggggagttctcagccctttggtgtatttttcttttaaactttggtgcttggagaatgacctagaaaatgttctccctatgggcatggggaaccattagtgttttgttttgttttgtacagtttttaaaggacattttatttctgttagaatttgtgttatgaaaacaaagtattttcaactttcaggaataaatgctgaactgtaaatacatatatgtatataatatgtgcattcaaatataacacatagctatcatacatatgcatgttatttatatttgaacatatttatgcatatttaatgtgatatattaagtctgttataactgcctatagagattttatttaataatctgtgagttaatactaagatcatacttggaaccattacttttatatgggatagaaaagtgggttgtgtgatgttttctgagaaccagcccactcccaaggggaggacataaaatgggcataaatcaacaatgtaatacccacgaagctgtctgagaactccatacagtgaaggagaggagtgccaatcaccactggcttcctctgcagagtcctgctccaaggactggaacggtcagcagatgtgtgggctgtggccctttcctgtgctgtccgtgagtcacaatggaaggttctgttcattttgttgtccccgagattgttggacagttgtattttgatgtgttgaggccagtttcttcatctggtgcctttgtaagatcttttctgtacttgaaggacattcttttactcctttaaaacacaccagcctgagggacatccctttattccccttgtctttgcatatctgcccacgtaaagcttactgtctggctggggaatgtgagacatagctaagggtatgaaatcctaaaagagtttcccaaatatgtaggccactgtcctggggcctgaaagccctttctgtctatggcctccttggaaggcatcgaggaggtgatattgatgggttttgatgactttcctaagtgagcagttgtttcagattgagaaggccactctgtggatgtctcaagggagaggtgccagtgcaggtgagactgcaaggtcaccagagctgtgctgcttgatgcagatgacgacttcttcctggcaggggcagtgctgggcttttccaggttctgggagagctggtgagcgctttcctccagttgccagggtgctggtcatctgggcagcagatagtcactgcctcacctgtggggagccaagctatggttgctgtggcagaatcctccaagtgcccaggcacccgactggtgtgacagcagccaggagggagcagggagatgagagaactcccagtaaagtctgcttctgggtaccatacagcgggagggaatatgcttgatgccagctcttccaaaggtcatggaggctggggaggacacacacacacacacacacgaacacacagccgctgtagagcataaagaatgaatgaatgggggccgggcacggtggcttatgcctgtagtcccagcactttgggaggccgatgcgggcagatcacgaggtcaggagatagagaccatcctggctaacatggtgaaaccccatctctactaaaaatacaaaaaaattagccgggcgtggtggtgggcacctgtagtcccagctactcgggaggctgaggcagaagagtggtgtgaacccgggaggcagagcttgcagtgagcttagattgcgccactgcagtccagcctgggcgacagagcgagattccgtcgcaaaaaaaaaaaaaaaaaaaaaaagaatgaatgaatgaatgagtgagcaagtgaatgaataaaggattgaatgcacccagcattcttttctcttaggggactcttcctgactactgcacaggaaaagaaagcagaccctgtttgcccatgaggatactgacccttgctcaggttgtcatagcttgtacttttccactgatgcggaaagggaggccctgccaaagaatgtccttggagtgattcaatgtatttttccttctgtgatttaagtcaaatgtatttaatgtaagaagttccgctgtgagctggaatgtgtgatgagtctttcagcctccccccgagaaagcccaccgtgtgaacacttccagttttagctccatcaggtgtgtaagctgacagtggttggcgtggtggtggctgtttttaaagtacacacacccaaatgggcttgtcagctagttggctggaaaaacctttctgggggctgcgagggattgatgtttgccgttcatgtgttcattcattcaatagttcttgaacattaccagggacacagcattacaccaggtgtgttttcaggctataaaggtgagagattccgccccccccgccaaaaaaaacttcagggacttattgacgtctcaaaatatagtttctattgacaattcattaaacaagttagtgaaagttaaaattttaattttaaaatctgtattttaaacaaaacaaatacaaaagtgtcgtataactgagttaattcttttattttttgagatggggtcttgctgtgttgcctaggctagaggtcagtggtgcagtcttggctcaccataggctcaacttcctgggctcaggtgatcctcccacctcagcttcctgagtagctgggactacaggtatgcgccaccacacccgattaattttttgtatttttagtagaaacagggttttgccatgttgcccaggctggtctcaaactcctggactcaagcaatcttacccaccttggcctcccaacgtgctgggattacaggcatgagccactgcgcctggctgagttaattctttagttcagtaaaagtgctggagtttttaaaagagtgaacttcaaggattttgatcttcggcctgaatacttcgcacacatgcccacgatggggccctttgtgcccttctgagtccagcctggcctgctggcatgcgtctggtttctctctgtaggacttggcaggcacagttgtgtgggatgcaaattacgcaagcacagaggcttgggaacttgctgccaccaagcctctccagtgattcttctcctgtgttggtcaccctcacccttcattcccctcaaggcaggaaaaagaacagaaattcctaaggcagtgttgttcccagcacacaattgccatccatcactccctgctgggaaaatgtaaatacgcaccagccgatagtggcactatttattgtcatagacttcactgtggatttgagcaggagcagcttctggccaagcattattcaccagctcccctgggaggctgtgctcggtgggcagagctgcatggaagggaggcaaaggggaggctggagtccttgcagctgagaacagggctgggtctttgccactgaggctgcacatgcttaacatcagggtggagtggaggctgccgtcatcttggcactaggttcttggaggtcgttcatgtttagaggagggaaagccacttccataggattcccagacagctgtcattttggggtagggtggggactgatcagcgttgttagtgttgggctgttgcaggtggatggtggatttgtagccatatcacctgaagccgagggaccactgctcacccagttgaacgttttactgaagctcacaaagccctatgctacacaaggcccttgccctcaaggagcttgcacttttgggtcttagacacccccatccccaccgtacgtattcaaagaagccaactgaatggatgatgatcaagtctgcaatctgcagtgtcaggaggcagacagcgtgggagtggggtcagtaaaaagcaacaaaagctcagccctccctcagcccagtctgccagctcccccctgaatctgcttggtcctgggtggcatgacctctgttagacctgcacggagtagacttagagtcaggcaggcagggaggcctggactcagctcttggcttggtgcttactagctctttccactcagttttcccatctgtaaaatggggattgtgagcccacctcacagggtgatgtgagagtaaatacaagtaacaaggtaggtgtcaggcacataacacaggctcagtgaattgcagctttcagtattacttccgactgcaccatggtccattcggtgaaggtggagaaaaggtgtagatgagcaaaccctgatgcaggaatgaagaggggagggaaggtgacccaccaaggtgcaggtgaaggcagggctgacaaggagaaaaggttttggggtcctctggaccaggcagatccaggaggcaccgtggatccttgtggagtaaattaatgtgtgaatatttaatgaaaagtctcttcctttaggtcaaagtgagagtgtggcatcgggaggtccatttcaggatcttgggcgctctcccctaaagtgcagtgcaggggagaaaggggaggaggatgtttcagtttcaacaaacagttttgagcactgactgtccacaccagatggcttgggaatgaccatgaatatggctcgatatctgtgctctgaagctctaagttaagaagggaccgaggtggatgcaagtatcttcatgccaccagacagatggcagtgggctctagagcagcatagagagacttgctgtgagcagaggacagacagagattagccccaggaactatggagtggagcgaagactggagagcttcagaccgaaagattttcacgggtgaataccattaagcaactggactgccagcttctgttggcagggaactttttttttttttttttttttttttgagacagggtctcactctgtctcccaggttggagtgaagtcgtgcgatctcggctcactgcagcctccacctcctgggctcaaacgatcctcccagctcagtctcctgagtagctgggactacaggcgcatgccaccaggcccggctaatttttaatttttagtagagacggggtttcaccatgttgcctgagctcgtcttgaactcctgagctcagatgatccacccatctcagcctcccaaagtgctgggattacaggcgtgagccaccatgcccagctggggacatttcctttacttctgttttgttctcagtggtgtttatcatagtcctgtgcacacagtaggtacgcagcagacccctgtttaacatatgaatgaacaagcctaatacaaaatggctttctaaatcaagtaatggttattgtcaaggtaatgcaccttcaaagagcaatggcataggatggcagaaggattcctgaggataagggttcccttcttggccatttccctttgtggatttctggtgagcagactagctcagccttcagtagaggtcagtgtctcctagaggtgcccatcggggaagcactgccacctccttgggtgtaacctagtgaccttattaactgcctcccagccaagatgagccactggcacccctggtggctccagggctctagatggatgtgagtgacattctttggactatgtctgtattacagatgtggacgagtgtgcaacagattcccaccagtgcaaccccacccagatctgcatcaatactgaaggcgggtacacctgctcctgcaccgacggatattggcttctggaaggccagtgcttaggtaacagctctctgggggggtcacagggactcttggaagttaacggttgccaggggcattttgaggtatgggcatagctggctgcctgagggtagtaagcttttctttgctagggagggcgggaggggtggaaggctattgaactcacatgtgtaaccacccttgaaaatcaattgccatcatcgccatcttgtcatcattatagtttttgaatgtatttatttatttttgagacatagtcttactgtcccccaggctggagtgcaatggcgcaatttcggctcaccgcaacctccgcctcctgggtttgagtgattctcctgcctcagcctcccgagtagctaggatcataggcatgtgccaccacgcccagataatttttgtattttttgtacaaatggggcttttgccatgttggccaggctggtcttgaactcctgggctcaagtcatctgcccgcctcaaaagtgctgagattacaggtgtgagccaccacgcacggccttgaatggtttttttcggtttttttttttttttttttttttttgatatggtgtctccctctgttgcccaggctggagtgcagtggcacgatcttgactcattgcaatctctacctcctgggttcaagtgattctcctgcctcagcctcctgagtgagtagctggcgtttcagtcatgtgccaccatgcccagctaatatttgtattttttgtagaaacagggttttgccatgttggccaggctggtctcgaactcctgggctaaagtgatctgcctgcctcagcctcccaaagtgctgagattacaggtgtgagccaccatgcccagcctcaaatatattttttaagggctatggttttggatgtattttttaagtttgattttaccttgactttcttcctgtcttcacgaagtttatatccaggccaggaagtgacagaggtgaggatgattttgctttagttagaaataatgctaagagaagggaacactttcgcttagtcacagaaatgtggcaagtcttgaatgtggatcagtagatcctgatcttacatcagttcctttcaacaccctgtctttgcccttccccgccaccaaccaccacacccaccccaccggctatggccttccattttactcctgaggagtcagtcatcaccaattgagaactgcctttgcagttagcatctgctctctgatctttctgtttattttactggaaggttattttcctttcttcccctctagttttgggtttagccaagtgagtgaattcacagcaaactctagctgtcacttcaatttctaattctagggtgtgatttctatgctgtgttttctagaaaaggccctgccagtttaaattctctaagacaccattctgttgcctgaaagtcagtcctggaggagttgagaaacagatccaaacgaaatcatggaaacaaagaaaagctacctctttctaagtttcttgattgaggctgagtaggtctgccctcaagccccgtccgaagcatccttgaggcctagattggcttgattctcctttccaggcttgcacatgggcgtctgtgaatatgacagtcactgtgcattcaaaccaacctctgctataatggaaaatttgatgctacttatttgaacataagcagatcagtgacagagagttatttgtacaggaacttaatatgtcgaatttcagagctggaaaggatgttgaatattatgtcatccaacttttatagcatcgcagactgagactcatagagaaagaacattttagacaaagtgagttgggtctaacttccaagtctcccgtgtctcagtctagtttttttttcccaccacaaggggcgctggagtggtagggggagaccgggctataccagccctgttacagaaaccctctgatgtgaggggtgccagcaactcggacattcctctacctgggagggttgttctcttcctgggagcatggagctgtggaaaggatgctcatggatgcctagcatggtaccatgtggcccagccactcatattcacatctgaaaggaagacgtcgcctaattatggctgaactcctgccctcccctggctaaactcacctttccctttcaaaatgcaagttccatagccacacactgtctgttctgtgtaccactgaagatgctgcttttgcagaaaaatgaggggtcaggggggctgccttttttccaaggtacccgtagtgaagggtaccctctccagcccctgctgcctgcctggccttggtgatgtgcccaactgcactctgggaagaagtcagggccagccactgtacagccaatgggccctctatgcaagagctgctctgcactcaggggcagtgcagtggccaggttagaagtagccgggacttagagacaaaacagaatcacaggacagggcacagaatctgagaagggctgaacaataggtaagggatcaagatggatctgggaggtggagtccttcctggcagtaggtagaaaccaggcacaaggactgaggctctaagccggcttccagagtcctggatggcccctggttccaaaggaacagggggaccagggaggaaacctggttagattgggggaggtggggataaggaccagttccagctacagtcagatcaactggtcacagcaggagcctgtattggtgccatctcagactctgccaggaggccggtgatttcattcactacccttaccccacaggaatgaattctccagcccattatcacatcagcttggggtgttgagaagtgctttcccaatgacatcaggctccccattgatggatacatattacagggaggtcacattgcccagctctgctcaaaggatccattcacccacagtgccgccgctttccctggcaaggccagctgtggcttggaagagatgtgtttatccagagttttatgttcactctggtgcaaggaggagattcagggtgaattccagtgccctcatgttactggattcatgggtctccagggtcatgctgcccagctcatcccagcctaactggctcttgttcctgacagctggacatattcattgttcatggagctggcaaggagcctattggagtgatgctatggattcttcttacgtgttaagaagaatcctgggcagtggagcctctatatggaatctttgagttgaatcttaacattggataaatcttaagagctgggtaatctcaaatcttagagctgggaaaaattggagagtccatcttggataaaccttagtgttgaatcttagagctgggtaaaattggagagctcattttgcccaacatcccaatcgaagcagaaatttcttctgcaacttttaggataggttcaggtatttatgggactgagatgggtcgaggaggggaaagattgtggggagattgagccttgtattcgagacagcatcaccatccgtgacactcagtaggcactgtcttggctcctgttcccatttgcttccgttcatgatcctgtttgggaagagcaaggcaatcatgccatgctagtgggggcatcattgagtgaggagacctgtctcactttgcttgcatttctgtttccagacattgatgaatgtcgctatggttactgccagcagctctgtgcgaatgttcctggatcctattcttgtacatgcaaccctggttttaccctcaatgaggatggaaggtcttgccaaggtatgtgacgtgcatgataacttggacatgatgtgagacactagctgcagccttcttcagcacctggcagcttatgtttgtgggaaatactgctgctacagtatattcccattccttgccactgcccgcccatccccattactacagaaacgtgagacctgaaccttgctatgcgaagcatctcaaaaagtgctctgaatatggctgagggtaggaccccaatcctccactggctgggagtgtacagtttcatggattcgcttcttttctgtgtctgctatccagaagtagccttgctggctttcttgcctaatcagaaatttggttgcatgtcctgtagcctaagttcagttcctgaggcctgaggagggttggtcagggtccctggccctccaagaatcataaaataaacacatccatgctaggcaggggtgtcgtgggcgattctgaggtctcttgctatacttttccctccaacctgtgccaggatggcctgttcctcagcaaagggtctggtggtggtggtaacatcccctgctactcagcgtgcccccacaaaaccagactgaaacaaaggcattttgtggttttcacatgatcatttgaaatactgataagtaagaaaaacaagttgcatgcctattgtggtttccatctgaaggtttcttctgctcaggaagtgaatgggggacttaagacccaaggaattagcgcaaatcctgctttggcccccgacttccccctcaaattccagctcccggcccaggcctccagcccctggcagctgcttggcccaggttggagttggaggcagtgctgcagacgcagaatgaggtctttgtctggagacctcaggctttgcagggcccatttccttgtttcattcacccttggagttctggctggcaggctcctggccattgagtttggaggctattaggtctcctttactttaattgtatctaaatcatcggtaaataggaaggcatcagtgttaaagagtttgaccctggattctttctaagtctctcctccaaagcttgttctgctaattgttccaagaattctggactgtgttcctcacgccaaaagaggtcattttcttctgagagtagacaccaggccaggaggttgaggaagcggataaacaagggcccttccttcccactggagcaggagggggcgcctggctcccttgctgctgtgataagcagcttagggcagatgcaggcttctctgtgccaaggcctgggattggaggtgccagccacaggctggcaccgtgcccccagtacctcctgaggcatagccatgcccaagccaaaaggtgcctgcgtctttcaggcctctgagggacaggtgtgtgacaaagagcagataatacacctggcagtgccaagtccacagcataataaagcagcaggcccggcacccaggcctgggtatgggcactcagccactgggatgctgcatcagcagggcccatgggcagcacagggcgtcgcatactccggtgagcttttgcaatcctgactcttcgtgtgtggaagagtgctgtacacgctagagcattgtcacgtctgttcatctcactgaacccaaataataaatagcctcttgaggtcagcaggcaggtgtttgtggctctgcttcactgaggaaataaaggctcaaaaaggttaagcaacttggccaaagtcacacagccacgtggtagcagatctgagagtaaaaccaggggcccagacttcttgtccaacaggttggagtggggccctgtgtgccctcagcagattcagaagggcatttggaaagggctggcaggaaagggcagtgagaaccccaggggggcagaatcattttggtcgccctgctcttcagaagcagctgagagcggtgagggggtggaatgagttcattcacctccgagtggccagcgcctggccagaggctgaggccaccagccctaacacttgccggcactgtcctgtctgaacttgcactcagtggcttagcacagtggacattttcctaccccctcctgtccccggtggggaaaccccaacctcccacgggcactggtgggggccagtgtcttgctagaccctctctctacagctgttcatttatttgttttctccctgagagctccagagatgctaggaggcaggaactttgtggccatgggattagcctcccctgtaagaaaagcctctcagtctgctcaccgtgaaggcttttagctctgaaaacactgacatctcttttcagaggcctaagaggtttacatggacttgggaagaggatagaaaatctctcagttggaactttggccattggtgtatggagcattgtgggatggtgcttacaatgggtcaaccaatgccagtgggaaagagactcttccctgccctccccgcacgatgagctgtgcagaatgaatcttggtttttgtggaaaaacccctgactcatgttccagttcccactgtgtgtccttgttagctggtggacttgggtacacctctcaatcttcaaaaacaattatatgtatatgtgtgtgtgtctgtgtgtgtgtgtatatatatatatatgtattttttttttttttttgagacagagtctagctctgtcaaccaggctggagtgcagtggcgtgatctcagctcactgcaacctctgcctctggggttcaagcgattcccttgtctcagcctcccaagtagctgtgattacaggcacctgttaccatgcctggctaattcttttgtatttttttagtagagacgggacttcaccatgttggtcaggctggtctcgaatgcctgatctcaggtaatccacctgccttggcctcccaaagtgctgggattgcaggtgtgagccactgcacccagcctataattttattttatttttttttgagacagggtctcactctgtcacccaggctggagtacagtagcatgatctcagctcactgcagcctcaatctcccaggctcaagtgattctccctcctcagcctcccgggtagctgggacctcaggcgtgtgccacatcacctggctaatttttaaattttttgaagagatggggtcccactatgttgcccaggttggtctcaaactcctgggctcaagcgatccacctgcctcagcctcccaaagtgctgggattacaggcatgagccactatgcctggtccttcaaaaatgcttaaacaatcttattgatgcatagtcagtgtataataaactgcaccatgattttattaattttgacatacgtgtacccgcatgaaaccaccaccaccacactcaagataatggatttcccattagtccttgtgtcccttggtggtcttctccttaacctacttaacctctaaagtgggccaatggtcctcgttgtaaggatcaagtgagtgcaggatccttccctaatgagcaaagttatttatgcataataaatatattattagaatcatcatggttatttgttaacctgaaacttccaagtcagtgagggtgaggggtgttcactgatggaatgcaaccggtgatggaaggagcaggtattgcctggaaattcctggttgggggggtgcgttggagcatagacttaccagcaggtgtatatgtgtatatgtttatatcatgtgtatacatatggtttccactttgcctgacttttgaccccagaagggacatgtggatggaggccccggtccttaagtgaacacttttggatctaagatcatgctcccaaaggtcctgggtggagagccttggtacctgggactctggtctcctggtggtggtagatttcgttgctggtgctttttctgcctagttattgtggctgttctgttgggaggacagtcagcaatgtgccttggctttccacagatgtgaacgagtgtgccaccgagaacccctgcgtgcaaacctgcgtcaacacctacggctctttcatctgccgctgtgacccaggatatgaacttgaggaagatggcgttcattgcagtggtaatgggctttcgcattggaaacttccacctgtacttggggcctgggcaggggttgaagggcaagggcttccttcataggtgtttcctctcatttcctggacacatgtccagtttgggacatcctccagggcagtggggtcagaatcacacagaacagagatgagtcacttcccaaaaggtgaggtggagtctcatcttccttgtcatctgacccttgatgcaaaaattaatggggctaccttctaggacagaggtggggttgaagagggagagcagtcacccgatttggcatgttggtttgagagctgtctgtcctcacccagcaccgactcaagtcttggggatatcacagaaagtacttacagagggcagtgacccaggaataatagcatgtcttatcgggtagggttggggggaacattgaatgaatgagaacatgtatggaagcacatatgttctgtgaacttctgaaatctctacaaataatcagtgcctcactccaggcctggcacccagggaacatgcaaaaaaaaatagttctcgaatcaatggataaatgattgaatgttgaatgaatgaaatcgtaataatttgttgtgagaacatagatatgatgggttagttgaccttttataaattccttccaagcccaaggaaataagattttctgcccacactagtttatggactctattataattttcttattaactccctctttttttcccctagaaagttaaattttttttcttagttagaaaaatattattggattgtaaactccttgagaatagggaccacctcttactcacatttatctctgtagcatcccacatagggccacacacaactccttttctttctttctctctcttttcctttcttgccttgttttttgtaaaggttagattaaagtacactccatttcagccacttctggcatcatcagcagttgtgaatttgcaaagtctaaattaataatgcttcactgtgctttcaaaataagtgggccatacactagggcgtgaaaaatctttctgtcctgcagaatggaaagtttcctaatccgggttttattgtaacaggaactgacccaggtcatgaatggaacttgtgtgatagtctcactgacaactgaagtgttctggggacagcgtcccatgaaacagatgaacacctctccctagggccaggacagtcagagccacaagcaggaagttccagagagccttgggctgattaaatacaaggcccagaaacagaaataaaataccctcaggcatgaaaagccactttcttcctagatttcagttccctccgtggcactccttggggagttggggccaaggaactaagaagtgtggaaaatccaacattatgtggtgagatgatttgtttctccagaatcctccgttaatccgcagacgtttattgccctactgcataggccatatggtagagtgaccctggaggacctgagttcaaattctagctctgccatttactatttttcttgaccaagtcactccctgagtctcagtttcatcctttattaaaaaaaatcaaccagccaaccaaccaaccaaccaaccaccctcatagagtggtcaaaaattaaataagttggcacggcccagagggtggcccagctccaggctggttccaggctggctggaagctgctgcttcccatgtcccagggaggatccaaggtaggcgggccactgagagacaaatattcctgcctaccccacaacactctggacttttctctttcaaggaggttttttttggacacagtggagttttagtcattacatgttaatttatcttccctaagtgtaggtgtaagagacttttggcttcttgagaagcttacatccatgccgatttggccaagattttcagttgactcattttgccccaaatggccaacttgtcctccatgttctccatgatgcacaccctcctgaagacttggtgtgaccccgggatatgtaggctttctagagcagactggcccaggataacagggtgatggagagagtctgtttctgcaccttcctacttaacccctttctgcacttctccatttccgcaggcactgttatcctcactgtgttatcacggctggggtggcctctccgtgtagccccagacccctcctagccttgtctctcagggatttgctaagctgagctgttcctggaaaccatggtgggttctcatgtggaggagtgaaagtggcctaatacatgctccctgccagaaactgggcttgtatttcagctttccactggagggtggagccacagccctaagcaaagtctgggaattgcagacccaaagataaaccgagtagggtctgttacagcccctccctgcccagtgggagttgggagtaggtgctacgctctccatctgccctggagctaaccctgcttgggtgcttgccccaacctcagggctccccagctccgctgatccctcagcacagttactcagggagacgttacagtgtcgtgtttctaagtgtaggatctagaggctgggttcaagtcccagctttcctccttactggttatctgtgaacttggtcaagtcagctaacctctgtaagtctcagtttttcttctgtaaaatatggagagtgatagcacctccttcatggggttgaggtgagaattaaataagaggaggcatgtaaagcatttaacccactgcttggcatatagggagcctcaggaattgacagacatcactactactctactgaaagtatgagtggaatctacaaacttggaaataaaataggacagtcagttatgatgggctggagccagagacccggggctctacaaggcttctaggggaggcggggaggcacaaccaaatcagatattacctgagcacacgtgacttttcaaatcagcatcctaattctgctggctgataacccatcacctgaggacccctgagagagacaggaaggagtttttccttctgggatgtgagaggcacaaggcgtgtaacacccggaattatctgatggtggagaggcagcttcttttgcgttgacaccctctctgggtgactccagccaccagtggtctgtgagtgagagagtaatccgaggacatgtcacatggggaaactagtgaaagcaagtttttgggaaacaacaaatgcaagaacaacatgttttctttggcatgcttatcgaatgaggctcaaacaggggctctgttgccaaactctgtgtgtgatgaagagttggcttttctggaacgtctgcttctgcatctgcatcaaccgccatagcccatgcggatgagttgtaaatcacatggacaggggctcccctccacgtcaggctggctggaagctgctgcttccattgtcccagggaggatccgaggtaggcgagccacaaagagaaaaattatatccctgcccatccctcaccactccggagttttctctttcaggcagtttttttgtttgtttttgtttttgtgtgtgtgtgttttttttgtttttttttttacacagtgaagttttaatataattaaaatcctggccttttggatatgtcccttaattgtgactttaggaacaatattgttcctgaagttggggaaagaggtgattggaggggagttggcattgcgaaagttgccccttcagagggccctctagggccagggaatgtttttttgggaaacccccagaaaatcccagtgggcaaagaaatctcagccccttaggcaggtcagaggcggagggtggattcccctacatggtgaaataggtttataatgaatggaaggtgcagccgagtgagaggcagatgttgaaagctcgatggaggtggatttcagctccatgtaggaaataattttctgacaattagagctgtacaaatatcaatggttatcctcagtaggtagtgagctctccattgctagaagtgctggagaagtgaattgacagcttcttggcagtaaagccattgtatgtatcaagacagtgtgagagttggagtagatggccactaagctcccatccccatgtagactgggattacaaacagcaggtgtgacttgtcaccccagatatggacgagtgcagcttctctgagttcctctgccaacatgagtgtgtgaaccagcccggcacatacttctgctcctgccctccaggctacatcctgctggatgacaaccgaagctgccaaggtaaggctgtccggaggggcctggctggggtgtatgtgtgaggtggagctgcttcaggggctcatctggatatcctcacctggggaatcatgtgcagctttgggaaggtggcaggggtgggggtgtgagtgggtgctggtggctctcatagtggcagctctgggcaggatgcctggcctgttgtcttccttccctgtaacccgtcctttggccaggatattggccacttaaacttctgtaatgaactctgcagatgcagacggcagcctctaagcgtggctttctgcctccccaggcagatctctgaggctcctctgagaactgctccagagctaagcaggacttttatggcctggccagagcccgggctttcttacgtggcctggagggcagtttggttagcctttctccaagtgatctcctagagcatggttgccagggagacctcatgcacctgactgctctgttcctgcaagggctgggaccccagactgtaaaaggggtgggccttctcctgtttgcctgcttagcctgggttccagccccatgctccacccactgaggggtcattgcagaagcaactgacccattctcagcctccttgaacctgccttatcccattgccaagcaagaattctccgtagtagtgccaggcaatagaaatatcatgtgagctacagatgtgagccatctatgtaattttacattttctattagccacattaaaagaggaaaaaaatgggtaaaattacttttactactatattttcttttctttctttcttttttttctttttgtgacagagtctcactctgttgcccaggctggagttcagtggtgtgatcttggcttactgcagcctctgcctcccgggttcaagcaattctcctgcctcagcctcccaagtagctgggactacaggcacatgccaccatgccgggctaatttttgtattttgtatttttagtacaggcgcatgccaccatgccaggctaatttctgtatttttgtattttaccatgttggccaggctggtcttgaactcctgtttttactactatgttttctttaatgcagtatatccaaaatattatttcagcatgtattcaatataaaaattattattgatgagatgttttacattctttttttaaattaaaaaaaattatatatataaataaataaaattaagagataagaccttgctttgttgcccaggccggtcttgaactcctggcttcaagtgatcctcctgcctcagcctcccaatgtaccgggattacagacgtaagccactgtgcctggctcacattatttcttggtactaagtcatcaaaatctggtgtgtattttctacttacagcacatctcaatttggatcagccacattccaagtactcagtagccacatatggcctgttgctgccatattggatagtacagctctgtagtaagatccagcctaccccacccccacgcgtctggcctggccaataatgccctgcctccgcttcttgtctcccctgcatttcagacatcaacgaatgtgagcacaggaaccacacgtgcaacctgcagcagacgtgctacaatttacaagggggcttcaaatgcattgaccccatccgctgtgaggagccttatctgaggatcagtgataagtaagtcacggcgtccccctggggaatagaaacctgatgagggcctggctcaggaggttggaggtgtggtgtgaaagagagtgcaccagccaggaagtgaggggacctggcctactacctacgtcatgtgctcatgcgtgtgtgtgtgtgtgtgtgtgtgtgtgtgtgtgtagaatagaacagagtagaatagatagaacagactggaatagaaaatatcagagtacattgcacatagcaagagtcaatattgttttttgaaacttatcttttagttttgtgtgctactggtttgcagtgcaaagtgtgttactgtaggttgtcaaaaagtttgcaaaacattccattccaagttatagggtctgaaacacatccctatatacaagaaagaactatttttcaaaatgtttgaccacaacacacagtaagaaacacatgcaaggctgggcacggtggctcatgactgtaatcgcagcactttgggaggctgaggtgggtggattgcctgagctcaagagtttgagagcagcctggccaacatggtgaaaccccatctctactaaaaataccaaaaaaattagctgggcctggtggcacgggcctgtagtcccagctactcaggaggctgaggcatgagaatcgcttgaacctgggaggaggagggtacaatgagctgagatcgtgccactgcagtccagtctgggtgacagagtgagactctgtctcaaaacacacacacacacacacacacacacacacacacacgcacgcacactcccacagagttctctatcactccgctactcatgccagagctatgcaaagattctctagaaagctaaccaagccgagagttgagtcagggttctagaatctcctcttccctctaatgactttgttctggatacatggggtctttcagaggttggcttctaaatgtaacactcataggactcacctggtgatctcgttaaagtgtgattcagtgggtttggggtggggcccaagattccgcctttctggcaagctcccaggtgaaatgaatgcttccaatctccctggactgctccgtgaatattgaggtgctggagagttgagtattgaggtgctggacagttgagtattgaggtgctggagagttctctcgttggtgctaatcaagtttctgacgtcatcttggtcaacattttactaaatcaccagacggcaaatattagagttgaggagagaattaaagtgaagacaacttccaaaaggtgaatgcagtaggacagtggctttctgttcctggcatagtaggagttccttttccttctcttttatcccttttttaaaccatctcagttcctccttggcctcctatattccaaatgttcacacatcgacttcccttgagcaacaccaaaccccgcatgggagacgaaaggatgaatcagacacacccatcctgccctctcggaatacagcctctaagagaggaattcatggcttaccagtggtacccactttgataacaaattggcaaaagagaggataatgccgggacaggcggatcctttagggacatcttcacttgttgctaagagctgtgctactaagcaaccctttagaacagggctctttgacccccgacgtaaggcctgtttgtggcagagcagagctccaggctgctcttcccagcttctattcctggttctctctgggtttttccaggccaccccgtctgtggctggggagctgacccatttcagcttgcagcactgagctggagttactggtggagtctctggcatgacgctgacaatgctccgtgactccctcactccaggctccagtccagtcagactccggcagccccttccagctccttgtccagttcaggtgtcctgtgctcctgccagtctgaacaggacttgctcatgcctttacccgtgcccaggaatggccagcctcccttcttgtgtgcacatacttccggccatatggaaggcattcctttcatttccacatagccagtcctgccccatctttcagatttcagctcagatgccacctctcccagctgtttgtggtcctcttcagctgggagccatcactccctcctccaaacttcttttaggaaacaatgattttctatgctgcacatgatactttattgtggccattttggcactagagacattttgacttggctattttgatgcagccttaaaaaaatgaaacttgctctgccacccaggctggagcgcagtggtgcaatcacagctcattgaagcctcaaccttttgggctcaaacaatcgtcctgcctcagccttttaagtagctaggactatgggtgtgtgccagtgctcctggcatatatatgtatttggtaaagccagaggtcttgaactcctggactcaagtcatcctcctgcctcagcctttcaaagtgctgggattataggcatgagacaccatactctgctcagaatgaatggaaatttataaaaaggaagagtaggctggatggtttagatggaggagtccaaaggcctctctgaaaaatgacacttgggctggaatgggaaaatgagttgactttaactaaatagagagtggaagatcagaaggaacagcatgtgcaaaggcgagaaggcaagagtgcattgaaggcactggagatggttggatgtggactctcttttggaagtagaaccaacaggttttgtggatagattggaagttagtggcagaaacacagcaaggttgactcctagcgttggccaccaccgcgcgtctcaacagacatcttcatcctattgtgaaccctggcccctaggtggagtctcagggcagggtcagagacagaggaagggggtgttaggggtgaatcaaggggtgtctataacaggcattctttggtagtaaaagtcagtgattttatattagggcactctgttaatagttgctttgtattagagatatttgtgtctgtggtttatttctcctattagaaagtaaactatctgaggtcaggatcttattattcattgaatttccaaaatgtccaatgtcacatcttgtacatagttctaactcttgcttatcaattatcgaatgacaagatttgattatattcgattcagtaacattccatgcagactgggctgagcacaatagagaatgtacaaggatccccaagacctgttaatccagtttcttactttaaaaatttctttctttcttcctttttttttgttttgtttttttgagacagggtcttgctctgccgcccaggctggagtggcatatttggcctacgtggcaaatgtaaagtatcttggagaatgttctaatgttctgaaaaccagagatctaaggtttgtattctatttagtagccagaacatctggttggtgagaaaagtccattctctaggaaacagagctcgcctacatgctggagagattttagactcaagccaggagcagagacattctacagttatggcatttggatgctaaaaatggggtggcctcattttcagtgttttaagagaggaagtaggcacagccagcacctggaatggatttcttgagttctcacgtgatttccctttccacagccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcgggtaagagggagtggggagtggggacgccatctgtaacagtggccttgtgctgtctctcctaggaacgtgctgtatgcaagcaggtaagagtggggctgggggacaggtaggcagagagaagagtggagggtgtggttcaaggtcctggtttccaccactttctgtgtagtcttgcaaaagatgcttctcctcctgagcctcaggatcctcatctgtgaaatgggaagttaggccaagatgcaatcttaggtctcttttctcctaatattctgttggagaggcattcacgtctccacttttcaaccaacccatgtgacaagtatttcttaagtacctcctatgcaggccaggcacgggggctgatgcctgtaatcccagcactttgagaggccaaggtggacagattgtctgagctcaggagctcaagaccagcttgggcaacatggcaaaactctgtctctacaaaaaaaaaagttagccggtcatggtggcaggcacctgtagtctcagctacctggggcagtgtggcggggaggtggtgtgagatgggaggattgcttgagcccaggaggtcgaagttgcagtgagctgagatcacaccactgtactccaatctgggcaacagagcgagaccccatctctgaaaaacaataaaaacttggtgacttaaggcaaaggaaatttattctctcatagttctggaagccaggagtctgaaatcagtttcactgagctgaaatccaggtgtcagcagggctgtgctccctctggaggctctagaggagaatccgttccatatctcttccagcttccgggggccgccagcacttcttgactgtggctgcatcactccaatatctgcctctgtggtcacgctgcctcctcttcctcctctgtgtgtatcaaatctccctttgtctccttcttatattaacacctgcgagtagatttagggcccattcaaacaatccagataatctctctgtccagattcttaatcacatctgcaaaaacccttttccttataacggaacgggttccaaggatttaggacttgcatctttttgggggctactacccagcatactgcacccaggaatctgcatttctaacagatgctgctgtgatcttccagggtcactgtggggagccatattgaaaaggtccatgggcgtttatatgctttcattagagactgggccctatgaagtcatgggccacaaggcaggaagacagaaatcttcccgataaggctggctttccgagggtccatgctgtctgaagctgcgggaccctccccgggaaaccactcagtcattctaatgtgagctctggagccatgtcttctacagtttaacaatttcacaattgtgtgatgtgacctaacacctctggacctctagatgagtgtttactttaggattagatgagattatccacttagtgccctatctggaatacagtttttatcaaagaagtggagtttggtggtgggggtgaaacagtcaatgactttttctttttctcacgctgttggatcaaacctgtgagcacctgggttacatctcacgtcaattccctaggattcacaggcatgttccatttctattggattgtctcattctctcacgtcaaaagtctgtactagtttaaatggaaacttcaacctctctgtctcttacccactgtgaagtttctccctgtctcctagttcagagcaggcaaggggtgtggttggcctctgccctgtcctcttgtcaccctcccggtaatggtagtgctggccctggctcctccagggctggcaggggaggagcaggtggtagaaagggtaaggctggaagagtgaggctcctccccgattgtagccattgtaaccaggcattggtattccctcaggagcagagcccccaaagctgttgctctcacagggtgcttttgtgggtcttttggagatttgcctgaggacttcacactgaccagtccctgatatgggcagtagggcctgtggttggtcacctgctactccaaacctctcagcccctaattctggggctatgtctcatacagatgtgccgtggtggtagtgaggtggagggtatcactgcatcctggcagcagaccttacacaagggcctttcaggatgtcaacatcagctccttgcattccccgttcctctctatggtgtggggcagctcagggctcacatctccagacttctcctggagacagtctggtaccactttctgcatccttgaacttcaggggcctgcatctctaaacagtttttctttttttgaaaacccctcttgattgagatggaggctagtaagtgtgtttaataaaatatatgtagagttgggcacaggggctcatgcctgtaatcccagctactctggaggctgaagtgggaggatccctggagcccgggagttcaagtccagcctgggcaacatagtgagaccctgtctctacaaaaaaagattaaaaaattagccaggtgtggtggcatgacctgtaaccacagccactctggaggctgagatgagaagataacttgaatccaggagttcaaggctgcagtgagctatgattgcaccactgcactccagcctgggtggcagagcgagaccctgtctctaaaaacaaaaacaaacaaacaaaaaagtatgtatgtaggctggagggggtgatggaatgagggaaacatctggctttggatcacagctttgtaagtcctgtataaccccaataactccacacacagcatcagcagcaagccgtgtatagtgcctgtatgtgccagacactattctaagtgctttctatacagtaaccctttaatcttcacaagaatcctatgatataggatggttttatcgtccagattttacagatgagagcactgaggcacagagctaagcaacctgcccgactagtctcacaactaataagcaccagggcaggatttgaacctaagcagcctggcaccaaaaatctgtgctgttatacttttcttcagaatggggaggtatgctttacctactcttccagctttggggtctcagatgaaatggagatcacaagaaaagtctaacatccagttacaatagaaagtattccagaaatagcagttatgattgtatagatactgttgtggccactgctactgttgctgctactgctgcaaggaggctgggagctgctgggccatggagagcttgggaatgctacccaggggactggagcatcgtgtgggaggtggggctggatggccatccaggctctcacaccctgagattcattgatttgattataaccacatgggaggagcttcatctcaccccgcaggcaaaccacacacacacacttgcatgcacacatgcacacacttatgcccacatgcgtacgtgtacacacacacacaagcccattcataagccttattggctgcctgtctctcactgagccctagaaagaggactgatgattggctttggccaggtggcttgggggtcataattagggccagaagaaggagcaaggtcatggggttcagactgtgccaaagtgcacttactccatgacacacgtggatcaagtgacagggcccatggaagctggcctgctacagcgtggctgcttgccacaggtcagaccatgccatcccacaagttgattagaataaacctgagtgtgtttgggatcagggccaagaagacacacagctggtgggctgttggcagccgactcccagcgtggtcaagtccactggcgttcagtcattcgtgtgcattcttccgttaccagcgtgcattcagcaccactgcatatgaggcttcaagtcaggcactgagcgttgagaaacaaacaggatgtggtctctgccctggaggaacccacacacaccttagcggagagggggaaaacaacctagcaaacacaacacaaagtggcgattctcaagtcaagtcaagacccatgggatggtgagtaaatggagaggtacagagaccttatcagagagtgtagtggttagaagcatgatttttggagccataaagtctagtaccatgcagtagtttggtggccttatgtagtatccctaacctacttagagcatagggttgtgaagattaattaagaggtgtaggaaaggttgtagccagatgcctggcatcataaccaccaccgtcatcactgtcgccaccatcctcctcctcctcatcttttcgcaccaccaagcctactaatgcccacgggctctcaggggtttatttcattaatgccctggctctgccctaaaagccgaatgtggaggtggctgtcctcagctcttgtggcaggtacttgagctcttccaggtgcttgtgggtagggtggacccaggtggaggccggactcaccagcttctgcagttacttccaaatgggagagtctaggatttcaaatgggatagttgaggattctttcgtactcaggagacatttaccaggagagcccaaaggaacaacttggaagtttgcacttgcccccttctcccttccagaccttgggctctgcagatctccctctggagggctgtccctagctcagggttctcaactcttggtctttgttcacgcagtgaaagctggtgagatatttgtatatgtaaaggctgcaggcatttccttgtgtggctttaccctctgaagccctggcccagggctcaggtttcgtaagggctgacaaggaagtccaagaaatctgcgtgaggaggtgccaataacgtggatgctgacgggaacaggaggaaccagtgccaagaggaaattgtgtggctgtcaggctgccgatagcctcatggataggggaggtcccagcgcctggcctgcacctgtctgccagccccacccttgtcttacttgtggtggctcttggggatgttcagaactttatggggcgccctccttttatggagacagataaaacatctagtgtagctttaaaccagctaggttcctttattttgcagagactgttgcttgcagcttctgggcacagggctgggctctgcagtgtatgggaagtgattgtccagcccatcccttttcttcttcacactgtttcctctaacagtgccaatatctgtcccttgcactgaccgcgagcatctctcattaggtgggtgctaggaagaagtgaaacacacatcagcctcttctgatacctgctgtgcagtgaaaaaagcctggggcttggggtcagaaatacctgaatggaagcccttggttctgcccaagactagctgggtaaccctaagcaattatttaacctcatgggacctcagtttgcttacttataaaacggggaagtaatgagtcatacctttcatacagcacttagacaaggacagccagggcccccccacctgggtcctgtgcttttagatcaatatttctcaatacttaatgtgcacacaaagccctggggattgtgttaagccacagattctggctcagtagatcctagccctgagattctgcatttataagaagctccctggtgatgcccatgctgctggtccagggaccacactttgagtggcaaggcctttcagggttttatgagaatttttttttttttttttagctggagtctcgccgttgtccagggtggagtatagtggtgcgatctctattcactgcaacctctgccccccaggttcaagcaattcttgtgcctcagcctcccaagtagctgggattacaggcacctgccaacatgccctgctaatttttctagttttagtagagatggggtttcaccatatcagccaggctggtctccaactcctggcctcaagtgatccgcccacctcggcctcccaaatgctgggattacagttgtgagccatggtgcctggccattttatgaggattaaataagcagatgtacataaacatggttagaagagtgcctcacacatgatgggtgctcagttgatgtcattcctctctgccttcctccttgaaagttttagaaaaagactcagtggaggagagagttcacgcgaaattattaggaccacagtgatcaggttacagaatggtgaagctggagatgactctagggtgcctagaggggggttcttaaattccacctttcccaggcatcacctaaaaatatactgacatagaaaatcttggaatgggcccctggaattgttagtttaacaaaaaaagttccagtagcctttgatgcctttttttttttttttttaaattactgatctggtccaaaccctcattttatttttcctcaaaaacgttttttaaaacttttattccactttcaagagtacatgtgcatgttggttgtatagataaattactgtgtcgtaggagtttggtgtatatatgatgtcatcacccaggtaataagcatagtacccagtaggtagtttttcaatcccctccctcctcctgcctcccaccctgaagcaggccctggtgcctgtttttcccttctttgtgtccatgtgtatgtactcaatgccaaaccctcatttgagagatgagccccagaggggtgaagtgacagccctaagccatgcagaagtttcaatcaatgattcgttcatcattcaatatatgttttctgaacaccttctgtgttcaaggcaccatgctggcttctagggggactcagtggtgaaaagcctgaccccagtacctgttcttacagaactcatagcctagtgggagcctagatatcagacacggatcaggtagacagtatggacaatcatacatggtcataaatgctttccatcctgtacaaagtaaaggctgcagcgtcagaggtcgcagggggacctgacttagattggggaaccagagaaggctcctcttaggaagtgacctttcagatgagacctgaagggtttgcagaaaagaaccaggtggagagtgggcaaagccagggaaagagcatggcacagttgaggcaccgagggggtgccagtttgactgacggaggcaagggagcgcccaggtggggctgcagggccaccatgcaggccttttctcactggtgttccccggttctgtccatagcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagag

SEQ ID NO: 36332 - DNA, 3912 bp, Homo sapiens
cgtggatcccgagaaagaggcgcaggacgaggaggcagaacccgactggcgcgtagagcagcagcacgagcagtaggaagcagtcacccggaagcctgggggcgagaggcgaagtggtcaggcgccgaaggccgagagcacgcggggatcggtctcttcccgccgggtctcttaccggtgcgagtcaaagagccgctccggccccggccctgagggaagctccataactgctgcttcaggagcgcccggccgtcgccgccgccgccattttcgcgcccggccgcaggggctcttgggaaggcggagtctttgggcatccgcccggggtgaggggacccgaagtcctgaggcgcgccggaagggctagcggtcccagcataccccgcggccccttgggccgtctcacaactcgcgtccggcggagaccacaattcccggcattcgtggggcagggaggagtcggcctcccggaatcctggtcccggcgtgcacttctgaaggacttcaggtaccggcgtgccccgcgtcctactgtccgcctgctcgcgtcctgggtgccgcctctgagtagggcgggcgaggaggcagccaaggcggagctgatggctgcgccgagggcggggcggggtgcaggctggagccttcgggcatggcgggctttggggggcattcgctgggggaggagaccccgtttgacccctgacctccgggccctgctgacgtcaggaacttctgacccccgggcccgagtgacttatgggacccccagtctctgggcccggttgtctgttggggtcactgaaccccgagcatgcctgacgtctgggaccccgggtccccgggcacaactgactgcggtgaccccagataccaggacccgggaggcctcagagaactctggaacccgttcgcgcgcgtggctggcggtggcgctgggcgctgggggggcagtgctgttgttgttgtggggcgggggtcggggtcctccggccgtcctcgccgccgtccctagcccgccgcccgcttctccccggagtcagtacaacttcatcgcagatgtggtggagaagacagcacctgccgtggtctatatcgagatcctggaccggtaatggtgggggtagaccgggaggcactgaagccacaggctggagggcgggcgggtaggaggggtcagagcctcctcttatctgtgctttccctccatttcaggcaccctttcttgggccgcgaggtccctatctcgaacggctcaggattcgtggtggctgccgatgggctcattgtcaccaacgcccatgtggtggctgatcggcgcagagtccgtgtgagactgctaagcggcgacacgtatgaggccgtggtcacagctgtggatcccgtggcagacatcgcaacgctgaggattcagactaaggtgggggctggggtaggccaggtctggttggagctgcttatttgctcgcatcttcagatgacaggtctcttttacccattctcccttaggagcctctccccacgctgcctctgggacgctcagctgatgtccggcaaggggagtttgttgttgccatgggaagtccctttgcactgcagaacacgatcacatccggcattgttagctctgctcagcgtccagccagagacctgggactcccccaaaccaatgtggaatacattcaaactgatgcagctattgatgtgcgtcctgataggagagaaatgacaaatgatgggggaggggggagaggctgtgtggtacaagcaccaactgatatatggtggatgagcctatatagagcttaggctgcaaaaatgtggccacttattcatgggctgagaaagaagagaatttggagaaagtacctacatcctggtatgcccccagacttagaatccccagatctctttcatgttttctccttgtcctacagtttggaaactctggaggtcccctggttaacctggtgagtgagacatccttccttccaagaatccctgccccaggtcagtgtgggaagggtaggtttcccctaattcaaggatgtttggtcaagtttctgagcagttctttgttggctatctctcaatatccaaccagatctccccaacacttgctggtacttttgttcgggtgcccccatcccctactatttgtttaggctagggaactgggggctgtatccctgcaggatggggaggtgattggagtgaacaccatgaaggtcacagctggaatctcctttgccatcccttctgatcgtcttcgagagtttctgcatcgtggggaaaagaagagtgagcctgccttatggggaaacgggttcctttaatgtggtggaaataggggaagggcattcagtgggacttcctggagggtggtctactgggagaagagggcagggaaggaaggatgtagctgggtggggctcatttgtccctctgtcacagattcctcctccggaatcagtgggtcccagcggcgctacattggggtgatgatgctgaccctgagtcccaggtatgagctttagggacagtgacatgtaatgtgaccagtgtaatcagaggggggcacctctattgagctttgttctcatttctgtctttatctaagatgaactgtgtcacacttgaaataatcacaagagctgtctcccttcatcatcttgactttcttatcccactccactttgtacacctgtcaccagattgatttcatcctgttactgctttgatttcaagccttcaatccattaacttggcatttaagggccattttccatctgtctgtaaatcaactttctagacctggctgtaataccttcctatatgaatactcagccaacctgatttcctactcccatgttttttatttatgctgttcttgttttatatggttaatatcagatccatccttttaggctcaacttaagttctttccccttaaagcttctcttagtattctagaatgacattagtgctattgatttaacactgtttgtcatttggtgccctcatgtggtgtacatcttttatgtacatgttgcactttattgctagaagacagaaagtgagttgccattgtattttgtagtacctagcccatgtcctgtccatatatttatcaatgtgttgatgagagacttgaggtggaactcaggatggggagaatgcctgggtttggctaatagggtgatctgtgtactttcagcatccttgctgaactacagcttcgagaaccaagctttcccgatgttcagcatggtgtactcatccataaagtcatcctgggctcccctgcacaccggtgagggagaggctgcagtgtgatatggggatgggcaaggtgtgcatgtgtccttgaactaggctttgtactccttcctttctctctgtccatttttctctatagggctggtctgcggcctggtgatgtgattttggccattggggagcagatggtacaaaatgctgaagatgtttatgaagctgttcgaacccaatcccagttggcagtgcagatccggcggggacgagaaacactgaccttatatgtgacccctgaggtcacagaatgaatagatcaccaagagtatgaggctcctgctctgatttcctccttgcctttctggctgaggttctgagggcaccgagacagagggttaaatgaaccagtgggggcaggtccctccaaccaccagcactgactcctgggctctgaagaatcacagaaacactttttatataaaataaaattatacctagcaacatattatagtaaaaaatgaggtgggagggctggatcttttcccccaccaaaaggctagaggtaaagctgtatccccctaaacttaggggagatactggagctgaccatcctgacctcctattaaagaaaatgagctgctg

SEQ ID NO: 36333 - DNA, 16935 bp, Homo sapiens
acatggcggcggcggccctgcggagtggctggtgccgctgtccacgggtgagcggcggtgcggcgctggcagggcgagcttaggggtcttctgggccttcggccaccaaggctttcttctcagacccttggccttcgcgacccttgcttgggctccttagaaagcttggggttagatctttgggtagcagaggccaggacagggggcacagagcgtggcctgagggcggggaccgagcttaccgggcagggggcggcgatgcgcgggacctgggagggagctgatcacccttcgccctctgatcagactccacgtatacaggagagagaatggtagccggggcggcggcgtcccgtggaaaaaagtagaggggaaggcaaaaaaacgtgaaattcacagctcgcggttaaatgccaagttctctaccgagagcatttcttgtctcgtttcttctaacgttcattgtggatgtgcgagaggtggttcgcgccctagcaggctcttgggtccacagggcagtggcagtcaagacgtgtaaggcgcactcagaaagtagtacttcatattgctcgtgctcttcgttttttcttttttctcttttttttttttttttgagacagagtttcgctcttgtcgcccagtctggagtgcaatggcgcgatctcggctcactgcaacttctgcctccttctgcctccgggttcaagcgattctcctgcctcagcctcaggtggatcacctgaggtcaggagttcgagatccactggcccacatggtgaaatcccatctctactaaaaccccatctgtactaaaaatacaaaaaaattagccgggcatggtggcgcgctcctgtaatcccaactacttgggaggctgaggcaggagaatcacttgaacccggcaggcggagattgcagtgagccgagatcctgccactttactccagcctgggcaacagagggagactccgtctcaaaaaaaaaaaaaaaagttatcctcaagtaaatacaggagatagtaggcacctgtgtaagtttgggatgttgcatagggttctcagaggtaggaggcagagaacagagagaaaaacggcccaggaaatgtggaaatggtggagaagttgtacctggtcttttgacatcaacacgccaggttctgtgctgggtgacagggtgccgagctgaacaggacctgcacagagctttttttttttcccccaattttttatggaggcagggtctagctatgttgcccaggctggtctcaaactcctgagctcaaacgatccttccgcctcagcctcccaaagtatcgggattacaggcatgagccaccagctcagtgcctgcacagaacttaaggcaagatctcggctcactgcaccctccacctcccgggtttaagcaatactacaggtgtgtgggactacaggtgtgtgccaccacgcccggctaatttttgtatttttggtagagacgggatttcaccatgttggccaggctgatctcgaactcctgaccgggtgatcctcccacctcagcctcccaacgtgttgggattactggcgtgagccaccgcgcccagccagcaagtgccttttacatgagatcagcccagtctttgcccagagcgactcccctaaattactctgtttatagctcaacccttgaggaggacattgtaggtttattccagagttgtccctggggcaacacattatcgatgtttgtgtctgaaaaatccagttctctcatctttggaggctggcagaaatggggtgggctcgcaagagaagactgcttgccactagcatagaagcttagagtgcctactttcagactaagggattaaattgtacatttagccttcttccccccatgggttggcatttcctgggacctgtccgttttcccccagtttcaggggcacgaggatagatgtaggccctggaggtacagacacagcattttctctttccaccagcttctgcttgcttctcagactttgggaagattacagagtgcccggcatgcatcaggcataagatacaaattggccagtgaggccaggtgcagtggctcatgcctgtaatcccagcactttggaaaaccgggggaggggtggatcacctgaggtcaggagttcgagaccagcctggccaacatggcaaaaccgcttctctcctaaaaatacaaatattagccggatgtgatggcgcatacctgtaattccagctactcgggagactgaggcaggagaatcgcttgaacccaggaggcataggttgcagggagctgagatcgcagcactgcactctagcctgagactccgtctcaaaaaaaaaaaaaaaatggccagtgagttgcaggtgaccctgctgttttgtgtgtggtctgcttacttctcagtcaacctcttgttagaatggatctttctcttctctccccccaattagagatgcctcggcagtggaatccaatttctttccagccacaacctaccccatgggtcgacctatcagatgcgccggccgggcggagagctgccactggtgagtgactcaggatgctcgggccagcagacacaggggaggcccgaaaattcagatcccattggcaggagggaggggtggggctgtagaggtggctcgtaccatctcggtggtgggccttctgtgtccggggctttcagaatgacagatcccagtgtgcctggccttctcggtcccagaaacacttgacctgcctcttgcttgatgtcgtaaggggataaggtgctgtcagaatagccctttatgttggctctaatgcttggaagagacccctgtattgaactgaattctacttccctgtgacctctgcccgtgggtacctcaccaagcatagctgtttccttttctagaagatagccctttgatcattggtacagagtcaccttgtcacaaccagacctcagtttctcctggtcattcctcttcaactgtgcttctgttggtgtctcagcatcgtgaggacagaagcccaaaacctgactcccttccccagacctgtacattcgggcagcgcgtacattctgtctccctctctctctgcgcccagagcctcagctcagctgcctccttggaggcagctacctacctctccagtcctgtcctggggccatcgtgggtgtgggacaggacctgtgactctttccctttcttgtctagtcccccgccacacactcactcccatggtttgtagcccaagagtctctggtagggctgcgataaggttgtgtggtcctggatgattttacttagaacctgggtttcccctggagaaaggctggccagggtggcatctgaatgggactgcagcctgctgacaggaggcctggccacctgtcctggggagcagcactgggcttttttttttttttaagatagggtctcactctgtggcccaggctggggtgcagtggcactatcacggctcactgcagccttgaactcctgggcttaagcgatcctcccacctcagccttctgagtagctgggaccacaggtgtgtgactccacggggcctgagcaccaggctggatgcagctttctcttgtagcttgacaggagccagggagggggatcccacctggagctggtatacccaacacagctgtggaaaagttgaccacaggcggccccttccgcctgattggattattgtatgatcattcattaaactgtttctctgttgtttttttgaaacagagtctcactctgtcgcccaggctggagtgcaggggcgagataccgctcactgcaacctccacctcccgagttcaagcagttctcctgcctctgcctcagtagctgggactacaggcaggcgccgccacacctggctaatttttgtatttttagtagagacaaggtttcaccatgttggccaggcttgtctcggactcctggcctcaagtgatccgcccacctcggtctcccaaagtgctaggattacagatatgagccactgtgtccagcctgcttttttttttttttttttgagatggagtctcattccatcacccaggctggagtgcagtggcacaatcttggctcactgcaacctccggctcctgggttcaagtgattctcctgcctcagcctcctgagtagctggcattacaggcacccaccaccacgcccagctaatttttgtatttttagtagagacgggggtttcactatgttggtcaggctggtctggaactcctgacctcaagtgatccacccaccttggcctcccaaagtgctgagattacaggcaggagccactgcgcccggccttgttttgctttcacaaggctttatcttttgagcagttttaggtttacagaaaaatccaacagaatgtccaaagagttgccatgcccctcctctcccatctggcacacagttttctattcttcacgtcctgcattagtgtggagcatctgtcacaattgacaggatgttgatacattattattaataaatgcatggtttaccttccggttccctcttggtggtgtacattctctgtgattacagtatcataagagtagtttcactgccctaacatttttctgtgttcccccctactcatctcaccctcttcctaccaaacccctggcaaccactgatcttttactgtccccttagttttgccttttccagaacggtctatagttggaatcagacagtatgtagccttttcagattggcttctttcacttagtgcaatatacatttaaggttcctctgtgtcttttcacagcttgagagcatatttcttgcttgttttttaaattattttattttattttatttgagatggagtctcgctctgtcacccagactggagtgctgtggcataatcttggctcactgcagcctcttcctcctgggttcaagcaattcttgtgcctcagccttctgaggagctgggactaaaggcacacaccaccatgcgcagctaacttttgcatttttagtagagatgaggtttcaccattttggccaggctggtctcgaactcctgacctcaggtgatctgcccgcctcagcctcccaaagtactgggattacaggcgtgaaccaccgcgcccagcctgttttttaaatagggtgctgtgttgcccaggttggtcttaaaactcatgacctcaagcaatcctccctcctcagcctcctaaagtggctgagagctcatttttttttcagcactgaataatattctgttgtctggatataccacacttttatcacctgctgtttctttgttttttatgattattataaaagagatagctaatcatcattaaatgtatatcaaccgaaaagagaacatttaaaaaaatccctgagtccctctgtggggcatttcattctatgttctactatgttctttaaattttttttcttgtacattctttctagtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacgtgagtttctttgctgcttttttttccctcacccaggctggagagtagtggtgcgatctcggctcactgcaacctccacctcccaggttcaagtgattcccctgcctcagcctcctgagtagctgggcttacaggcgcgcaccaccacgcccagctaatttttgtatttttagtagtgaagaggtttcaccatgttggccaggctggtctcgaactcctgacctcaagtgatccgcccgcctcagccttccaaagtgctgggattacaggcgtgagccaccgcgttgggcccctttgcttcttacctttcttggttgacatgtttgtttccagggccagggtttctccaggccagggacagccagaggagctcagggctggacggttgggggcagggtggctcgtgaggaagtgaggtcactgctctgatgcactaatgagagggagccaggggacaggtgcgggtctccaggcctctgggttctgccatgagaccatgcagcgttctgtgcagcttgaagcgtggtccccagaccagcagcagtggctcctcctgggagtggatgagcagtgcagaggctcacaccctcccaaactgccaggccagcgcccgcatcttcacaggcccccaggcaacgcatgcacaccagctatgggatgcagcgctcctgagagctcccagctgtagccctctgagtggagcctggtggaaactgggtgatggtgctggtattttattttattttattttattttatgagatggagtcttgctctgtcatccaggctggagtgcagtggcgtgaccttggctcactgcaacctccagctcctgattctcctgcctcagcctcccggatagctgggattacaggcgcccgccaccacacccagctgatttgttgttgttgttgttgttgttttttgaagcagagtcttactccattgcccaggctggagtgcagtggtacgattttggctcaacacaacctctgcctcctaggctcaagcgattctcctgcctcagcctcccgagtagctgggattacagacacacaccactactgcccagctaatttttgtatttttagtaaagacagggtttcaccatgttggccaggctggccttgaactcctgacctcaaatgatccacctgccttggccttccaaagtgctgagattacaggtgtgagccagtgcgcccagccctatatatctttttatagagacggggtttcaccatgttggccaggctggtctcaaactcctggcctcaagtgatctgcccgtctcagcttcccaaagtgctgggattacaggtgtgagccactgctcccagcctgtcattattaattgtcacttctcttcttgagcagctgccaagccctggcttctgggaatggctctgcattcctttatttgtaagggccctgcgaggcagttacagtgtccccattttaccaatgagcagctgagcctcagagatgcaggcacctgccacgggtcccttgcattttggtttggtttggtttcatttgtgtttttttgtttgttcgttttttgtttttctcctttgagatggagtcttgctctgtcagccaggctggagtgcaatggtgcgatctcggctcactgcaacctccgcctccctgggttcaagcgattctcctgcctcagccttccaaatagctggaattataggcgcccaccaccacgccaggctaatttttgtatttttagtggagacggggtttcatcactttggccaggctggtgttgaactcctgacctcaggtgatccatccgccttggcctcccagagtgctgggattacaggcatgagccaccgtgcccagcctagtttggttttttgagacagggtcttgctctgtcaccctggctggagtgcagtggtgtgatcacagctcactgcagttttgaccttcccatgttcaggtgattctcccacctcagcctcctgagtagctgtgactaaaggcatgggataccacgcctggctaatttttttatatttctagagacagggtctcgccatgttgcctgtgctggtctcgaactctctgggctcaagcgatcctcccatctcagcttcccaaagagctgggactacagctcacatgcccagcccctctttatcattaatgcaggggtcatctgaagacatagcaggctgagtttggagtgggatggatggagcgggagacataagaccaagctgtggtggctggaggctggatgaggggcacagtgatgacaggcaaggccacctcctaccacccggtgaaaggtgaaggctgggcctcctgttctcaggaggtagctgccaagcggggacccgagtctgccggccttctgagcaaggagctcaccgctgctgagaccctcaatccaagccatgtgggcagccgggggccctggaggcagcacatgctggcaggtgcggggagggaggggctgcggagaagatgcttcttggacctttggctgtaagagaaatgtcactgccgtgtcagaacatacagacttaaagacacaacggttggccaggcacagtggctcacacctataatcccagcactttgggaggccgaggcgggtggatcacttgaggtcagaagtttgagaccagcctggccaacgtggtaaaaccctgtctctactgaaaatacaaaaattagccaggcatggtggtgggccctgtagtcccagctactcgggaggctggggcaggaaaatcgcttgaatctggcaggaggaagttgcagtgagccgagagcgtgccactgtactccagcctcggcaacggagacattgtctcaaaaaaaaaaaaaaaaaaaaggacacagcgctctttacctagaaaaccatcgagtcagaaaccgtgcggacgagcgaggtgctacggaagaagcttggggagctgacgggcaccgtgaaggaggtaacagttccacgcccgcctggagccgctggggccatcaaagtcccctggccgctggaggctggaggaagagtcggctcctgggtgggggtggcttggcagcagtgggtggcatggggcgtgctgccaccctcgggaaggtttcaggagttcccggcacatgcagggtgaggtcagactggcaaccttgcatgaccgttgacccagggagtcggcagcagtaagtgctgctagccaggactcgaggagaacatgaaaatgtttttcctgcctaaaaataggaggagaggggccgcttccaccccctcccgagggtagaggcgggaggcaggattcctggggtgctgcggctctcctcggttgtctgttctgtccagctttgcgcagcatggggcgccctcaccgccgttctttccccggggtcccctccttgggaatccttgctgccaggcagttcccgggtctccagaggactcctgcccattttggaaaggggccagcagacccagcgtctcacccagagcccagggccagcatcccggaagccgtggcggtgtgctcatggctctgggggtgccggtgtgctcatggctctgggggtgccggtgtgctcgtggctctgggggtggcggtgtgctcgtggctctgggggtgccgttgtgctcatggctctgggggtgccgcgtaccacaggagcacagaaggcctctgccggcctcggggaaccagatccgcccttctctccggcaggaattcattcctcctgccccgccccccggccgccagggccggtgccaacgccccctctctgtgtctgtctcagtagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccaggtgagcccagtcctgggctagggcatgcagcctggggcggccgaacccagacacccaccccagccccgctgtgcctccctcgcagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgagtaggtaccagcccgtggccctcgctgcccccattttgggcagctttcactgctgtccatttcgggagcccaccaatggttccctcctgagtccgtttcttgagtttgccttctgcccaaggttcccggctccctcgaatttgagggtgagaggtgagggcggggtcctcagagcccctaggtttgaggtctcagctgcctgctgtcctgtactgccccctgcctgcagccgcaggagggcacagggtggccctggcgccgccgctcaccccagggcccaccctcttccccagggaggccctgggggtcgtgctgcacaaggactccaagtggtaccagcagtggaaggacttcaaggagaacaacgtggtgtttaaccgtgagtgaaggtgtcttggagggcaggtgactgtgtcccgggcagttggtggaccgcaaggtgatccccctgcattgggcacaagacagccccgttttgcagaggaggagatcggggtcagagtgggccggtcacttctttgcggtcacatgatggtggggctgtagattctgccgccagaagccaggtgctccctcataagcacagtcagggccccgaaacgagccgcaggcccctgtcccttgtcctgtgaggactgctagaggcctgtgtttcctttgtagtgaaagcaacagccagtggggtggcggcccataacttacacagccccattagggccgcagctgaggggcctctgcgcctggccaggtaggtgggcaggcagcggtccccaagcacagatgaggatgcaggtccacagccgtcccctccctgaccccacccgtgtcagggtggatcccgcaggggtcacagggagcctctagaagctgtgagggagggttgtgtttctggaaggggccccttctccagcacctaccccatcttccacagggttcttcgagatgaagatgaagtatgacgaaagcgacaacgcgttcatccgggcatcccgggcccttacggacaaggtcaccgacttgctgggtgagtgagtcatccctggacctcgcaggctggtggtggggcggggtccccggccttccccccgaactcccggctctgctccctgcagggggcctgttctccaagacagagatgtcggaggtgctcacggagatcctccgggtggacccggcctttgacaaggaccggtttctgaaacagtgcgagaacgacatcatccccaatgtcctggaggtgggtgccacacccccaggacccctcccaggcggcaggtcctggctccaccacctcccccgccgcagccggcaccctgggtgctgccagggaactctgctgccgaggctgttttctgaggaggctggttgcacacgggctcctgcccggctgcagctgccccatgagctgtgcccgaagcccttcctgggccttaccggcacctccggtacctccaggtctgtttccctcactcctcctgcctgaggctgttgttcctttgaggttgctgggagcagctgctggaggctagggattgtctcaggtgcctggagcccctcaccccttgggagaagtgggcgtctgtcttcagacatcagagctggccccaggccacgtctgacccagagctgcagccgtgaggttccctcacggtgctgtccctggcaaccagacccttgttgggcttatagatgagggtatcttgctcaaggtcatgctgcagcctgccccctataagcctctccctgaggttggtggcctcttgtcttccctgctgcctctgcctctctgcagcccccaggatgcaggaggagcctggacaccttcggcccagtcgggccaggcctctggaaggcccttcatgggactctccatccttggccccgccggcctccgcccaacgtcctcttcctcctccagtttcccgtatccttcccgccacttcgggcagggctgggaggtggtgcggatgggcgccatgccccaaaacagcagcctgagcaccgcagtgccttccgggatgggtgatgggtgccaagtgttctggccacccgccccctgccgctcacagctttcaccaccagcatccggctccttcccgctcttctccccgctccaggcacctccctccccctcatcggatccggcccaggctccaggatcctgtggaagcagctcccagcccaggcacgccccctgcagcccacccctccctctcgctgcccccagcagttaggaggcagccggtcccatggtgggccttgcagtccgaaatgtggtcccctggggggacagaggacatgggctcactgcgggagccggagttgggtcctcatctccctggcttggattcctgaccaggctgaaagctgggtccccagccacctttctcttcctccaccaggttccaggggggtccccctgtggggtgcctcctgggtggtcgcccgcaggccgccctccgcctgtgcctaggccagagccaggcactgacaccagcagggacgggcctgggggggacacccagtgccacagctccacccgcgccccacaggtggcagccgggggtgtctgaggaaactccccaccccgcaccactggagaatgttcccaggacctcgcctgctgcctgaaaagcccactctcgttctggtgcttattttcccttcctttttaggccatgatttctggagagcttgacattctcaaagactggtgctatgaagctgtgagtacttcctttctttttctttttttttttttaaggcctaaaaaatcaccatggagaagttccacttcggtggctccgttggggtagctcccaacaggcaggacctgggctcccggtgggggaatcctcacgtctcaccctccgagagcctgacatccccccctgcccctttccattcctcagcatgtgacacatctgggctctcaggctggacaccgggtcacccgccagtcctttgctcccagactgtaaactttgttagggagaatccttctctgggctggtgtctaagagatggctggttgggggtgtcccctgggcctgtgagagatcacaaagctgccaattttactgggccttttttttccctccaatcttaaaataattttggttaggtctgggcacggtggcctatgctttcaatcccagcagcccaaggcgggagattgcttgagcccaagcattcaagactagcctgggaaacatagcaagatcccgtctctacaaaaacatttaaaatgagccaagtggcagggtgcggtggctcatgcctgtaatcccagcactttgggatgccaaggcaggcgattgcctgagctcaagagttcgagaccagcctgggcaacatggtgaaaccccatctctactaaaataaaaagttagccaggcatgctggtgcatgtctgtaatcccagctactggggaggctgaggcagtagaattgcttaaatccgggaggtggaggttacagtgagctgaggtcgcgccactgcacttcagcctgggcaacagagcaagattctgtctccaaaaaaaaaaaaaaaaaaaaaagagccaagcatggaggcaggcacctgttgtcccagctattagggaggctgaggtgggaggatcacttgagctcacgaggtcaaggctgcagtgagtcatcgcagcacagcactccagcctgggtgacagatcaagacactgtcactaaggaaataggtcgggcacggtggctaacgcctgtcatcccagcaccttgggaggctgaggcgggcggatcacctgaggtcaggagttcgagaccagtctggccaacatggtgaaaccctgtctctactaaaaatacaaaaattagccaggcctggtggtgggcgcctgtaatcccagctactcgggaggctgaggcaggagaatcgctagaacccaggaggcggaggctgcagtgagccgagattgcaccactgcactccagcctgggcaacagagcgagactgtcttaaaaaaaaagaaataataatttagggaaggagagtcccaggagaggtggttgcagccatgaagtaaaatgaggtgtctgggggccgactgccctatttcaggtggctgcagtggcctggggtgcaggctggggccgggggtcagggacagtgtgggtctcccacatgactgggggggggctgggagtcaagtggggtttgaaggtgtcacccatcccacttcccaggccagagcagagtccctgtgctcacctcccacgggtcgtgagaatgaagtgtgatcacagaaaccagggcagtgctggccccgggccagagggaacccacagaggtaaccctggtaaccaaacagcccctggaagagttgggggagctttcatcggtgacccggggccgccacctatggggcacggatggggttgcggcagtgggtgcccctccccaggccctgggagcctctagctgtcctcacgacatgatcctgaaacatagatccaaacaaaacatcgatagtcttcccacaccaggaaggagctgtgtcctgatgaggcctcagctgcttctcagagtcaaagcttggggttcgggggccaccagcagcaccgcgtacctggggtctggtctagctgtctgccccatccctggcagcctccctgtccctgcccgagtccatccctgtggggctcccagctctcatctcctcaggccacctcatctcaccctattcgctccccgacctgtgtgtttctttcccctggcttcttcgtattaagcgatccagaatcgttcttggctaattctattctgcacccagctcataaacaacttggaaaaagcagaggagaagatgtcagattttctttttaaatactcccctgcatggtgactaatccagcaggcatttatgagtttcgatgtggatttttttttttttttttttttttttggttttttgttttgtttttaccttgggaccattacgccacagctgactcgctttgccagggagctgctggtgccctggaaacacagctgaagttccagccacgtccacagaagtgtttttaaaatgtcacctttaagaaaccgaacaagtaggattggctctgttttttttttctctcccctccgcggatcagtcatttccataaaaagtagatgctatcagaacatcttttctctcatggtttcatgccaagcccagagaaacctccagcgaaaacgtgtctcgggggctgcttcctgtgcctggcacaggcgcagggggttgagggtgacactgggggctggtcagtgacagaggcagcctcaggctgaggacagatcctagaagaggcgtttgatctcaggccaagattcagagtgcggcgaatatggaagtattaaagatcagccaaggggccgccagcttagccctgggagtagatttgggattttgttccaagagaatcacccactttgctgattaatcctgttttcattgggtcatctggatagagtgttgttcccaggagtgggaagcgtgtgatctgggccagtaagtgggtggcacctgcctccccacttggacctgggttcttggcctctgccattgctggctggcggcagggcacctgggcgccagggtgtgtgggcagcagctctgtgtggcgtggtgcccaccctgggtggcatcacgcaggcgtgtcggcctctcattgcagacttacagccagctggcccaccccatccagcaggccaaggcactgggtctccagttccattctcgcatcctagacattgacaacgtcgacgtaagcacctcgcagtgggggcccgggccaccatcgggggtgggaactatggcccagacaaggcccaggaggtggccttgccaggggctgggggccatgggctgatccaagaggtcttgggcttgtccaaggggagggtctcgagggaggcctggtcctggcctgagaggcaaggcccacggggagggaccggtgctgggcctggtgctggagccttctcctagcagggcctaggcgcaggggtttcacctccaggggagcagccgggctgtcctctgaggcacatcccccctctcggcccctctgcagctggccatgggcaagatgatggagcaggggccggtgctgatcatcaccttccaggcacagctggtgatggtggtcaggaaccccaaaggcgaggtggtggagggtgacccggtgagtgagggagtgggatggggcaggcacatgacaccgcctgtccccaagatctgtgtgtggccacctggcagagaccccagctcagagccctgaagctctgggactgggtggggatgtggagaaacctctgggccagagtttggggttgagggaggtcggagaccagcagacctgtctgtttttaccaaggctgagtggttcctgagtctaggcaattgtgctggcctctgctcccagcccctggggaagttgccggtggctcctgccccacagagcctggcccccccccagagctgcctgggtcacctcaaccctctcaacagtgcccttcccaccccaccctgcaggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagc

SEQ ID NO: 36334 - DNA, 249385 bp, Homo sapiens
ggagagaggacctatttctacctaaggacattcccggaaggcaatgggtttcaaacaatatcctgaagagactcatctcggggaactaagcaggtaggaatggaaaggaggaaatgggaggggagaggaagtcaatctgggaccctcatcccggcttcaaccaaaagcttcactctcatctgcctgatggatggagctacaatgtttttgaacaagagattccatttgaacaaagagctctgggttctgtaactttaagagtttgggtggtttttttttcttttcatttgtttgtttgttttttgccacatcagattttatagagaatttaagagttttaaaactacaattaggccgggtatggtggctcaggcctgtaatcccagcactttgggaggccaaggcgggctgaggtcaggagttcgagaccagcatggccaacatggtaaaaccccgtctctactaaaaaaaattacaaaaattagccaggtgtggtggtgcgcgcctgtaattccagttactctggaggctgaggaataagaatcgcttgaatcctggaggcagagcctgcagtgagtcgagatggcaccactgcactccagcctgggtgacagtgagacactgtcgtaaaataaataaaataaaactacaaatatagaggagcagagagtggcaaagcagattgaggacagacttcagaaggccttgaactctaatgtaaagcattcagattttcacctcaggccagtggggactcgccaaaagcttttgtggaaggaacagaatggtgaaagcaatgctgaacagagcctaacttggttacagtgttcaggatggagaccagagttggaagataaaacagaggcaccaactaccaggtgttttctacaataagggcctcaatcaggtttttttaaggaaaagatgcattccatgaagtcaaatatccaagaagaggtatacattgcacacaatactttatttgatccttttctacattccccaggggtgtattcctgtcaccattggagatgaggaaataaggccctgaggctcaagtcatttgtccaagattacatagtgagcaaatgactaaactgtaattcaatgccaagtctgttttttgttttttatttgagacagagtctcgctctgtcaccaggctggagtgcagtggcgtacagtcttggcccactgcaaactctgtctcctgggttcaagcgattctcctgcctcagcctcctgagtagctgggactacaggcatgtgacaccacactaattttttgtatttttaatagagactgggtttcaccacgttggccaggatggtcttgatctcttgacctcgtgatctgccctcctcggcctcccaaagtgctgggattacaggcgtgagccacagcccccggctgtctgttaaactgtttactgtattgtatgacctccagccatccaaatcccttacctgggcattcaagaccttaaaaaatcagacttctaaaatgtgtgcattttatcatatgcggatagtacctaatttaaaagttaagctgatcctcaaaacacttgttattttctgatttttttatagttgccatcctagtgggtgtgagataatatcttattaggaaacctcatttgtttttaacttttttgttaattaatgtatttaagactataaatttgcctttaagtactgctttagatgtgtacaaattcaatcatgtagtattttattcagttctattttttttagtccaaatgttatttaatagtgtgctatttagtttctgaataagcaggactttattttagccatcttttaaaaaatattaattctgtgatggcattgtagttggaaaacattgtcagaatgggattgattccttggaacttactgaaacttcctttatggcctaatatgtgatctattattgcagatgttttaggtataatcaaaagaatgttttctgtttgtgttgtgtacacacacacacacacacacacacacacacacatatatatatatatatttgagacagaatcttgctctgtcacccaggcatgatcttgacttactgcaacctccacctccagggttcaagcaattctcatgcctcagcctcccaagtacctgggactacaggtccgtgccaccatgcctaatttttgtatttttagtaaagatgggttttcaccatgttgtccaggctgatctcaaactcctggtctcaagtgatctgcccaccttgtcctcccaaagtactgggattacagttatgagccaccacacctggccatatatttttaattgtatttttgcccattcatatcaatgaataaacatttccaaatgcaactgttaatttttgaattttttctatgtatctgatatagctcaagattgtattggtaggtgttatatgtttatgatgattattttgattttatactgttccttaaacatttttaaacagtgaaatataacttacatgaataaagtttataaatcttatatgcatatttaaagcaatacttacagacatccatataaccaccactaaggtcaagaaataggctgggcacagtggctcacacctgtaatcccagcactttgggaggccaagatgggtggatcacctgaggtcaggagttcaagaccagcccggccaacatggcaaaatcccatctctattaaaaatacaaaaattggcatgtgcctgtactctcagctgcttgggaggctgagacaggaagaatcgcttgaacccaggaggcagaggttgcagtgagccaagatcatgtcactgcactccagcctgggtgacagagtgggaccctgtcttaaaaaaaataaaataaaataaaataaaatattgttaacttttttttagttaacagttttaaaaataaactcacctttctaaccttttctggcactaatccaccttctccaccaacccttccatacacctcatgcttcttagggataaggctgtttgtcactatgcactaattctgctattcattgcacccagtcattttgcttgtttgagacagggtctcactttattgcccaggctggagtgcagtggccccgtcttggctcactgcaacctccgcctcctgagttcaagcaattctcctgcctcagcctgccaagtagctggaattaaaggcactcaccaccccatgcccggctaatttttgtatttttagtagagacgggatttcatcatgttggtcaagctggtcttgaacttctgaccttgtgatccgcctgcctcggcttcccaaagtgctgggattacaggcgtgagccattgcacccagccgcccccagtcatttttatggcttctcttacacctagtgatgactgtcatgtgagggtcccttcccccacctcccctgccaaaaacctccccaggcttcaaactgcagctaagtggtacctctgtagagtgtccttcactctctcctcaagagggaacctctgtctctctattctctatatctttacacctttttaaaaaattacccttaagtcagctttcatattcttctcatattgtggttattttgtcacctattacatataaactccttgaagacaggacaaaggtcttaacctctgattttccttagcttgattcggtgtgaggcatatggtaagtgctcaaccaatattttaaagaaatgaatagaatctcttctttaattcagctatgtttcattattcaagatagctagcattttttccccttaaaacatctctttggccaggcacggtggctcatgcctgtaatctcagcactttgggaggccgaggcgggcagattgtctgtgttcaggagttcaagaccagcctggccaaaatagtgaaaccctgtctctgctaaaaatacaaaagattagctgggcgtggtggcatgcacctgtaatcccagctactcaggagtccgaggcaggagaatcacttgaacctgggaggtggaggttgcagtgagctgagatcatgccattgcactctagcttgggcaacaagagtgaaattccatctcaaaaaacaaaacaaaacaaatctctttatgttcatttcttttccattttgattgctgctctgcagaaagagaaagaggaaggatcgaaagaagaataaaaggaaagaaaggaggaagggagggagaaagggagggagggaaggagggagggagggagggaaggaaggaaggaaggaaggaaactacatttagatcccctttccagaccaattacatgagaatttctggagaatgagtccagcatccttaattttctcatgtgccaccaggattgagaaccactgcttttttggtcccttttaatttcaccagttttatctctaaacctctaaaacagggagggagggagggaggaacccagtggcttttagggcctcgtttcacaggcccatccaatctattcagctacttcttccaacagatgcctctgctccaaggctcatccaggtcccacaggcacgctgtgctcccgtctttattctctgctccttgtacctggatgtttcccttctcccctcccctactcacattctaaccatccttccaagctattccctcctcctcaaagcttcccagaccactactatcatccctttctaaatccctgtggttgaaataagcatgctgaccgtagctaataacactgtattgaatgctggaaattggcaaagagtgtagatttcaggtgttctcaccacacacacacacacacacacacacacacaaaggtaactgtcaggagatggatatgttaatttgcttgactgtagtattcatttcactatggatatgtactgcaaaatgccatgctgcacacttcaaatatatactgtaaaagaaataagaccttcgagtcggcacaaaatccaacacaatggacttatccccaccaccagtccatgcacttgtctctctaagatcacaaataccctgagaacagggaccatggctaagattctgtggccatgaccctggcctctaacgctgtggagacatggtttgctaatggaatgctttttccagaggaggccctttaacctaaccctctcctgccacagagtaaaggaagaaacaagaagtttcagtgacttacgggaagtcgtacaccttgacccgaatctagcaacctcaaggctcttctctggttgtttattcacagccatctgttttcctcattctctcctctgattccccctcaggagcgacagaaggccctttaccctcacctttctctcttagtcttatgaactgtgtctttctcagtgataggtcactcagctgctgtatttggtggcagagcccagagaacagcacagaaccacagccctcagggcaattcagatgctggggtttttttctgaaagtccttccctgaagagttattccttgtgagggaggggggaggaggacatttctggacttattgctgacatacacaccaaaggctgagtttgtcttctgggttaaacagaggcactatggctctaaattggccaggaagaggcttcagctgaggctacaggagggcagaccaccaagcgagtataaaagaaaaaagcaggctgggcacagtggctcatgcctgtaatcccaacattttggaaggctggggtgggcagatcacttgaggcccggagtttgaaaccaggctggccagcatggcaagacccagtctctacaaaaaatacaaaaattagcgcggtgtggtggtatgcacctgtagatccaggaatttgggaggctgaggtgggaggatcgcttgagcccagaaggtcgaggctgcagtgagccataaccacgccactgcactccagcccaggtgacagagcaagaccgtctcaaagaaacaaaaatgaaagaaaaagaaaaaatatataacagttaagtagaagcagaagcttccaccaatttgagggaaaagcaacctttataaaccaatgtcaagccaggacaggcagaaaagagcacctcttgagtagacaggctgacaggggccctggaattcaggctaggagcacatgttcatgagagaattagaatactgcactccagcaataatcccaaatccttggcagatgttaaagtgatttccatccccatgaggtgcagagatactaggaatcccccctggatttcttcctgggcaaggctgttgccaaggtccccaactgaaggtagaaagggtgacagtggccagcggagtgagaaagacagcaggggctgggcccacacaggtggccgccgttcccaccggcagcagttaaggctttgattagcagcccacagcagccatggctggggagggccacctcccacccgggcacaagccgaaggacacttgtgacaggacagctgcggatggtgggtactctcatgccctgtgtctttccacactgggatattcactatcacgtatacccccattcacacctggaaccactctgctagtccccaagaggagattcggactgttagaacgagataatttcagagctttaaatggctcccatttatgagaaactggatgagagagcaaagcaaagcattcacgactcacgtgctacagatgttcaagccaggagaactagcaggaaggggttctttccagccttcactctgccatttaccaagtatgtaccaagtatgtgagcctgggcactgtggatgtggctcaccattcctgcatctggggtgggcagatcacttgaggccaggcgtttgagaccaggcttgccaacacggcaagaccccgtctctacaaaacatacaaaaattagcgaggtgtggtggtatgcacctgtagatccaggaacttgggaggctgaggtgggaggatcgcttgagcccagaaggtcgaggctgcagtgagccgtgaccacatgagggggtcgagcaaaatgactctttgaaaatggccctgacaattctctagttacaaaccctcatttcacaatcattaagtgagggctccaatcacacagccagttgggtcagagcagagctggaatctgcctccctggatctcgtgcttctctgctctacccggcatctccttcctcccacctgtgattcccagtcatgctgtcaataggagtggcgggaggaggatcctggagccataagctagaaaggtccccaagacgcaggccgcaggctacgtgggaaatttccagatgctaagagaaggccgctctgctctttgtcagggctccccgtgaaactgacgaaaagtcaaattccatggaggtgactaaagacaactcgactctatctgtattatttgaatttcatacaatcaagcaggtatttcagtatgacttaattaaaaactgaatacagagtcttaaaacttctatcatttagattctttttttttttttttggagacagaatcttgctgcgttgcccaggctggagtgcagtggcacaatctcagctcactgcagcctctgcctcctgggttcaagaagttctcctgtctcagccccccaagtagctgggattacaggcatgggccaccacacccagctaatttttgtatttttagtagaaatgaagtttcaccattttggccaggccggtctcaaactccagatctccagtgatctgcctgcctcggcctcccaaagtgctgagattacaggtgtgagtcaccacacctggcctagattcatttattttggcttaactaatatctaataggtaaatcacagatatcccactggaggaacattctcacataactccttgtggataataatcacagctaacattgagaggatgccgtgtgccaggagttttgtagatgtgatatcatctcatgcttacgggacgtgtggctgttaccagcaccttacagatgcgaacacagagggttggagagttaggtcatttattcatccacacaggggaggtttggggccaggatcaaacccacgtgtgttggatagactgactccacagtccatgtccccgatccctgcaccacactgcctctcggtgggtatttacacctgacactaatatgtctctctaacgccattactgaagtcaagttctgacagagtaaggaagataagagacaacatcagagcacctgggctcaaggcccagctccaccacttattacttaggagaagttaacctttatgaactgcagtgtctcatccaaacaagaatgattctagatgattgctcacagaactgttgtgaagactaagtctgagaacccatgaacaatgctcagtgcaatgcctggtatataataagctctcaacagaaacacataatcatggttcaggacaccaaagagcacctgggcccccatcacagcactgctgctggccagccctggattgaagcaccatgctcccaggctgccagcttctgcagatttcagctaccctgaacattccctgccttaaagtcagcttccagaagagcacatttgatcccaagttaaattgtgaagtagacgaccagctgccattcatatggagcccagtgtggatgcgtaggtaagttagaggatgaagcgctgccttcagggtcacaccaacaaacttgaggactgactactacagaatccgtgagtgttctggctggtttagaggcctcggttatcccagttgtctgtattgacaagcagcaatcttgatgcgccacctgagtgagggttccactcagctgtaaatgacatgttataatagttttaaatttatatgtgactttttcacttttgtgtcttaaaagccaaaggaaatgacctcagttgttttttatttttccaaaacaaagtccaaaaggtatagactttccagcaccatctccaatggcatgtttccataaaccctctgcataggcacgcccaaccactcgccactctgaaaatgcatcgtgctttctcgtgcctctgtgccttgggctctcaccctccctacctgagaatgactcacttccttgtctccattaaagcatttggttacttcttcctgctttcagaccttttgtataagacgtcagttatgtcttcctaccagactgtagaccacatgaggacaagacgcgcctccttgtcatctgtgtccaccagtctactagaaaagctgaaaaaaggaaaggggatggtccttaagctgtaatgcagacacattttcatgactgcaaatgatagccttccaacctcatgataagtatcaggccacttggcttacttactcttccatgtattgtaatacgtcattataaattgcaggtaaccaacatattgacatatattgtggtgaagaagagcaagtttgactactttaaacattgctttttattccttatcattttaaatgtgttgctacttttgatgcactgcttactgacatttattgcttcctctgcacaagcacaaaatgctggctcactctcagattcaatgtagaactggtgaaagtcattaaatgccatgagccttgggttttttcccatgtactgtagtaaattcctcttgttgggattgtaattgcaggtggtcatcagagaacacagagcccccggaagaattttatgacatttcaggcaagccacaggtcagcctggggaaaaagcaggaagaaaaactggcaatacgagggcccaacccaaaagttattcctgaagagaaacaacggtaagaacttgcaggaatcaaattagttctgatgcagtaggcagaattcttagagaggccccttttatttaaaaatgattttactggccgggcacggtggctcacgcctataatcccagcactttgggaggccgaggcgggcggatcatgaggtcaggagatcgagaccatcctggttaacacggtgaaaccccgtctctactaaaaatacaaaaaaattagcctggcgtggtgtgggtgcctgtagtcccagctactcgggaggctgaggcaggagaatggcgtgaacccgggaggcggagcttgcagtgagcccgagatcgcgccactgtactccagcctgggtgacagcaagactccatctcaaaaaaaaaaaaaaagactttaccaatatgtagtcagaaattgttcaacataagctttctggtattccagtcataatactctagctgttcggacaacgccttctctctcgcaagctctcctcttttttcattctctttaaatctcctatctggcttccctaaataaattttttgtagccagaacttccatttcattgcagtggttagttttgtgtctcccattgctctttagtaacttttaatgacctgagacatcgttggcttcctttccttttccacttcctccaagtcaattgatagcacaccctacactctgtgtttacaagcgtcagagaaggcagcaataattttttttttttttttttttgcctcatcttcactaagggatgcctgaattcttgacagggccagatagaatgcaaaagtggttttctacattgctaagaaataacaggcaagtctagataccacgagagctagcaacctgaagaagtcatctgttcattctttcatttatttaccgtatacggtgttgggtgcacaaaaagcatggagcaaggtgcttcagggtgtttagcaatgagcaagacaaagacactgacaaggagctttcattctgcaagccgaaaaagacaggagctcaaattgataccatacaagtagcatgaaataggcaccccagagagggacacagctatggaaaaatcaaatgagggaaagattacatctcattgggaaagacttggtggaggttcaggtcagttctgggaatgatgagtctgaagtcattggggcattcaagggaagcatgagcaggcagtgggaacctgggaccacaatcaggaagaaaagggtgggtaggatataaggggtccaaagtcacttggaagaggttgtcgtggctggagcagtgaggggctcacacctgagactccagtactttaaagaggctgaggcaggaggatcacttcagccaaggagtttgagaaagaggttatcctcaattccctaattcctgttccgcctactgggatgcttccactcctacagcttccagagcctggtgcagctggggcttttaacttaccaacagatgttctgctgcagctggctcatccaggatccaccataagggacttccgcttaggcaaaattgcatttcagtttttaaaacaaaagagggtcaggcacggtggctaaaggcctttgggaggctgaggtgaggggatctcttgaggccaggagttcagcaacagcctggccaacaatgtgaggctccatctctaaaaaaaaaattaaaaattagctggacacagtggcatgtgcctgtagtcccagacactcaggaggctgaagtgggaggcagaagcatcacttgagcccaggagtttgcggctacagtgagctatgatcaggtcattgcactgaagcttaggcaacagaacaaagaccctcacaaaaaaaaaaaaaaaaaaaaaaaaaaaaaaaaaaaaattaaaaattgaaagggatttttgttgttttgttaggtttttttggtttttgttgttttcttattttttacattgtcttcacagacatcaccctgttagatttttttttttctttttccttttttgagacagggtctcactctatcacataggctgaagtgcagtggctcaggacggctcacaagagcctcaaccccctgggctcaagggatcctcctccctcaacctcccagatagctgcgattgtaggcacatgccaccacacccggctgattttatattttgtagagatggtgtctcactatactgcccaggctggtctcctggcctcaagcaatcctcctgcctcagcctcccaaagtgctgggattataggtgtgagccactagaccaggtcccagacattctttttgaatatacctaagacatttgcaataacagattatgtattatgccatagaccaggaaataatttattatttcattttttctcatttttaagaatgcccagttttttgtcattggtggtggtggtggtggtttttttctgtttttcgtttgtttggttgttttttgttgcccaagctggaatgcagtggcacgatctcagctcactgcaacctctgcctcctgggttcaaatgattctcccacctcagcctcccaagtagctgggattacagcgtgtgccatgacgcccagctgatttttgtattataagtagacacagggtttcaccatgttggccaagttggtctcgaacttctgatctcaagtgattcactcacctcaaccttccaaagtgctgggattacaggtgtgaaccaccatgctcggcccccatggtttccttaatctgaaaagtataaaaaaggttttttttaatccagattcccactagccagaagtaatatcatttatagtaccaaacttttctatttgattaatgcaattaaggcaaattaatatttgtgtgttgattcttttatttgcatttttttaaaaaacaaaacttggatgttgtaattttgttattttctttttcactcgattatgtatcatggccttttttgacatatgcatctacattatcattttagattcctgcaggatattccagtttattgataggcattcaggttatattgatagacattcaggttatttccactggtttttttttttctttttttctttcttttcagacagagttttgctcttgttgcccaggctggagtgcaatgtaacaatctcggctcactgcaacctccacctcctgggttcaaacgattctcctgcctcagccttcccagttgctaggcctacaggcatgcaccaccacacctggctaattttttgtatttttagtagagatggagttttgccatgttggccaggctggtctcgaactcctgacctcaggtaatccacccgccttggcctctcaaagtgctgtaagccaccacacctggctgtttatttccacttttaaattgcttttagataatactgtgataataaacatcttcatatgtatactcttgtgcatgtatctgggtgtctctccttactatccatttatagaagtaggattactaggtcgaaagatgtggttaacggtattaatacacattgtccttaaatttaacatcacgtcatctaaactgtggcctcaccttccctcccctctaagtacttcccactcatcatgtggtacctctttcccagctctacacctatcttgacccccattcctgcaaggcctaagctgcctactagctgcctattagctaatcaacagaatattcactttttagagcttttaaaattattactcattttcatgaagattaaaatgacttccagagccaaggaatgaagctataatgaagacaacaaagacaggagaacgatgatgggggttgatccttggctgatagacttcaaagtcaaccattagcacccaggatgagtcattttgaattagaatcagatactctgcccacctataatgagagatcttcttgatctttaatgagtaccatctcttcattgaaacagtcaccagaatttgcatttccaagatctcttgccactttccccaaaataccttctatggccattacacagaaaaaaacttatctgtgcctgcaaagaaaactcagctttggaccaaattatccccactgtgtacaacaaaatcacattcctctggcctctgtatttctctccgtagtccatttcaacgcttatagcaaatcaacattgtgacccaataattattaagtccattaatctttactgcattattaatcgcaaatctcaccaactaaccttgcaaagtgcatatgtgggtaagccatggaagctagaaagagtttcctgggaaaatctgggatcttatttcatgtcctcacatttctctgaaggaaaaaaacttgtaaacattgagtcaaaaccttacaaattttggagggaggaggagtgcaaaaaattcttacaaatttcacaaggttacaaagcaaaaggggaatgtggtcttgaaaaattcttaaaacttaaccagaatgaatgacgactgatctttctttccaatagtttgatgtttggattagtgcatttccgttgtgaaatccgattttctattatccagttacacctagtaggcatgaaataaatgtttgttgaaatgaattaaatgtaatatgctcaggtcaatgtctttcacattctttataaggtcttatatttggaaaataatattaacaaccatttccatgaataacatttacttcatccatagaaaatgtaaagatactaccaaagggagccatcctaagatgcctgaaatgagttattaaattctaacttaaccacaaccaatattactaatttgttttaaataacttgtccaactcctagaaggaaacaaggatttggggagcagaagtagatcaagaaaattagtattaaatggcaggagtaaagggataacatttgaaattctggcttcctggagtgatcagtcaaaagctctcctgctggaaaataatatcttgaattgaaaagcattcggatcatggtcgatttttaacccaattaaatttccttctcctaggtagcctatttactaaagcagtatgatagctgttaatattatcatttaataaacatattgctagtaaaaatgaactctattccaactattaccacagcataaataaagattttttctcaaaatgttagcttggtttgggattgctgctttttctttccaattgatttgcctctgcccagctgatctgcctctgaggagctaaaaaataccaataaatagtaacacagactattaaagtatgcttttcataatatgtcaatatctttctatttctcaggataaccatatgcaggaaggatagggaaacaataaactattattttaactgcctaacagcgttttttcaactagaaaccacattcaaacaaccttatttttcactatgcagcacgtagtccttctcttatttcctttttcttaaaaaaattgaatgtattttgctaatcttctctgtatctttccaattttaccctgtgtgctgccgaagagagcacttttctgggggaggggaggggaggggtgttgtttttctatttttgtttttaagacagagtcttgcactgtcacccaggctggagtgcagcggcatgatctcagctcattgcaacctccgactcccaggagtcaagcaattctcatgcctcagcctccctagtagctgggattacaggtgtgtgccaccacgcttggataatttttgtatttttagcagagatggttttgccctgttggccaggctgctatccactcctggcctcaactgacccacccacctcagcctccaaaagtgctgggactacaggcatgagccaccatgcctggcccagaacttcctaagaaacacttacacgtcactgcttgctgtctcacacttccttgggtgaattccctggagagtgaaaagattcaaacagacacaaaatggcaatacatgctctgtccacttcacaggaatttacctgaatagtttcagacacagactttatcataattaagaatttttgttttttggggtttttttttttagatggagtcttgctctgtcgcccaggctgaaatgcagtagcgtgatttcggctcactgcaagctccacctcccgggttcacaccattctcctgcctcagcctcctgactagctgggattataggcatgtgcctggctaatttttgtatttttagtagagacgggatttcatcatgttggtcaggctggtctcaaactcctgaccttttgatccgcatgcctcagcctcccaaagtgttgggattacaggcatgagccactgcgcccggccagagaaatattttttaataaacaacttcagaggccaggcacagtagcttatacctttaatcccagtactttgggaggccaatggggggaggaacacttgaggccagttcaaccagcctgggcaacacagcaggaccccatctcaacaaaaaaattaagcactttgggaggccaaggtgggaggatggcttaaggtaaagagttcgagaccagcctcagctacttggcaagaacctgtctcaagaaaacaaagaaaaaatttaaaaaaacacaaaaactaattaaattatgattatagaaatcttccgaaagataagaaaatgttcgtcaaataccaagtaaagatttttaaaaagagtacgtgccacagtgaccaactcatcctggttaatctagaactgctacagttttaaaactaaaactgttttaaagtccacagttcatgccaggcacagtggctcatgcctgtaatcccagcactttgggaggccatggcaggtagatggcttgaggccaggagtttgagaccagcctgaccaacgtggtgaaactccatctctactaaaaatacaaaaattagctggatgtgcaggtgcatacctgtaatcccagctactcgggaggctgaggcatgacaattgcttgaacccagggggcagaggttgcaatgagccaagatcgtgccaccgtactccagcctgggtgataagagtgagacattgtctcaaaaaataaaataaagcccacagtcctgggaacaccccacagaccaaactgaggcaactgattaccctagcataagcaatctttgaatgaaaatatcaaaatcatcaagaccactccctttaactgaattaaacagcctttattgaatgccttctgtgtataaagtacaggcagcccttcatacccacaggttccatatccatggatacaaccaaccatggatctaaaatatttgggggtaaaactgcagtaaaagtaatacaacaatataaataatacaaatttaaaacccatgtagtataactatttacatagcatttacatggcagtagatattaagaaatttagcgatgatttagagtacacaggaggatgaagttttatacgcattgactatgccattatatcagggacttgagcatctgtggattttggtattcctagggtcctagaaccaatccccaacagataccaaggatgactgcactgtgctgagcaggaatcagtcagggtccaggcaggagacggacagtacagccaaactgggcgatctgacgacagtgtcacaaagaggctatttacagaggtgtgggcatagttagagaaaacaatgaacagagaagcatcctgggctagcaagagtgggggctgccagcacctgaaaaggcagaggaggctgtccaacctgaactcaccacgacccagcaggaggcggcaagccctcccctcctccaccctacagactagcactgtgcctcccactgggtaaatctgactacaaggcagaggaagggggcttgttgatggagtcctcgcctgtcagcaccccaagccacagagcagggcagagtgagtctgaaggcacacaaacaacacataagcctggcccctgctcttggcaacttaaaaatctaagggaaacatcaagtcgttattttaggcacatactgagacaactcactagtgccaaaaactgagtgtttaggtctaaccggtccctgcagaattaaatcaaaatcaagttattcattccttatggctcctgatctgctttcggttagaatgaatgagccctggggattaaaagagagatttatgtatccgtgaaattattttactcatcccacatacctgtgctagtttgagtcctgcatctgtcccctcactttttgtgcgcgtttgagagagtcttgctctgacacccaggctctggagtgcaggggcatgatcttggctcactataaccttgacctcctgggttcaaatgattctcctgcctcagcttccgaagtagctgggaccacaggcatgtgccatcacacccagctaatttttgtattttttttttttaagtagagacagggtttcattatatgttggcccggctggtctcaaactcctgacttcatataatccacccaccttggcctcccaacgtgatgggattatagacgtgagccaccatgccgagcctgtcccctctttataattccaaaggtgagggtgtctttcgtgtaacatgtcagggcttaccttgatgggtttatgctgcagtactgtgccaaatgtctataccctgaagcaacctgctcgcgtccggaatcggtgggttcttggtctcactgacttcaaatgtgatgccgcagaccctcgctctgagtgtcacagttcttaaaggcagcgtgtccggagtttgttccttctgctgctcggatgtgtttggagtttcttccttctgatgggttcgtggtcttgctggcttcaaaagtgaagctgcagaccttcgcagtgagtgttacagctcttaatgcagcgcgtctggaattcttcgttcctctcgttgggttcgtggtctcactggcttcaggagtgaagctgcaaaccttcgggtgagtgctacaactcacaaaagcagtgtggactcaaagaattagcagcaacaatatttattgcaaagagcaaaaaaataaagcttccaaaccgtggaaaaagaccacagcagattaccgctgctggctcgggcagcctgcttttattctcttacctggccccacccacatcctgctgattggtccattttacagagagccaattggtctgttttacagagagctgattggtccgttttgacagggtactgattggtgcctttacaatccctgagctggacacaaaagttctccacatccccgctagattagctagacacagagtgtcgattgctgcattcacaaaccctgagctagacacagggtttgtgtctagctgattggtgtgtttacaaaccttgagctagatacagagtgctgattggtgtatttacaatcccttagctagacataaaggttctccaagtccccaccagaatcaggagcccagctggctttacacagtggatcccgcaccgagggtgcaggtggagctgcctgccagtcctgcgcctgtgcgcccacactcctcagcccttgggtggccgatgggactgggcgccgtggagcagggggcggcgctcgtgggggaggctccggcggcgtaggagcccacagcgaggtggggaggctcaggcatggcgggctgcaggtcccgagccctgccccgctgggaggcctggggaggcagctaaggcccggcgagaagtcgagcacagcagctgctggcccaggtgctaggcctctcactgcccggggcttgctggtggacctgcacctccggggcttgcgggcggacctgcccgccgagcccacgcccacccggaactcgcactggcctgcaagcaccgcgcacagccccggttccgcccgcgcctctccctccacaccttcccgcaagctgagggaagcagctccagccttggccagcccagaaaggggctcccacagtgcagcggcgggctgaggggctcaagcgtggccagagtgggcgccaaggccgaggaggcgccgagagcgagcgagggctgtgaacaaactccggacacgctgtcacctctcactcttatcaaaggtgagcatctctgtgcttttccaaaatgtgtccatttttgtcaaagccaaaaacaaaagagcaaattaccaagcagcgtttcactgcatttatctgttgtctacaactcctgacttgctaagggcgactgaaatttacaggaggaacatcacaggaaatcatcacgaatgtcagctccaaaatggtccccatgtcttattctttccatcaccattaatccaagatttagaggttaaaattctaataaatgggcccggcacggtggctcatgtctgtaatcccagcactttggcgtacacaggcagataacttgaattcaggagttcaagaccagcctgggcaacatttgtctctacaagaaatacaaaaaaattaggccggcgtggcggctctcgcgcataatcccagcactttgggaggccgaggtgggcggatcacaaggtcaggagttccagaccagcctgaccaacatggtgaaaccctgtctgtactaaaaatacaaaaattagccaggcgtggtacgcacctgtaatcccagctactcaggaggctgaggcaggagaattgcttgaacctgggaggcagacgttgcagtaagccaagatcgcaccattgcactccagcctaggggacagggcgagactctgtctcaaaaaaaaaaaaaaaaaaaattagctggatatgctggcacacacctgtggtcccacctatttgggaggctgaggcgagaggattgcttgagcccacagtggttgcagtgagctgagatggcatcactgccttctagtccagcctgggtgagagagtgagacctgtctcaaaaaaaaaaaaaagtcgaataaatgtatcataaaattagatttcattctgttagcattaaactgcagaaattcctcacacaatgatatcatcatggcagctaatgtctcatgaaaagacaagtctccatgtgaagggtgcttatgatttttggaaaacaagttagtctgagactccattcttctctttgtaaaatgtgggaaataatgggtgactcattgattgttgtaaggattaaataatataatttccaaaaatacctaacactaagtaggctctaaaattagtctccccaccctcaaactctctaccttaccctaagtgcatatatacatttaaatacatagttttagtcactttgtttaacaatgttacattttagtaatttaaaaaatatattttccccaaaaccagaaactccaaatgtatctccacttccctgacacaaagtagctatctgccaacacaaggaatggggtgaaaggaataggacattccattgaaccaggagtttccagagaagtgtgggtttcttcctttcaacctctttgatgtaatctaaatcaataagtaatgacagtttgtccaaaagtgtcatacattcaggtgaggaagaagggtaggaagctcatggatgtatgcagaggaacttaagaactcctctcaaacactgtaaaacaggttttctgtccatacatagggtggatttgcaacacagccttccacaggctcaagcccatctgttgtaaggagcatgagttaggacagaacaaggaggaaaactaccaagtcatctctcttcacacaagtccagccaagtattgattgtttattcaaagctttcttttctccctccctctctctgttcagtcactatcccctgcctcccacccaccccctccctccaccaaatgaaattaaatttctcaactacctctatttgatgctgtgtttagcataagccctgagtagatatggattctgtttcttgaattttccctgacaaaccgcttccagctgccctttggggtgggatgccaccgtgataaaatacagtgtcatgtttgctgaggatttcagctgccacctgggggctcatgcactcaatgagtgctctttagcaaggctggtggtgacatggtgacaaacggtatgttgacttttttctttctgtggtttaggactggttggtttcagtcttgctggctctttctcctgggttaccaacattttccacatttagagcctgtgactgcctctcctccaggattattgcagcaagctccttgctgtcgacagaagccatttgttggttagagggtttacaactgagacgacctacaagtgcccatttgatagttaacccatgcttcagaatttgcttattttttttcctttttaaggactctttcttcaactaaacagtttctcttcagagtgttatcactccgctcccatgaaatgactgggactgttacttcttttatctctggtcacacccagcaaaattaagcttgcttgtggatgattagccgtaggctgatccacatctgagccaattgactggctgcttaggaggactttgcctcgggctcacccctgaagccaccacccctgaggccactgcctgtgccagggcattcccaagcctctatccccagtgtgggcttccctgctgcatgtggctcttcagcctcaggttcctcctcttcactcccccatccttgcatgggcttcctcttccgtcccgcttgcttctagaacatttccaattattgcttccaggtcctgaacactagtggctgaactgaaaaatggaaaagatgatgaaagccaggcactgagaaatcagttaattaaactcttcagaggtccccagaaaggacagattcccctgcacacctgatgaggaatcttggactcttgcttattaaagggaaaggaagtccattttactggacacttgtcgaggaattccagcaagcccctggacagagggcttcagtgaccagggtagctttctgcttttggttgtaaagagatcagaaagtgtcatccttcaaagcgatgtcatgggctcagagccctttctgtgcactttgccatattgtgcccactccggttctcaaggtcagttggccatctgaagtggaacaatgacttctctacaatccagctttaactatttgcacagttccatgccattccactaatttagtacataccagggtgtacccaggcttcaggctggtctgggttctacttcccaagcccagtcccagcacatgccttcccaaagatctttcctcccaggtcccagtctccctcttaggatcaaaccaattcaacttaacccttatttaatgtcttctctctgcctactcagcccagtgtggtagtcaggcacagaaactcatcaattacagcacagagtcagcaggtcaacaacagagtgggataaaattccctcttctccaaacacacaaacccagctctgtagcatcttttttccacccctgaaattcccccaaacagactatcccttgtgctggcatccggcaaggtcctaaagaggccctacagcctgtttttgctcaggctgttttcaagcctttttccgatctattttctctgaaactttgcgtgcatatacacacaccagaatcaacaagtcgactgagcatgcaaaagccacatccacatttctagaccttgataccttctcagacctctggcaaatctaaagcccagaccaactgggattactcccaggttatacattgctttagagaagagaatatttgtcacacctaggcatggatccgagaagtcctcacatgctcacatgcagaaggcccattccttaagtaattagaaatccatcatctaaaaaaaacaatgaccaaatcacattttgattaggattaaaaggtggaggctgggcatggtggctcatgtctgtaatcccagcactttgggaggccaaggcgggtggatcacttgaggtcaggagtttgagacctgcctgggcaacagggtgaaatcctgtctctacaaaaaatacaaaaattagctgtgcatggtggtgcatgtatgtggtcccagctactcaggaggctgaggtgggagaatcacttgggcctgggaagtggaggttgcagtgagccacgatcacgctactacactccagcctgggccataaagtgagactgtgtctcaaaaaaaaaggtagagacaatagtacaggtaccttgaaacatccaaaaacccaaaagcttttctattctgaaaggatcagacaattttcttataagaaatatattttttctgatgaggctttgctggagatattaccagaacaagtgtctccaaccactggtagtctggaaaatgataaaggtgggttctgggtggcacagtgaaaccagcctgagattacaaacctttgctgggggtaaactacagaagcaaccatggagacttaattctgtgtttttctgagattctataattaggtaatgtcatttacatgcttccaagtgagggaaggaaattctttggaggcaaagcgtaacggttccagtactggcaccaaatgtcttcctgctcagcaagtccattttaaagtcttgttcatgagctaagctgagttctcctacagaagcagagtgaagagtcaaggaaatgtgaagactggccaggcacggtggctcatgcctgtgatcccagcactttgggaggctgaggcgagcagatcacaaggtcaggagttcaagaccagcctgaccaacatggtgaaaccccgtctctactaaaaatacaaaattagcctggcgtgctggtgcatgcctataatcccagctactcaggaggctgaggcagaagaatcgcttgaacccaggaggcggaggttgcagtgagccgagattgcgccattgtactccagcctgggcaacaagagcgaaattccatctcaaaaaaaaaaaaaaaaaaaaaaaaaagaacatacctctttcagcatccccttgcagggtcctccctatctctgtgattccaatagtattctctgaaacaacacagaagagttggcctccctccctcgcctgacatagctctttacacagttgcaattccatgcctcactcaccaccccgttctggtgactttcctctgcacacattccgccttgctctccctcttagtttttaacacctatttagcaaatatcctggaaaaatatttccaaaaaaagttaaaagtggttgtttggaatgatgagattaccggtccactgttgtttgctgcttctttgcatgttttcaacgtctgggcctggaacaagtgcaggtattcctttgctcattccgtaacgatgctcagcattgagtgtgctatcctgactagtgcgaatactccattgcttgacttctcctgtgtccggaacgttacacttctggtaatacattgtacgattgtatttgtctttttcaagaccacttaacaccttcagcttatataaatctcgtagctaactgaagcctccaggttttttcacatgaagtgttcacataaatcatggatctcccaacctattttcatctttatgagtagttaagacataaatccttcttacagtattaaagggtgctagtgtattaaactacctaaatagccagcatgccttttaaaggggctatcatgatctaattcaaatggtaagaattccagggtctatgtcaggtgcccctggctccctctgtgtctcatccccttccattatggatccaaaaaacatgtcttgaaatgttgcctcctggccgggcatggtggctcatgcctgtaatcccagcattttgggaggctgaggtaggcagatcacttgaggtcaggagttcgagaccagcgcctggccaacatagtgaaaccccatctctattaaaaatacaataattagccagatgcggtggcatgcacctgtaatcccagctactcaggagactgaggcaggagaatcacttgaaccccagaggcagaggttgcagtgagccgagatgcaggttgcagtgagccaacatcgcaccactgcactccagcctgagtgacagagaaagactctgtctcaaaaaaaaaaaagaaatcattgcctcctgcaaaaattaatatgcaagaaaattcaagggactagtaatctgtggaaggagggggaagatggtaatgttttatttcttttcggtgtcaattacatgaggtcattttattttataatatattctcttgtatgtgtgaaatacaaattttaaatatgtgataatttaaaagtaatatgtagagttgatttaaaataggaaaaaatgactgggcatggtggtccatccctgtaatcccagcactctgggaggctgagacaggaggatcacttgagccaaggagtttgggactggcctgggcaacatagcaagatcctgtctctacaaaaagtacaaaaattagctaagcatgatggtgcatgcttgtagttccagctactcaggaggctgaggcgggaggattgcttgagccccagagattgcaaatgtagtgagctctgattgtgccaccgcaccccagcctgggcaacagagccagaccctgtctctaaattaattaattaatttaatttaatgggaagaaatgtctgggcactgcggcttatgcctgtaatcccagcacattgggaggcagaggctggaggatcacttgaggcaagaaattcaagaccagcctgagcaacatagcaagaccccatctctacaaaaacattaaaaaataaaaaattcactgggcatagtggtgaatgcctgcagtcatagctactcaggaggctgaggtgggaggcttgctggagcctgggaggttgaggcagcaaatgagctctggttgcaccactgcactgcagcctgggcaacagagagagatcctgttttttaaaaaaaaagagggggggattgggggggaattctcagtatcccttcaattttgaggggaaaaaaggtaataagaaaaaacaaggagaaagcaatagataagcaaatgaaagggaggaaaacagattcaagtttgaaaaggaaaatgaaagaaaagatagcggcctggaagacaggcagagataggaggattagatggagtatttggctgaacagggacaacagaggtggtgaggagtccctgcggcgctgcagagtgggagagagcggaacagtgaaagctacttcggatcctccaagaaacgtcagcaaatccatcctattcctcagcattctgcttcagccacctaaggcagtcagcctcccactgccgttcagcctgtgtggcccagagccaggaagcacgttccctcgcagctctgggtacagattccctatacacatgagtgtctccctcccggtgactcagctgctgtgctttcctctccttccccagggcctgagcagtagcctgcctgatgatgatcaagcagagccctgcaagtttcaagaggaatgtcagtgactcttcactgaaaccccccaggtaggcatgcagtgacaatccagggctttcctggacacattgcaatcctaacctcagggtaaaagccatgtccctgttccgccacagcatggcaaaatcaattccagttggattaaaaagttacatgtttttaaaaaaatgaaaccgtaaaaatgtatgtgactcagataaagtaaaaaaaaaaaaaagaaaaaagtgagtggttatgtgtttttaaaaagacagagatcaaatggataaatattacacaagactagtctaaattgtttggtgtacaccatgaaatacttttttcaacctctggctccaaatctccaaacttttgtccccttccttactccttgtgctgaacagacagccttttagtcactcagttttaagagaaacttcattctggtcattaagactccatctcaggtatgaaaatttcagtaagtgaaggcaaagattaattttatattcgtttaaaggcttttcccgtccacctaaggccaggcttgcagtccctgttctggaaggtgggctgtttgctctttctgcattttactcctcttctcctctctctctgcagtttctttttctttttcttttcttttcttcttctttttttttttttttcttgagacagagtctcactctgttacccaggttggagtgcaatggcacaatctcgtgtcactgcaacctctgcttcctgggttcaagctattctcctgcctcagccacccaagtagctaggattacaggtgatggctaatttttgtattttttagtagagatggggtttcaccatgttggccaggctggtctcgaattcctggcctcaggtgatccatccgtctcagcctcccaaagtgctgggattacaggcatgagccaccacgcccagccctctctctgctgtttcccctctggcgttgtcgggaagggaggggaaaggactaggggaaaggtgcctttatgtaagtcatgcagctgtcctgacagtcaaactctctctctgggagggtccccttgtgtgggctcaagagacctttgagggtctctccagggcactgttgtctgatgcatactgggtcatctcagagtcccactcctaggctcctgccagctctccccatcacagcctggggcacatgatgcagggggctccccaccagacagccagccaccttgggcgggtcaccagccagatggcctgagtcactgtctgctgcattcacttggcccacagcacatccttccactccacattccagatggggagagtgtagctgctctctctgtctgctttctcttcatcccgctgggacgggctgctgcagcaagacttttgcattcagaattctctagatgaaaaggagagaccagtttctatgttcagttagactcctaattcaggaaggggagggcacagggatgggaagttgggggatggggatggagggaagatggggatggggaagaggatgggtccacctctctcagaaactttctcattattctgtgctagtgtcagcaccagatgggccttcagaccccagcatctccgtgagcagtgagcaaagcggggcacagcagcctcccgctttacaggtaggtcttggtttctcccagtggcaagcttggagtccatctggcaaggaagagcccataggggaatcgccccacaccacactctccctttacatctgtcctgtgcttgggtccctttggtggtctggtgaagctgtggactccttagaatgatgtttttggccgggcacagtggctcatgcctgtaatcccagcactttgggaggccgaggcaggcggatcagctgaggtcgggagttcaagaccagcctgaccaacatggagaaaccccgtctctactaaaaatacaaaatttgctgggcgtggtggcgcatgcctgtaatcccagctacttaggaggctgaggcaggagaatcgcttgaacccgggagatggaggttgcggtgagctgagattcattacatcgttgcactctagcctgggtaacaacagcgaaactctgtctcaaaaaaaagaaaaaaaaaaggacgtttttaagtttataaaataaaatatacaggactacaaaggttatcaattacattgaaatgcagttatcacaatcatttgaaaatgtgtactctagtaataatgcttctttttaaaaaaaatcactttattaggatataattgacatacaaaaagctgtacctattcaggccaggctcagtggctcatggctgtaatcctagccctttgggaggcctaggtgggtggatcgcttgaggaaaggagttcgagaccagcctggccaacatggtgaaaccccatctctactaaaaatacaaaaaaattagccaagcttggtggtgcacacctgtaatcccaactactcaggaggctgaggtgggagaatcacttgaacccaggaggtggaggttgcggcgagctgagatcgctccactgcactctagcacgggcaacaagagcgaaactccatctcaaaaaaaaaaatagttgtacatatttaatgtatacgtgcacccccatgaaactatcaccacaatttatgttataaacatatccatcatctccaaaaggttcccccgccctctgtatttatgtgcatgtgtgcacgtgatgggggggggtgggatgagagcacctaacagttaagatctaccctcttggtaaatgctcaagtatgcaagttctgttaactatagacagcatgctctccagtagctctttagaacttgtataagggaaatgttgtaccctttgaccaagccctcctgtttcccactcccccagcccctgtcaaccatcattctgctctttgcttctatgtgtttgactattttatatttctcaagtgaaatgatgtagtgcttgtccttctgtgtctggcttctttcacttagatgatgctttattaaaacatagtataacaaggtctaacagtgatttctaactagtgatgagtataaaggtattttgctatatctgcaatagctgtatgttatatgaaaacacgtgtgctttctactagagactaagttacagttgttgctggtactactatagtttgttgcgtacattcataattgggggaaatgcaacatttcagctagaggatagtgaaaataaggatggaatatttttcccattgatgtttgcaacctgccaaggacagacaaagaacccttgcactagactgactactgcctgctccagggaatcctcccacagccttcctggcctctgcttatataggtcaggagggtgcaggggacatggctgcagggctggtttggtggcctcttggtgaggtttgcagaatcacctggcaacttccctaggagtggagagacatgaaagccaatgctactcagcttttttttttttctgctacgcactttattagcaacttagctttttttttccctcataacccatagacttagcaggaggagcatagacattaagagtaagtgcacatgaaacattgaaaaggagtaaacatgaatcctctctttgcaaaagacagtctcagaaatttctcatctgctaattcacttaattcaacaaattacatctatcatgtttcaagtgctttgtttatcgatatagtggtaaacagaatacactgatgggacaagcaactctgagatgacagaacgagttccctaaatagtctgttactgtgactcctgtttatgcttgatattcacaaaatattctggaattgatacccgagaaactgctaacagtgattacctctggggagtagagatggaaattgagaggaaaagaagggaatgtcttttcatgttaaactcctttgtactgtctttaaaaataataataaacatctttttatatgatgaaaaacaagttgtaaagacaactttaaaagttttcctaaaggaaaccatatgtgactttaactgatttgagacagtagaagctttctaagtataaaagtaatagaaggaacgatgggggaaattgatagatttcactacacacacaaaaaaagatgcaaaacacgtcacagaccaaaaataacaaacttaagaaatatttgcaacaaaaattaaaaggggccaggcgcagtggctcacgcctgtaatcccagcactttgggaggctgaggcgggtgaatcacctgaggtcaggagtttgagaccagcctggccaacatggtgaaaccccgtgtctactaaaaatacaaaatcagcatggtggcacatgcctgtaatcccagctactcaggaggctgaggcaggagaatcccttgaaactgggaggtggaggttgcagtgagccgtgatcatgttgcaaaactccgtctcaaaaaaaaaaaaaaatagcctcagcctcccaagtaggggggactacaggcatgcaccaccacgcctggctaatttttgtatttttagtagagacagggtttcaccatgttggccaggatggtctcgatctcttgacctcatgatccacccactttggcctcccagagtgctgggattacaggtgtgagccatcgcaccagctggaaatggtttcttaaataagacccaaaacggacaaatgtttaaaaacgtaaattgaattacatgaaagttaaaaacttcaacacaataacagacatcttagaaaaaatgtaaaaagtcaaaagcctaaaagaaagtgtttgcaacacgaaaaacaaagcattaatatacaaaacatgctaaaattattttaaataaactttaaagaaaatacaatagaaaaaaatgagtaaatgatacatgcagtaattcacagaagaaactgctatagtcaaaaaatacaggctgggctctatggctcccagcactttgggaggccaaggcaaatggatcacttgaggccaggagttggagaccagcctggccaacatggtgaaaccccatctctactaaaagtacaataaatgagccaggcatggtggtgcacacctgtaatcccaactactagggaggctgaggcacaagaatcatttgaacctgggaggcagaggttgcagtgagccaagattatacaccattgcacctcagcgtgggtgaccaagtgagactctgtctcagaaaagtagtaataagtaaaaataaaacaaatgcaggaaaagttgtacaactttaccacaaacatgtaaatgcaaataaatccacatttcactcccacaaatcatttcactttcccatatgattagaaaaactttaaaattttgacaaaaccaagtgttagagaggatcgtgggaaaccaaagattctcatgcactattagtgggaatgcaaatttattcaatcactttggagaaaaagttggcattatccagcaaagtgaaaaatgagtacaacctctgacccaattctgcttctgaagaaacacttgtacatgtgtgcaaagagacaaataaagatgtttactgcagtgttgctctatagtagagattagttggaactagctcaaacgtctgtgtgtagaagaatggataaataaactacaatggaacaatatgtgcagtataaacaaaggaaccagatttatacgtagcgacatcaaggaattattaaaaacaatgtggccgggcgcagcggctcacgcctgtaatcccagcactttgggaggccgaggcaggcagatcacctgaggttgggagttcaagcccagcctgaccaacatggagaaaccccatctctactaaaaacacaaaattagccgggcgtggtggcacatgcctgtaatcccagctacttgggaggctgaggctggagaatcgcttcaacctgggaggcggaggttgcagtgagccaagatcacgccattgcactccagcctgggcaacaagagcaaaactctgtctcaaacataaataaataaataattaaataataaaaataaaataaaataaaataaaataaaataaaaacaatgttgaggccaggcacagtggctcactcctgtaatcctagcactttgggaggctgaggtgggtgaatgacctgaggtcaggagttcaagaccagcctggctaacatggcaaaaccctgtttctactaaaaatgcaaaaaattagctgggcatggtggcaggcacctgtaatcccagctactcaggaggctgaggcagaagaatcacttgaatctgggaggcagaggttgcagtgagccgagatctcgccatttgcactccagcctgggtgacaagagtaaaactctgactcaaaaaaaaaaaaaaaagttgagtaaaaaaaaaatgccacggatagttttatacagtataataccacttatttaaatattcttaaataccaaagcaacattaaatatttacagatgtatttctacctagtaaaagcataaaaaggtgattgaggccgggcgtggtggctcacacctgtaatcccagaactttgggaggtgaggcaggcagatcacctgaggtcaggagttcgagaacagcctgatcaacgtggagaaaccccgtctctactaaaaaatacaaaattagctgggcatggtggcgcatgcctgtattcccagctactcgggaggctgagacaggagaatcgctagaacccaggaggcagaggttgtggtgagccaagatcatgccattgcactccagcctgggcaacaagagtgaaactctgtctcaaaacaaaaagaaaaaaaaaagtaattgatacacactaaatttctgatggaaaggaaatggggaaggaaagaggagaagtgttattgtactttcctatactttaaaaaaattttcccaaaaaaagcagtacatgtgaaattacgaaggagagtgtctgacttttattagatacttgctaaattatagctatccttgaagttatctatcaagaacaggtgctaaaatgtacttgcttcctgtttcccaactacaccaactggtggcttctcctcatcccacgtgtgctaacagcaggctctgtgtatcacagaacaacacagtgtgagccttgagcctcatgtcaagccggtgcttctcaacctggggacaattttcactgccaggggacacttggcaatgtctggaggcattttagtcgtcacagctggggcagagggcgttgctactagaatggagagtgtcgaggccagggaactgctgaacatcctgagattctcaggacagcccccaccacaaagaaccatctggtccaaatgtcaatagtgccgaggttgagaaacccaatgtaagctcatagaaattaacataaataaccgttgcattgaatctaatatactaaatttgactacttttctgatgagtcctttttataaattatcagacaagtgaagccacatcttctttctaatctttctttctaatactggacactgactagaccggagagtgtgggtgatagagctgcttctgccaaaaccatggcctctagtttctcttctctgtatccacagcaggcagaatggcatctgttggaaagggcatatactctaaaatctttttttttttttttgagatggagtcttgctctgtcacctaggctggagtgcagtggtgtgatctctgctcactgcaacctccgcctcctgggtttaaacgattctcctgcctcagcctctggagtagctgggattacaggcatgtgccaccgtgcctggctaatttttgtatttttagtagagatggggtttcaccatgttggccaggctggtctcgaactcctgacttcaagtgggccacctgcctcagcctcccaaagtgctgggattacaggtgtgagccaacacacctagcctctataatcattttaattgggcaaaatattatggaatttttttcagtcatgaaaattaatcaggcttgcattctaattcagtctaaccctggctatttccaaagccaaaggaagcacaacacaggtatttcttttcaacctcccaggaaatagttcaactgatccatggaccagatgtcaaatctacaccattaaatcaccttctccatagtcttaaagttcaattggccaaatcatgcatgaagaggctaccagtcatggttacattcagcttcatagcataaaactgcaaaagacaaaggcatatataagattaaatttcatttttctctcagttaaaagaaacctagagataagcagtccagagctgctttggtagctccatgacatcatcatgctccattgcattctctgtgcccctcatcctcatagttccagatgcttgctgaagctcccccagaacatccctgtttctaagttcaaatcagcaggaaggagaagggaagggcatggttctactcttttaagaacacttccaggcagctccttgcaacccaactacttttatctcactggccagaatttaattacctgaccatacttaatggtcaaggaagcagggaaatacagatttctagctgggcagcaatgtgcctgggtgaaaatcaggatttctttgctaaaggagaagcaaagagtgggttttggaaggcagctagtagttgatgctgtagactggtcctctggcagatatactcatgaatactcttctgcccctgtgtagacctaggcatttcccatccagttagtgcatctcactcaaagtccagaatctctaggtgatgtgctcgatcatgtctgcatgtgcctcctcatggtctggtaatttgcaaaccaaaaaatgttatctacatttacatgcaatataattgctggcataggagcaaaataagcagacacacagaaaaactcacattagaaaagcagggaaaggctgggtgtggtggctcatgcctctaaccccaacattttgggattactcagatcactggagcccaggaattcaagaccagcttgggcaacatagtgaagcctcatctctacaaaaaataaaaaataaaattttttttaattagccaggtgtggtggtgtgtgcctgtagtcccagctacttgggaaactgatggtgggagggtcatttaagcccaggaggcagaggttgcagtgagccaagattgcaccactgcactccagcctgggtgacaaagatcctgtctcaaaaaaaaaaaaaaaaagaaaagaaaaaggaagagagaaatattgcaggtattggtccatagcaatgatcaaatcctgctggaaaagaaaagaaaaaggaagagagaaatattgcaggtattggtccacagccatgatcaaatcctgctggaaaagaaaagaaaaaggaagagagaaatattgcaggtattggcccgtagcaatgatcaaatcctgctggaaaagaaaagaaaaaggaagagagaaatattgcaggtattggtccatagcaatgatcaaatcctgctggataggaatggcaaagactccctttgggggcagagaaggtcattccttgattgagctgctgccttgaaggatctctcttgtccattgcccccatggcctctggctttgccctctcaggggtttttccttgtcagttttcctctatggctatatctgagccctgggcattggagataggatcatcttgaagctgcatggtttccaccgccaacttcttgcttgtgcaggtgcaggttcccaggaattcttttcagagttgtctaatcacagtttttgcaggccaagcttgaggtttctgtccaaacataggaagcttccatccaatctctttgcttccagtcaattccaagtgtgggttactacagcctaacactgcgtccagaaacacttctcacgccccaaggctctgatcttttatttagagctctttatgctctggccatcctttccctctccaattggcctggctgccttgagaccatttgaaagaagaaagaagttgggtgagatgggaacacgcttaatctaatctttgtgtctgggcttgtttccattgtctggcaaggaacctaggaagatgctcggaaagtgcctggggccacagccttatctcctgccaaggctggatgggcttgcactcactggaagcagtatttttcatcctacaagactcccagttacaggactcatagctgagtttagattacaggcagagtctaatctttacaaagctatgtttccttccatctctgttggcaggcaggatagctccagatgagtttatatctttatcacagctcttagctaaaagctgcaagatgcaatcaatacaaaccaaaattttacacttcttaccccttcccccagccacatcttcagtttgcatgttgcttgctttatattattcaggaaatggcaattttgagcaaatgttttgctacagcataacaagggtcactaattttccaactgatgatatctgctcaccactgctccatgtctgatcttctccactaagccaatgacacaattggattttattatatatatcatccaactcatgggtgttgaattttatattgattaggataaggtttagttgcataaaacaggaaaatgcaaaataatatgtctaaacataatacaaggtggtaaccccacagatgtggcttgtcagatgtgtagtatgataagaaacacaatttgcttattaattataacagttcctagtaataacttgtacctgagagtatatgacttagataaaatacctacaggtgagtgtgataacagctccttttcctatgtagcttgtgagacttttctcaagttggaacaggatttaagatgtagtttctcataaggagggatccaaagattttatgataatgtcgactaattcctgacccagaagtctgcagaggctggtgaaggaggggtggggagctgaatcactactgagcaggacgaaggtcagatgggagttgggaaggagagtgtcgagggaagccatcagtggggcccaccagtccagaatctgactataaaattgctaaatagctcaggcgcgaagtctcacactgcaatcccagcactctgggaggctgaggtgggaggactgcttgaggccaggaatttaaggccagcctagtcagcttagtaaaaccctgtccctacaaaaaattttaaaaatagccagacgtgtggtgctgcatgcctgtagtcccagctactcaggaggctgaggcaggaggattgcttgagcccaggagttcaaggctgcagtgagctatgattgaacccactgcacttcagcctggacaacagagcaagaccctgtctcaaaaaaaaaaattgccaaattatgagacaaagagaaagagagtgcatgttgaaatcaaggaaaagtccagagtcctactaccactgattactttaagaaccaacatttcttgtcactgtgtgccaggcagtgtactaaattctttacatacctttactaatctctaaaaaccttatgaggtagatactactatgatcttcattttacagataaggaaactacggcttaaagaggttaatttttccaaagtcatagcaaatagcagagccaagacttgaactcaggtctctcagagagcaacgctaatctcttaacctctatggtaaattgtttgtaaagtagatttgagcttttttttttcttcaaagaaatgactctcaactgtgtcaactattcagcactagccaatcattcatcacctatgtaatcagtctggtttatgaggaaagatatctcagacatacatttcttttctttttagagacaggcccctggctctgttgcccaggttggagtgcagtggcatgattatagctcactgcagcctcagtctcaaactcctaggctcaagcaatcctcctgcctcagcctcccgagtagctagtactacaggcaggtgccactatacccgactaattttatttattgtagacgaggtctcactatgtggctcaggctggtcttgaattactggcttcaagtgatcctccaggctcagcctcccaaagtgctggcatgacaggcctgagccacctcgcctggcctaccccagccatactttactaatttgtattattaagccacatgtcatggactctatgaacaaaaagggggaaagaaagaggttggcatttaggaaaatgagaaaatagaccaagtatgatttgaagaccttttattcctctctcagaaaaccccctctttccctccctcctttctttcatcaaacacttagtgttggccgggctcggtagctcacgcctgtaatctcagcactttgggaggctgaggtgggcagaaaagatcacttgaggtcaggaattcgagaccagcctggccaacatagtgaaaccccatctctattaaaaataaaaattaaaaaaaaaaagttaaataacactgagtgtccactctggtcaggtaaaacactgaggagtagaagtgtcaccagggtcaaagcccagctctgcacttgcagaacagggcgtccagtgctgtcagttaagctcaggtgttgtgtctgcaacgagaggcagctggtctcatggggaagtgagggtagaaatccttttgatgaggcccaagctgaggcctgggaggataaatagaagcttgccaagtgtgggcagactggaaggcaatcccagtagtggaggcaacagtgcacaagcccagagcaggagaaagcatgtgttcagggaagtgttgatgataaccagaatgtgggagccatgggtaggggtgtgacaggaatcagcctgaagatgcctggcatgctacactcaccagcatggacttcatcctagcgagataaatgttagatacaaacgggacatccaatgcatgctttagaaggttcattctagctggctgggcgcggtggctcacccctgtaatcccagcactttgggaggctgaggcaggtggatcgcgaggtcaggagttctagaccggcctgaccaacatggtgaaaccccatctctactgaaagtacaaaaacgagccaggcgtggtggcacacacctgtaatcccagctactcaggtggctgagacaggagaatcacttgaacccgggaggcggaggttgcaatgaaccaagattgccccattgcacttcagcctgggtgacagagcagactctctcaaaaaaaaaaaaaaaaaaagtttagtctagctgcagggtagagaatggtttgaaagatgacttcaatgaaggaaatcaatgagtctatcaaggtaatgcagtgatgaaatggtgagacccagacctagggcacaacaacaggaatggatagtaatgaagagaccggaatgctgctgaggaggtggagagaccagagcttgatgcgtgcttaagcctggtggctgagagaggaggcggggtcaggcccaatgtccaggtacccagctcggacaattaggctgatgagtgggtccaaaaacacagggaagagagaagcaggtttggaaacaggttcaaatcaaatagagctcacaggagtccagagttcacaggacagatctggcctggagaagaagctgtggggtcgctggcatagactaatgggagccaggggaaggatgagattttcccagaagaggactgttggcctcctgccctgcaccccacatagcacacactggccaggtcttctcgctgtgccggcccctcaccccatctactcttgggggtcctgctccatgctgcgttaccccaatccccatcctaaattagttctgtgtccctttctctcagggtctttcctagctactctggtgaatgatttaatgttaaaaattcataggcattggtcaggcacagtggctcacgcctgtaatcccagcactttgggaggtcgaggcgggccgatcatgaggtcaagagttcaagaccagcctggccaacatggtgaaaccctgtctctattgaaaatccaaaaattagccaagagtggtggcgggcacctgtaatcccagctactcatgagattgaggcaggagaattgcttgcacctgggaggcagaggttgcagtgagcagagattgtgccactgcactccagcctgggcgacacagcatgacttcatctcaaaaaaaaaaaaaaaaatcatgggcattaatgcattattacccaaaacatttctgaattttaatcaaagagaatcaataggatttgaatccatagaagagctcagagcatttcctttcttttatttatttatgtatttgtgataggtggttattactgaggtgacctggccctcatgtcccactcctgccactagaaatctcatttccccaactgtgcgttttccaaaagttgaatatttcctttgcttttcgtgcacagatataaattgcttcccaggtcctgatcctttttaccttagagagcctgtaccagcacttagtgcatttattcatctttgtaatggacaactgcgattgtggctgttttagcacaggacacagacaaaagggaactagaactgtttctcaccagtgcaaggcccttgagtcagaaacacctggcagtgagtggcaaagaagaaacaactgtgaagttaaatgccaataccccagggaagctttcccacaggaatcattagggacttcttcaccatgttcccatggcagtatgtcatttatcatactgcactgcaattcttttgttttcaagtcagtctttccttctacattgtaagttccaaggagagaaatgtcgtaccttctccatctttgtactgcctgtccctgtgccttaacacaatgctgctgtagatagcaggtgtttaataaatatctattgggtgaatgagtctgcagagatatatgtcattcacagagcatgtcagggagcttctcgacacaccaagtcacactgggaggttttccagggaatataagattccttttgctatgttgacctcttgcttcttgacctttgcatgtgctgtgcccgtgatttcaagtacatctctcttcatccctaattaggtaacagctacttagtcttcttaaaattaataaatatcaaggctgagcacagtggctcatgcagttggggaggccaaagctggaagactgcttgaggccaggagtttaacaccagcctgggaaacacagcatttttttccaggtgaaaaacatcatttttcacctggaaaaaaacataaaggatacatactaataacacaggctatatggcaaatgtctaactggtggagcttgagaaagagaattctgagggaagaaaaacagaaactgatagcaagacttggaataggagcaaaacaggagtatgatggcattgggagattccagggaagttcgggaagccaagaggatgaatggacacgggggtaggggtaggagcgtgggaggtatggggaccaggataggaagacatacatggttggatggagagactgatggcaaagacacacacacacacacacacacacaaacaaattttagtaaaaaaaaatataaagaaaagaaatcttggcaaactgtaaaactaaagatggaagaaggagaggtaaaaagggaaaatgtgcaaaaagccaagaagtatcttagcttataattattcatctctaaaggcttctatgaaattattccttctgctattcaaagctttcctaaaattctgctcttcctagaagtctttaacagcagagaagtaaacatcttacctcctataatagaacagtgagactggaagggatcttagcaatcaccaagctccttcgtttcacacagaggatggaagtgactcccctgtagacacactgttagatcgccttggagcctgagccaaagtcacagtctgtgtatttctagaatagtgtttattccaacaggtaatttttttctactccattttcccaaacaaatgaccttctcaaaaactggggggaaaaagtctgttttttaaagtaagtcaataaacatttcattgtgaaggactaagcaataggcctgggaggcaagagctggtttttgtactcacagcacctagcccagagcctggcacaaaagtagttttcgatagggttttgttggatggatggatggatggatggatagatggatggatggatggatggatggatggatggctggatatgagatagatggatggatggatgaatggatatgtgatggatagatggatggatgaatgaatgtatgatggatggatggatgaatggatatgagatggatggatggatggatatgtgatggatggatggatgaatggatggatgaatgaatggaaggatagatggataaatgtgttctatttagggctgccaccactattcagatagttattgaatagactgtttcaatgttttctgactttaagaggtatttgatctaacttgcttctgcatatgggccaatgatcccaggttgttttaaagaattcttggtaaatgatctaattaataaatgagatgttttcaaataagttataatctcatcggaaacctaagacatggatgtaagcagaaatgattagcaatacaggaaaacaatgtgttaaacgccaggtgactattcttgcagataagctgtaagtagagtgatataacttattttctaaagtgggtccccttcgagagtgaaagagggccttattaatacaccaacacaataggaaaaaacagggctatatggtccaagtagggggttcagatgagagggcagatttcccatgtactgaggaggcttcttgaactttgcttgtgctgtgccataatttggagcacgtctctcttcattcctaattaggtaacagctacttagtcttaaaattaataactgtaaaggccaggcatggtggctcacccctgtaatctcagcactttgggaggctgaggctggaagactgcttgaggccaggagtttaagacaagtctgggcaacagagcaagactctgtccttgcaaaaaaaagtttttatttaatttaatttattattattattattttgagacggagtcttgctctgttgcccaggctggagagcaatggcacgatcttggctcactgcaacctccacctcccgggttcaagagattctcctgcctcagcctcccatgtagctgggactacaggtgtgcaccaccatgcccggctaatttttgtatttttaaaagagacggggtttcaccatgttggccagctggtctcaaactcctgacctcaactgacccacctgcctcagcctcccaaagtgctgggattataggcgtgagccaccatgcccggccaaaaaaatttttttaattagctgggaatggtggcacatgtaggtagtctcagctactcaggaggctggggccagaggactgctggagcctaggagttcaagtctgcagtaagctgtgatcgtgccactgcacaacgacaacaatcaaattaatatatgtgatgtattaaaaataagtttgaaaagtgtgtatgaatgacaaaagctagaaaaaaaattaaagattctgtacatactgtaagtatatagacaggagtttgttatctcatttaaaaaaaaatcacgcgtgtctttctagagttttaaatttcagatatttggctttgagcaaaatactcttttcttttttcttttctttttttttttttttaagatggagtcttgctctgtcacctaggctggagtgcagtggcacgatctcggctcactgcaagctctgcctcctgggttcacgccattctcctgcctcagcctcccgagtagctgggactacaggcacccgccaccacgcccggctaattttttgtatattttttagtagagacagggtttcaccatgttagccaggatggtctcgatctcctgacctcgtgatccgcccgcctcggcctcccaaagtgctgggattacaggcgtgagccactgcgcctggccaaaatactctttttaatggtttaatgagagtagcctagagtttatttttaaatggtagaaatgttgctaagaatagggtaggtttatatacttgctatacaaactgtggtccctggagtcgcagcatcagcaacacttgggaatccgttagaaatgcagattttcaggcctcacccagacctatggagtcaaaatctgccttttattgaggtgcccaagtgatttgcaagcacattaaagttcaagaagcattggtctatacaaccttcagtctttcaaaagtgtgaaatttatttaagcatttaagtatacctttcctactttgctcttcttctcctttgtaaaatgtattgacagtatgcttccttttgcttttaagccatttaagtgtctagaactttaatgataataatgaagagggctgttgtttacaaagaaaacagtaagaataggatgaacaccctagattcccataatacatcccccattcaggggtagcgatggacgaagactcaaattcacatgataagctgctccattttggcatgaaccagtttttaactctagccagtcaatttcgtttttaaaacttctcccaggagaagaaaaaaagtgatagaagaagaaaccatacttagaaatgcaaactattcaaggaaatcttgactttcagtccttgtaaatactgaacaaaaggctttatctttcacaagttgaagaaatattaacatgctatgggggtgtctttcctgcgactgttttgctggctctgggcccggcatgaatttggtagtactgggcaaggccacagctgcatgccggcctgcattgcatctctatttttgcaggcattaaatagcttctcccatctccaacatgtgttgctgcacatgtgacccaatgaatcaatcccctgtacaatgaagcaacaataatgggtctggggcaattagcacagggacagcaggtcttcctagcagactcttgcccacgttaatattcgcagcatatcctgggtgggtgctcctgagaattctgctaatgccccattaccatcctcagggctggtaattgcaagggtagagatctgttgcagcttctgggcagccgttcccttccttcccaagatgaatgttgtgaagggcaatgagggggttgtgagtgcctccaaataaaggtcttttatagctctttaaagctgtaagtcattcagtcatagtttctttcacctgctggcttgacaactttaaaaatttacatttctgaacttgtactttaacaggctttcatcataacttcgggaaagaagaattagaatggggaagatttaggtgcacagatggggtcgaaatcaggataatattgactaagcaccctcctggggctctcctaacacaaacgattaccctgcctcctaggattttatagttcaaatagaataggtgagcactaaaacaatcaaatctgttatcctgaaaggccaaattggcaaagtggttcctagtgaaaatcatggaatattagccctcaaagatattttaaagcccacccctccttttttggtaattgtctgtgaaatgaggatcttacagaccctgcctcatcacatggcggcgaggaccaaattagacaccctgggagcttgcaatggaaaagtctttcatgtctgcaaaggaaaataatgtgtgtgtgtgtgtgtgtgtttgtagataggtaggtaggtaggtatgtaggtaggtaggtatgtaggtaggtagatagatagatagatttttttttttaagacagcatctcactctgtcacccaggctgcagtgcagcagtgtgatcttggctcaccgcagcctcaacctcctgggctcaagcaatcctcccaccttagcctcctgagtagctgggaccacaggtgtgcaccaccatgcccggctaatccttctggtagagacggggttttgccatgtagctcgggctggactcgaactcctgagctcaagcaatctgcccgcctctgcctccaaaagtgggggatggaaagcatgagccacggtgcctggcctaatatgtgtatttttaatgatctttattgttttaagctgaaaaaatagactcaaaggagtcaagtggtaacaagacaagagctcccttagaggtgctcacccacctgcatgctaaactgtatgaggtagctttcctcttgggctgtcagtgctaaagatgtgtaataatgcagaatacctgtactctggactctcactagagaatacagctttgaactccctgctgttcaatcccttagcaaaatactgatttttgagaaataatgtttgtgaagaatcgcctgaaggttatgcaaattctccactctgctggatatcctaaaatttacctatggatcaaacctgattgtcagggcactgtgtatttggatcccaggtatttgcctcctggtagtagtaacttgactgaactgtgcttacatgaaggggtgtgctatcagacccaactgtaagaaatgcattattatattcaacacaaggattttatggagaacctgatctgatggattgctagattcctctttatgaggactcacagtgataaatttccttggggctgcagcttcaggagaaacctggcttctactaaacaactttttaatcttatgattaaagtatcagcctcttccctctttgctctggccactaggaaacttggggccaaatttgtttatcaaatggattccattgctctgtaacaatcttggttttaatgttcttaccccctttttccctttggcaatttgttttatctatgtagttgcctaccttttgtaaatcgacttgtttttaaaaattaattatccctagctacttgggaggctgaggtgggaggatcatttgagcccaggagtttgaagctgcagtgagctatgactgcaccactgcacactacagtctgggcaatagagcgagaccctgtctcttaagaaaaaaaaatcaattttgattacttcataaatttcagttgaattgagtctctgacatcattttccagtgaagccttgaatcagtctttaagcaaactattttcatcagctggaccttggagatgacactcaactatgatttttcagaggcatgtgttaagtcatgaatgcaaaccaatcacattttcaagtctctgaagttggccgattttcatttcagaagacatatttagctttgtaagatctcttaaatttataaacagacattgaagggtaaataggcacttgatctttgatacatagttcttggactcaccaacaagcaaaacaataatatctcagtccgttgagctgtatcatttgggttttgtgacaatttggacaaagagtggttgaagtttactctttgctctctgagtatattaaacaaaagagtttaaattgtaagaaggaatatctgaatattaaagagctatttcccaacagcttttattcctatttgcatattaaaatgccattagattatctttataatctagcactgctctgattggtactttaatatgcctattacagacccttcctatttgttaaattaatatttgattactataatttcgaaggaaatccattcttgaatgtcataaatatgtactcttgaatcatatcctataaattaaaatatttactaatatgtgtggtcttgaaaatcattccaaattcctgaaatcactctgaaatgtaagtaatacatggtatgtgcctttttgaaatatttggaaatgtgtctgcttacttcttttttgaaatgacccctttcttgaattctggaatattgcatcctctttcttttagttctctctctgattaagcctttgtcctgtttgttgttgttgttgttgttttttgttttttgttttgttttgttttgtttttgagacagaatttccctcttgtcacctaggctggagtgcaatggcacaatcttggctcactgcaacctctgtctcccaggttcaagctattcttctgcctcagcctcccaaagtagctgggattacaggtgcccgccaccatgcccacctaatttttttttttttttgtatttttagttgagacggggtttccccctgttggccaggctggtcttgaactcctgacctcaggtgatccacctgcctcggcctcccaaagtgctgggattacaggcgtgagccaccacgcccgaccacctttgccttgttaaacatttcttcctcttcacacccctaattgtgtgattccccaaattcagcatttcttccttcatgctgacctaggataactaaaccttcttaaagtatcaactatcattcttaacagatgactctgggacctgaatatcacttgagttccaacttcttagattacccactggatacttctactgtcacctcaaattcattgtgtcaactattaatcattactgttcatttcatgttagtggcatcaaaagacttagcaataacaagaaaacttttatcaattatatactacatactacaacggctgctttaaaaacaaatctcacttaatcctctgaaccatcttataggtgagttttaccaccttcactttacctattaggaaattggaaataagagaggtaaagaaagtatacttgtctcacagcaagtatactgcaaaacttgaactcaagtgtcatgttaagtggtctcccaaaaattatatctaaaattaaattatttttattttctctgtaacaaactttcttcttgtatgcctatttttgcctatggtaccgtaattctccttcatatggaaacttgaaattgtgaaggtttttccctcctccttattatttctcctgtcaaatccatctgtaagtcctgtaatattgcctcgtcctgattttcctttcttccttcctctagttcacacacttacccattaaggtctccaataaatctctgccctctctttctgcttttagctccttgcacattctcctcccctgaatggccactgaacaacctttcagaaggcagcagttgccctgtcctctagttgaccagaagccttcagctgatacaatgtcttaaggtcctttccctgacagtctaagctttccacatttcgactccaacctacttttccaatagctgataaaattcactccactcttttgctctcttcacactgcttggaataggcattttactttctgccttctaaactttgctcactcagccttgcctctcaaaataaatatcctcccacctctttcccttaaaatgtccaactcaagtctctgagttggctctgtggtttttactttcctctaaagtttacctactgtatttattatttgtgttactcattcagcagaagcatatgttgccctgtgtagtaattgtagtaattaaaattatcgtgtgtatgtgtgtgtgtgtgtgtgtgtgtgtgtgtgtgtgtatcttgcctccttggtcagattttaaaattcctagagggcaaaatgaattacaaccatcttctacatctctcagatgtttgaaatgagtttacatgtaaatcattctacaaacaatatagtattcaaagaaagcaaattactttgatagaggcaacagggtataataaaaagaacatgggttttgaaattaagaatatatgaattccaatccaatcagctgtgtgaattcagtcaagttcaaattttttaataatatgggttacttttgtcaccttatagcttattgtgatgttcatagcttattacaagagaatttaggccaatccctgccatccatgtatactgaaaagcaaaactattgtggttatttgatgactgaagggtatcactgtcttttcaagtcttgtgtgagcataagtgattggtatgagtcaccattgtacctataactgattgacatgaataaatatacagaatataaactccaactattttttaaaagtttgttggatatttctgtatttagaaatataactttagtgttgaaatagttgtcatctaaaccaatgatgcccaaacacaggtctgcaagaaaatgagaaaaacattattataatgagttttttggttaaactaagtaatgcaattgttaggattattctgtattttgcaattatgactctcctactttttgtgtgggttaacatttctttgctttataaaacaatggtcatgatacatggtagaggacagtagctgtggtttttgttatttctatcatggcttttcttaacaaaaccaagttagcaaactgatgttcatttccacaatagctttgaaaatgtcacagatccatattacctcaaatgcttggaaaccataatctagcccaagctctttgttttagagttgagaattatttgacttacagaagttaaattatttgtccgagatcatgtaacttactactgcagacccaatatgagaattcaactctattaactctcaatgcagaatatgcctcattatttaagtgaaaaactgtcttttctacaaatgaaaagaaaactctatttttcgtataacttttgaagaaaaggcattgtgtaaattttatttgctaaaaataattttattaagccaggtgtggtagttcatgcctgtaatcccagcactgtgggaggccgaggcaggaggattacttgagcctaggagttgtagaccagcctgggcaacatagtgaaacatcatgtcaaataaaaataagtaaataaacttattaaaatcctcccaaaagatggctttatcactaaatgaaagaaactggatgataaactatacatctgtaaaaattttttaaaaacaagtttcctaatttgttaatttcatttttttctacttattttcaaacaaaattaacttttattaaaaatatctttgtggcctggtgcagtggctcacacttgtaatcccagcactttgggaggctgaggcaggtggatcatttgaggtcaggagttcgagaccagcctggccaatatggtgaaatcctgtctctactaaaaatacaaaaatagcaggatgtggtggctcatgcctgtagtcccagttaattgggaggctgaagtaggagaatcacttgaacccaggaggcagaggttgcagtgagctaagattacgccactgcactccagcgtgggtgacagaacaagactcatgtcttgaaaataaataaatatatatatatatatatatctctttgtggccagcacggtggctcacatctgtaatcccagcactttgggaggcagagacgggtggatcacttgaggtcaggaattcgagaccagcctggccaaagtgacaaaacccatctctactaaaaatacaaaagaaattagctgagagtggtgacaaacacctgtaaacccagctacttgggaggctgaggcacgagaatcgcttgaacccgtgaggcagaggttgccgtgagccgagatcatgccactgcactccagtctgggcaacagagagagactctgtctcaaaaaaacactttgtgtacctgaagattctggaaaatataagaggaaggaataaaaaccctataattctagagaaaagtcacaattgacactttaacatagttcctgctacatatttttcgatgtatatttttgtacggttgaaactatactacatatttcctgattcttcattttacgtatttattttaatttctttaaaatatgtaatatatttacatattttaaagcttggaaagaataaacagacatagagtgaagaggctctttctgatctttctacctcaatcacccagttttctttttctttttttttttttttttgagatggagtctcgttctgtctcccaggctggagtgcagtggcacgatctcggctcactgcaaactctgcctccccgggttcacgccattctcctgcctcagcctcccgagtagctgggactgcaggtgcctgccaccacacctggctaatttttttgtatttttagtagagatggggtttcaccgtgttacccaggatggtctcgatctcctgaccttgtgatccacgcgcctcagcctcccaaagtgctaggattacaggcgtgagccaccgcgcccggccaatcacacagttttcttcctaaccaaaattaatacagttgttaaaagttttcatatgtgtatctttccaaagagactttgtgcattttattcagattctttaccttaatattaaaacagattcactttccatcttatttaaaatcatataaaatgtcaattttaaggcccacataatattttactatacagatataccataatttgcttagtcctgattatctatcagacattaaaattgtttccaacttttgagttttagcaactttgtagatcctagtgcttaaattaaaagagcccattgatcttctcattttagaaattgtaggacttggtgggtgcagtggctcacacctgtaattccatcactctgggaggccgaggtgggtggatcacctgaggtcaggagttcaagacccgcctggccatggtgaatcctcgtctctacttaaaatgcaaaaattagccgggcgtgggggtgtgtgcctgtaatcccagctactcaggaggctgaggcaggagaatcgcttgaacccaggaggtggaggttgcagtgagccgagatcacgccattgcactccagcctgggcaacaagagagaaactccatctcaaaaaaaaaaaaaaaaaaaaaaaaaaaaaaaaaaaaaaaaaaaaaagaagaagaaagaaaagaaaagaaagaaagaaaaaagaaaaacaaaagaaattataggacttttacagtaattttccttgaagagattagtttcattttacccctattctcaaaagcaagtctgttgtttttttctgctaaggctagtccatcaacctggggttgaaacaatcctttatctccatgaactgacctcagtgagttacagccacatcctcttatactttggaaagaacatccctcagctcagtgttccataaatatttatagcaggaatgccccagtccaaagtggatggcattttgacctcatcattgttgctgactccctgtatcctgggagcttagagggtcgaagcactgttgtttaagacaccctttggagctcccccttgaaagcaaagagtagttatgcattcaaacatacccaaggaatagcacagcaatacaaaaaaaaaaaaaaaatgatgacccaagtagaaagtatgcccaagaataaataaatgttgatgctgctttcagaggactgtgagagttgatgggctttgtgctgaatgctaaagacactggttcatcatggattggtcagaaaagagtttgcctcatttagaggaatattcgtggagttggtgatgaatagagaaaggtgaggaaggcttcccgaagcagaggagaagccatgaatttgttgcctagaaaaaggtctatgtgaaatagagctcttcagagtgagaaatctggacctacgctatgaggaaattggcataaaaggaccaagaggaagcctgacaagaaaggaaaatacttggttaaaacaattgcagtagaaagggagaaatctgggcttaatatagatagaactgtcaaagataagagtaactgccagaaaaccaacaaacaaaactagataaatcagtgagccttctgggatttttttttttttctgggattctctctcaaccaacccaactcccagccgcatcccaacccccgtagataaagtctattgtccttgtcctattccttgtagtggaaatttagcatgttctcaatttgatgcaaagtgttacgtaactccaggatccagcccactcttctgactatatttccaactatgttataatattactctaagactctcttttatagaaatgttcaaagtaactgtggcaaaattgtttttgctcccaactattgtacacacttcataaaaactatttctacaacctgagagccagttgagataagctcttggcggcagataaagaccaagattgagcactctccagttacatatgtgttaaacagatctttaaacatatcctttcaaagctgtatctcgagggataatttaatataggaatataaggtaccatgagagggtcaatcacagaaatatttttggtgagagtgactttccccatgatttttttttccccagactgagtcttgctctgtcacccaggctggagtgcaatggcacaatctcggctcgctgcaaactccacctcccgggttcaatctattctcctgcctcagcctcctgagtagctgagattacaggcgtccgccaccacgcccggctaatttttctatttttaatagagacagggtttcaccatgttggccaggctggtcttgaactcttgaccttgtgatctgcctgcctcagcctcccaaagtgctgggattacaggcatgagccaccacgcccggcccactttccccagaattgttaaaggtgactacttatgtggtagtattcaaatacccaaagaccacctactctaattagcaaaataagctgtatttgtattggtcccattctttcattattctcaacctgtttcctctctgtaagatggaaataatatctgttttatagaattgtcataaaggttaaatcagatttccagtaatggcagactaaataagtgtgattgagcttcctgctaaggacaactaagaaagctgggggaaaagcattttaagaatctgattcaaagcagtagagaactaataagatgtttaaaaacactgagctagggtggggaagcttggaagcccatggaggtgagcccggagtttctgtatgtttttcccctgtgagcaagaccagaaggcggagagaacaacatgctgagttatgattttgaaagccacaaagatctaaggtgacagggattggtgctcagtttccatcaagggatgggagtcctggtggatgaactcttctcacactggattaaaactctgaaggaccttaaggaaaagagtaattcagaagtaagcacccctagagactacagcttagcttttaattctttcaagccatgaaattgattttaggtgacattttagtgtttgagcacttaggcagctggcaggaacaaacatatcctctctggagaaatataacatcatctcagacctcaaatatatttctacattttgtagatccaatatctggcacataataaaaaataatcagacacacaaggagtaaaataacatgaactaatatcaatagatacagcagacaatagaaacagacctacagaggctacaggtgttagagtttgcacactgacttcaaactaatgatcttattcaggtcaaagagattaaaaaaaaatccaacaagattaagaatttcaaccaagaacaacaacaacaaaaactcaataacaaatcaaaaggatattccagattaaagggtaccaaaaaaaaaaaaaaaaaaaaaaaaggtttaagagcagatgagacacaattaaagcaagaatttgtaaaccaaaagatagatcaggagaaagtacccagaatgtagtagaaaaacaaaataatagaaaaatcagaaatgataatacaacgcataggactgtagtgaaaagctgtaacatacgttcattggaaactcagaagggaagaagagactgaggtagcagcaataataagagataatggctgacaaaattttgcaagctggtaaaataattcaaagactctataaatcctaggaaacccaaccaggataaatacacaaacgaatacctaaacacatcatagtaaaactgctgaaaacccaagacaaagagaaaatggtaaaaatagcaagagaagaaagatagattaccttcaaaggagcaaaaatatagcagatttctcaatggaaacaattgaaagtaggagactataaaatatactaaaagcactgagcaaaagtaagaaaattgccactgaaattctataccagctgatatagccttccataaaaaggtaaaataaataactttttagacaaactaaagcaaatattagatgtttttatagcagaaggaaaatatccagccttggagatacagtaaaaacaaaacaaaacaaaaaaaccaaaggacaaaataatgagttaaatatgtaggtgactctaaataaatattgattgcataagccaataattataataatttttagcaattaaaatgaagaattaaaacacaaagcaacaataaggatggaatatagaattagtggtgttggaacatgggtcagtaggacatggaataaatggtgtaaagtgttctaagtttcttgtccaggaaaaaaataaaagtattggtattacatttagttaagaaaaagacacacttaatatttagggttattactgtatatattttaaaggaatatatggctttccaggtaataaggagaaaaataatagaataatttttttgtagggccaggcgcggtggcttacatctgtagtcccagcactttgggaggccaacatgggcggatcacttgagatcaggaactcaagaccagccctgtcaacatagtgaaacctcatctctactaaaaatacaaaaattagctgggcatggtggcgtgtgcctatagttccagctactcaggaggctgaagcaggagaatcacttgaacccgggaggcagaggttgcagtgagccgagatcatgccactgcactctagcctgggcaacagagtgagactccatcccccaaccccaaaaaagaaaaatttgttgtaaagttctcaatcagtctggaacaaatcaatgaaggaaagaaaaagaaacagaacaagtaggaaaaatagaacatattgaataatacctagaattatacgtagaatcaaaattacacataccagtaattactttaaatgtaaatggactaaatatcccaattaaaagacaaagattatcaaactggattaaaaaataaaagtgttaattgtaagagacatgtaaaacttaagaatccagaaagtttaaaaaacacatttggagaaagatttagctatcatacaaacacaaaagaaatttggttgtaggttttttttcattttttgttttttgtttttgagatggagtcttgctctgttgcccaggctggagtgcaatggcatgatctcggctcactgcagcctctgccttccaggttcaaaagattctcctgcctcagcctcctgagtagctgggattacaggcgcacacccccacgcctggctaatttttgcatttttagtagaggtggggtgtcaccatggtggtcaggctggtctcaagctcctgacctcatgatctgtccacctcagcctcccaaagtgctgggattacaggcgtgagccactgcacccagtcagttgtaggtatcttaatatcaaagtagacaatgtaaaaagcattattggtgtctttataatgacaaaatgcttccttcaccagatagattataacaattttaaacttgtatgtacctagaaacatagtttaaaaatatgcaaagcaaaaactacacagaaaggcttagacaaattcatagtcatgttgggatattttaatgcacctgtcccagtaactaatagaatatttgaacaacataaacagtaaaatacagcaaaattaaacacacacacatatatataatagagagaaaacactgcataacaactaaaaaatacatagtcttttgaagtaccacataaaatatgtataaaacttaagcaattttgtgacataagtgttaacaaattttaaaggattgaaattctacagattatattctttcactacaatgttattaagccagaaattggctgggtgtggtggctcacgcctgtaatcccagcactttgggaggtcaaggtgggtggattaactgaggtcaggggtttgaaaccagcctggccaatgtgacgaaacccatctctactaaagtacagaaaatcagccaggcatggtggtgggcacttgtaatcccagctacttagggaggctgaggcatgagaatcacttgaacccgggaggcagaggttgcagtaagctgagatcgcaccactgtactccagccttggtgacagagggagacttcgtctcaaaaaaaaaaagacaaataaaaataactagaaaatccttattttttgaaattttaaaatatctttctaataacatgtggctcaaagaagaaaccacaatggaaattataacatattttcaactaaataataataaaaatacaaactattaagacttgtgggatgcaggggaatttataggttttaattcatacatttgaaaagaagactgaagatcaatgaacaaagtcatcttttttgtttcccgtttttttttttttgatacagagtcttgctctgtcgcgcaggctggagtgcagtggcacaatctcagctctctgcaacctctgccttccaggttcaagtgattctcttgcctcggcctcccatgtagctgggactacaagtgcatgccaccacacccggctaatttttgtatttttagcacagatggggttttgccatgttggccaggctggtctcgaactcctgacctcgggtgatccacccaccttggcctcccaaagtgctgggattacaggcatgagccaccatgcctgttgaacaaagtcatcttaagaaattagaaaatgaataacaaataaaacaaaggaaataataatgatagaagtgtaattaaatagagtagacataccatacaaagaaccaaaaaagctcaaaattggtattttcagaagactaataaattaatatacccatggcaggactgataaagaacaaggagagaaatgatacgtattttcaataattaaaatgggaatattattagagatcctacaaatactaaaattttatgaacaattttatgttattaactttgaaaatttagatgaaatggacaaattgacacagaaagaaatagaaatcctgaatattccttttttgtttgtttgttttttccttttgagatggagtttcactcttgttgcccaggctggagtgcaatggcatgatcttggctcactgcaacctccacctcctgggttcaagtgattctcctgcctcagcctcctgagtagctgggattacaggcatgtgccaccatgcctggctaattttttgtatttttagtagagacagggtttcaccatgttagccaggatggtctcgatctcccgacctcaggtgatccacctgcctcagcctcccaaagttctgggattacaggtgtgagccatggcgcccggccctgaatatttctttattaaagaatttgaatctataatttaaagtcttccagtaagaatgctccagacccaggtggctttataagcaaatgcatacaggtatcaaaagaagaaataatggcattcatacacaaactaaaaattggaaaagaggaagtacatgacaacttattttatgagatctccataaccttgatattaaaatctgacaagaggccgggcacagtggctcacacctgtaatcctagcctttgggaggctgaggttggcagatcatttgagttcaggagctcgagaccagcctgggcaatctggtgaaaccctgttctccacaaaaaaaaagttggccgggcatggtggcgttcaccggtagtctcagctacttggggggagctgatgtgggaagatcacttgagcccagaaggttgaggctgcagtacacaagatcttaccactgtactccagcctgggtgacaaagtgagaccctgtctaaaaaaaaaattaacaagaaagaaaaatttcaggtgaatcttcctcatgaacatagattcaaaatcctaaacatattattagcacaccaaatttagccatttatgaaaaggataatgcataaaaactttatttggtttattccagaaaaagaaatttggcttaaaattaaaaataaatatgtcaatgcatttacaaaatgaaggaataaaatcatttgatcatttcagtagatgacaaaattcaatattcattcatgataaaaaaaaaaaaagtttagaaaactaggatggagactgggcgcagtggctcacacctgtaaccctagcacttcgggaggctgaggcaggtggatcacgagctcaggagtttgagaccagcctgcccaacatggtgaaaccccatcactaccagaaatacaaaaattacccaggcgtggtggcgtgcgcctataatcccagctacttgggaggctgaggcgggagaatcgtttgaacccaggaggtggaggttgcagtgagctgagattgtgccactgcactccagcctgggtgacagagtaagacaccctcgagaggagaggagaggcgagatgaggggaggggaggggaggggagcagagggaaactaggatggaaaggaactgccttaatctaattaaataggcctacaaaattccttcagcaaatatcatccctaatggtaaaagctttccctctgtaataaaaatcaagacctggtatccactttactcaatgtcatattggaggtcctaagtgcagtgtccctcactttataggcatgctgcatatgcagttggcatcagcgaagcaggtccaccaaaactttattttgaaatgatttgatatctaaacaaaatgtaaaaacatcaaatttaatgcaatattgcaataattccctaaccactctcctccaaccactttctcttcatagagccaaacttttaaaaaatataagtcagattattgatgaagagacccaggacctggtcatgagctaccagatttgcctgcctctccatcccatcttatgtctcccttcctgttgtctgcattctggcttcaccagcattttcagagtctcaaaggtgtcatgcaacttccacatctaggcctttggaaaaagccctttcctaagcctgggaccatttccaatgccctcttcacctaattcatcctttagattttagctcgctagttcagggacaacctaatcacaaatagggaatagcctcagtcacaataaacacatctaacacccagaacttgctttctaatatgatttttcaacaaagaggaaccaaggctccttggagaaatggttgattctaggactggagcagaaaatatacaagatgagcctgcagcatcttacaatgccagaaagtaaggaagtgatcaaaatatacaccgcctcatgatgagagtatgtcaaagatgcacagaagtcaactgaaagagctcccggtggccaaagctagagaatctgatcaaggaaataaataatgcattatggattataatccagggtataaaataatccatgagtctcaattgatataaaaaatgaataaattaataagtgggggagaagagagaaatctcctatgcagaagaattgtagatactttttgtagacactctgccctcgaggggaaacataatcctcatttcttaagtgtgggctgctcaaagtgactcccttccaaacactacagtatggaaagggacaggggctgggagtggagaacagtaagttttcagtgcagaaatctgacaagcactgtatttgctaggtgatcaaggtcaacatcagcagtgaagtcatgttgatcgtaggtatccttgatacaatgtgatgagaatggcattttacctctgtggtcttcctcccccaaacacaaaagcccagtcaaatcatatcatgagacaaatatcagacaaattccagttgaggacattctgcaaacgtttcacaaaatgtactcttcaaaactgtcaaggtcatcaaaaacaagaaaagcctaagaaactgccatagccaagagaagcgtaaggagacaggagaactattaatagaggtaatgcggcgtcacagatgggatcccggggcagaaaaaagaaaattaggtaaaaactagggaaatctgaataaagcgtgtattttagttaataatactgtatcaatattggttcactaattgtgccatgtatacctgactaaatgtaatggggaaaactgggtatgggaactctctactatatatgcaatttttctataaatctaaatctgttaaaatctaaatctgtatgaaaaacatcaacaactaaataacctctaaatagtgaatagaatatggtatccctcctacttctcataaattatttaaaagtctgccaagtattggtctgaatacggaaatcatattttgcttaagctggggagtgggtacataggccttgttgtatttttctttatgcctttttgcatatctagtatttcattttttaaaatgctaaatgtaaagcaattgcgtaaaagtcaaaatgttgatctctcgcatgatggctacttagttttaaaatatcaaattatttgaaaataatttttcaatgattctgctttgctggtacccaagcatgtccagtgtgcccacggggtgctgggcactgtctctggggaagcagcaaaccagactcatctctaggtggcctgggctcaacagcttcctgccattttctttgattggtagttaagacttttttgttgttgttttgtttttgtttttgttttttgagacggagtctcgctctgttgcccaggctggagtgcagtggcgcgatctcggctcactgcaagctccgcctccagggttcacgccattctcctgcctcagcctcccaagtagcggggactacaggcgaccgccaccacgcccggctaatttgtgtgtgtgtgtgtgtgtgtgtgtgtgtgtgtgtgtgtgtgtgtatttttagaagagatggggtttcaccatgttagccaggatatggtctcaatctcttgacctcgtgatccaccagccttggccttccaaagtgctgggattacaggcgtgagccatggcgccgggccaacattttttttttcctgacaacttaatgtctatctatcctaatagattgccagctacgtgagagcagggatgattgtatgtacattgagtagcaaggtgcctggcatacaataaatggtcaataagtatttattgagtgactataacttaatgattcaaaacttagaccctagtgttacctggacctgatgaagtttagcttccccacttactaggaatggggtcaataaaaatgcccactccaaaggcgctttgtggacgaatgtgcttacttattacggttctttgtaaatgttagctatgatttttattaggtgcttgctgaattaaatagcttaatatttgtaaagtgcttagaacagttcctggaacagggtaagtgcttcttgtttgtgtttatttattatttttttaatgttgctgttgaccaaattaaacttcacattcattttgtttagtctgttagggatattctttggaaaatcttctacattgtgtggaaagataaggcctaaaatgcatactattctgattcgttcaaaatatatcactctgggatatgtgtaattcagaaaggaacgtgatctgaacacttctgtagtagttatggagaagtaatgtgtactacaaaaaaggaatcattaaatcatttaagaaaattgctgtgcactacagcaatatcattcatagataattaacaatccacctttgcaggggtttgttacctggtttcaaaacattggcttttaaacttcttgccctagctcaaaatgtaagaaatacattttacattatgacttagtacacaataatatatgtgcgtgcatatataagcatatatatacatgcctaaatatttgtgtatatgtataatggaaacaaaattttactacacaatggtcattcctagtaaagtgatggatgctctctaatactgtttctagttccagtaggtgagagggtaagagaatttgcacttttttttttggcgggggggatggagtcttgctctgccatccaggctggagtgcagtggtgctatctcgggtccttgcaacctctgcctcccgggttcaagtgatcctcttgcctcagcctcccgagtggctgggattacaagcacatgccaccacacccggctaatttttgtatttttagtggagatggggtttcaccatgttggccaggctggtctggaactcctgagctcaggtgatccacctgccttggcctcctaaagttttgggattacaggcgtcagccaccacgtccagctgagtgtttgcactttgaacaagtcccaaggtgatgccgttgctgctagtttggggaaccacactttgagaacttctacactagacaatactagtgattgaaaaaaaatcaagccccactaagcgcctccaagtgctggtctggccccaatcttccaactcatttacactttgctttagattcaacatccacctgctcctgggataattctgggttcccccacttctggtgggtcttgtgtttctattttccttaccagtcaaaatgtccacactcatctcttgcctagttgttctctctctctctttctctctctgtctagaaatggaaaggtaaagacgatactgggatggtctgacttgagagacaaatgcaattaatcatcacaataattcaagggaaagttaaacagtacttgctgtttttttccagggatccaaaatgagttagttactgccttggcataaagtcaaccaaaattatgggaatacctgtgcctatttcctctttatgatttttggtctttttgctttccaaaaatggggtaatgtataaaattatcaatgaaaaacttccttgctcttgctcattactttaatcaaaaaaagttcaacaagtacatattacaaggattctcttggtagaacaccattagctaaatagaaaaaggaaccgtacttaaacactaaatctagttgaaaaagcaaatgatccttaattgtagattgatgagctccggccagtgatggtatcacagcctaagatgaaattggtgaaatcaaatgttaagaggtctcagaattggcatcacgagggcaaagagatgaaacaactagtgatatctggccaaggagcagcagtgtggcagctggctactggcttctatatgaaagagagaaatggtacctacctgggaccaacatggagggcggcagggagaggctgcccctcgaaatggggaaactgactgtttgggcagggaaggcaacagtgactgaaaaaaggaatcagctgttattggttgaccagaaaaaggtactggtatccactctaagcttttagggaaggaagaactggttggctcccagttcagacaaggcccctaacatctgaattaatcttataaatggttctgtatgcttctttcttttgggtctcaggtttaaaatgttctttcttttgagtgggtgattgagatggaaattccaccaagttttctggagtagatactctatgacaagaacggcatttaatttcccttcagccactgtgggtttaaaaccaacaaacttaggtcgcatcttcataaaaatcacaattaaattttgggttatggaggaggtaaccaggatagaatatgctttgggggtacaaaactgttgaagggaatcattatcagtagcttttcacagctacccaaccataaaacgcctttggctctgagaatagtagtagctagattttggcttcttttgtttttttctgtcccatcccccatctccccttggatgcctttggattcaaatgtagatgaaatgcagattcttgggagaaaggaagacatgcctggtttggctggtgattgggaaaagaggaggatctcagatttcaggttttagttatcattctcccgagatgggaagaggctgtgattcttgatctgaagagtcttatcgtcggtagaacttgccatcgatgatcaattgtttggatttgaggaggagagaattgaattatgttggcctacaacaacgggagcaggtcaggtaagaatcgtttattgctggtagacgtgtcttttaatcatgtgtgtatatcgtctctcttgttgaccacttctctaatcttttaagagtcatatgtcttactagtgcatggtattgtgctgtatgtatttttgctgcaatcttcccggtgtgcttaggggatgtgatttcacttttattcttaagccactgagaaaataatagcacccacacacgtggtcatggaaactacagaacttcactgtttcataaaaggtggtggaaattccaagtcattaaataatcttgggcatatttacttctgctatgagtgctggtaaaatgtttatataaaaaagtgacggaggaaagcaaagtttgcttaaaagtaagacaaattgaacgaatgaggttaaaatatatatgtatatataagcaaaatagcattccataaatcagtgagttttaaatggagggcagatgaaaggaacaaagtggacaattgagaacttcctcaatttctcagtcgctaggtggatacccatctccttcgccagtggaagccaactgtcagagtggagaggtggttggaacttaggagtatggctcactcctgctttgttttagaggctactggtggttactcttaatgttgtagactaaggatagcagcataaacattccagattgtcaagattgaaaagctacgtaaattgacaaaggtctatgtaaattgacatttttgagttgcctttttgaggctataattcttcccctttttgtttccacaatggggaaaatcgccttactagctcaatatctggatatgtttgttgtggatgtctatgttcctttctttccctctcctgggcaacaatggcagttttggagactccttggagaccacagtaccattacgcacatggtggagccccttgtgaatgcctaagcttgtggatgttctgaagggggcaataattggagtaatggtcatggcgagaagtgcttgtatttgtattggtccatcattgcataataggcttatatgttatatgtatctatttcctattgaggatctcttttttacagttgatttttcttgagggattttaaactatcacctgccagtatttgagcgcttgccgaagtgtgcactcaatgctttgagatttcccaaatgtataaaatcctagtccttgccttcaaggaacttacaacttttgttgataaattggtaaacctagagagaaggcaacaatgaaatgcagcatataatggaaatgctaagtgagaggaaagaggcgctgtttggaggagggagagggaattggctgggccatcagggaaagaggcagagcttgaggcgccttgaccagttgatgaagtggtggctttaatttgcgattcttgtgcaaacatttgataatgggaattggatgtgtaggtattgggctttctcgtggacactgaaattccattcattgaacaacaccttatttcctgtatagagaatggtgctaggggccagcgtcaaatttgaagatgaagtctgactgaaggtcatcgtttggagttggggtggggtgaagagtagacaaaccttaaaatacagagacgagtgctgcagtgagcacgcgtgagtgcttaggcagcgcttgaagagggagttaccgatttggccctggaagtcaggaaggctatccttttaaggtgatccctgagctgggagtttgtttcaaacggtggggaccgcaggtagaagcaccgcttaaggggaacggcgattcgactcgcagtgacttaagggttggcgtggtgcttgttcctgggcgtggggaggacaggaaaccgcggggtctgtgagacgccccgtggttgttgaaacgctgttggggggcacaaacgaatagggctttaggaagaaaactggtgggaggagccttgtggctccaaggtaggttaggaactggagcgagatggagcacggaggagtgaggcggcccgaaggatgcccggggagacatggaggaactggcgagggcttcccgatgcagggcctgggggagagggtgaactaatgcctctgcagtgccccgtggggaagttccgcatactcggccagagtgatcggagttggcggctgtctgggggagttgggtcaggaagccccttctttcgccaccgatggggcacgtccagggcccggcaggtgtgccctggcagtagatcttccctgggaagtggagcgcgggccagccctcgctgttctgagcgagggcctgtcgtgtagtccacaccgttccgcgaaaggaaccaccattgacagcctcgttcgattagaacccggacctccctggaatccagactcggtcccttcccagctgcgcttcggaggaggcggacgctccgagaggaacccagaggcctggcgtggggggagctgcgggcagagcggaggcagccgcgccctcgcgccgccctccgccgcgcccggctcccgccccccggatcccacccccggcctgccgcggagccagcgtgccagccggagctcgccgggccaccccgcggggcgcgcggcccgggctccgggtcttggcggcggccggtggggcgggcatggggtggggtgggtgctccacctggccacgccgccggcccttcgcgggctggcccggccccggacgggcgggcgcacggaggccgcctcttgggctcctcctggagggaggcgcgcggtagacggcgcggccgctgccgtcggggcggtgggctccagacgcgggccggctcgctcgcatggttccctgccccatctcgggtccgtcgctgcccgtcctggtgtgcacaaccgcgctgcgcctcgaacctcgaggtccaggtcccgcctgccctgggccgggccgcaagcgcccacgtcgaggcgggctggggggcggtgccgcgggccaggccgaccccgcaagcgggactggggaagtcggagccccgcccaccaccccgccccccgcgctcgcggccccgcccccgactgccccgctcctccccttcctgccggctcgctcccggccccgccggccgcccgcctcggccccgagcggagcccactgctcccctcggctgccccgccccgccgccgccccgcccctcccgcgcgggcggcccgaaaacccggagcgcgggagcgcggctccgcagggccgggcggccgcactgggcatgctcagtagccggggcaggttttttggtcgcaagtaggaagctttctgcactacaccggagaggggagccgcgatccggccgcgccgcccgcacgccgccgcgcccgccccagcccgcccggccccgcggcggggcgcgatgagcccgagcgcgagccggcccgccggggagtgagcgcggggcgcccagggcgcgttgcgtagctgctcctgcgcacaaccccgccgcgccgccggcccgcactggccgcggagtgcaagaggctcgtccgtgcccagcgcccggccggccgcgggagcaggaagcgcaggccacgcaggacccaactgaaacaaagtgtcggccgcccggcgccggcgcccgccccgaccctgcccctcccgcccgcaactccgccgcccaccatggcttccgaggagctgtacgaggtacctcccctccccccggcctcgggccgccccccgcccgccgcccctcccggcccggccgcgccgcccgacggccccgctcgccgcccgcgcccgccgcgtcccctcccccgccgcggccgcagtttgctggacgggaaatgtgtgtgaggggagcccgagcctccgttccgaggggccccggccggggggtcctgaagttgccgggcgtggggtgggggggggggtcccagccgtggggaagtggtgctgacacaagtgacttgctcggactgagctcaaagtgctcttggcgtgggtcgtggaagtggtgcctccgttgccgctcggcggggaccgtgggcggtacggggggtggggtgtgggggggtttctggatcatttgataaagcatttgggagagggttttgcccctggtcggggggtggcggggagaagaccggtgcaaacgctttcgactttgctgttcgccaaagcgatgcaaaatctcgcaccgaaaatgctaaacgttgaccacatgctttaattaggttagcattgtggccagagccaggaaatttaaatttaacgctgatacaccgtcattcatttgcgccgcagcgttgcaaatgagaagggcatagccagaactgtaagttctggtcgatgggtttaaaccagcttcaagtttgagagttaccaatttggatctttagacatgttttgtatgtctccatgtaacttcttttgacgtatttcaaagtagacttcctgggagtacagaagtttggaaggctttctgttcttctggataaatgattctcttgtttcacatgtatttataaataagttcctaagagacttaaaacttgcgaagactctctagactcacctttatgatgcgtttagggacctgggtgttgagggacttaaggaagcatctgtaacaagtagagccctgtggccccagggatcctttcagttgtcttctcttatgggcgtattattgctgttggcatagaatagagctttgttgtctgcgatgttagtcttctagcaacttttttgttgctttttaagagcaagtgtttgcagaagttctcaggaggaagctgccatctgtagaattaagggtaaggttgttgcttctccttacattgtatgtggtcagtataccttagctggtactgaaaatgttccattcttttcaaccattttacacattagctgtgccccgctgtattcaggatactattttaggtcatttggggatgtaaaagaagaaaaatctccctgttctcaggagctttccttctaggaaggaaagtgttgtgtgtctggaagacacagaaatggaggctaggatgtttgaggttgaggtcttccaggtgaagtctgtacagggggaagtacatagcatgagggtatgggggattttagtttctacattagatcattctttggttgtttagtcatgagtgttcactcttggcatttgcttttatgagtatgattacataatcagttccatcagtggatgagagtagcaccttatacgtaagttgtatcctatgtgtgtaagaatgattctgaagacagcacatttcccattagtatattatgaactaagtttagttccttctgtgcttattctatatcttcaggtttctgttcctaacagaagttattaatgagtaacattttgtactaagtttgtgttcatttaacgtttattgaatgcttgccatatggaggtttcatggggaaatactgaggtgtgagaatggttcatgctttcaaggagtgtctgttggggaggaagtaagtatattgcaaataaatgatacacctgcacaattgaacttttgattctgagttttattttagttttggaaaaaaaggtattatagaagtatagttcaggtgataaatttaagtatgtgtagtaaatatgtagtggtcagtatctttcaaggcaaaatttgtaacttttcttttacttgtaggcaacactgtgactatgttaccattgaaagttgacattgaaagttttgcatggcagttgagagcctagatttggagtcagacaacccagttagtgacttccaactctatcaccttgggtaaattagccttgaaagctcagtttcctcatctgtgaaattgggatcagtgtttcccttatagagctatgaagtttacatgagaacatatgtaaagcccaccctaaaattcccatggcaagcacccagtaagtgatgatgattgtatggtaactggcttaaaatgcctccctgaaacctggttttgtttctaaaggtatagagttgtattgttttcataaaggcagtattatctgtagggcagaagtgatacgcaattgtaaatgaacgcgatagtctgacaaggctgggaaagacactaagatgatgttttgtggccaagtcaagggttgttagttgccttgttttgtccagttctgcctaaactgaaatagaagttttctgtttggcctcaggctccacaaatctagagggatatattgacaggaggaaatgtgaagtcttgcttctttgaactcacatggtctggtaggaggacaggtctgcagtaactgggaacttgggtgagttacccaactgctgagccttggttttctcgcctaaaagaaatgtctccaatacttagcatggaacctggtatgtagtaataggtctttagtaaatgtttaaatggctattgaaactaggctttgtgaacaaaaaataaaggaacagatcctggaaaagatgggtagagcatgaaccttgcaaaatttgaagagttactattagttgaaggatggaatagatttactccctacttttccagctgctaggattgaggaaaaacggatttttgatgcggcgtaggttagaacttcatagttttcacaaaaagacaagcgtcctttacatcacgcttctaatgtaaagggccagataatacatattttagacttgtgggttatattatggtctttgttgcaaccactcagctcacctcatgtagtgcaaaagcagtcgtagactcctatatgaatgtgcgctgtgtctcaaactgcttatggatagtaaaattcacttagtatatttcatatcattttatgtgtcatgaaatacacatttgtgttttttttccaatcacttacaaatgtaaaaatgattcctaacttgtaggttccacaaaaataggcagtgggctggctttgccctgtaggttgttgtttgttaagccctgctgtaggtgatcaactgtcatagtctgtttaggaatctgggtttactcaagggttggggatgtatggaagttagacggtatttctaactttcatcccagctctagacttagagctggaagatctgggtggtaatcctccctcctttcctccttcctttcctttctttctttctctttttttttttcaagagtcttgctctatctcccaggctgatgtgcagtggcttcatgttgtcagctcactacaacctctgcctcccgggttcaaagctattctcatgcctcagcctcctgagtggctgggattacagacgtgcaccacccccgcctacgcccccccccccccgcccccgcccccgccccggctaatgttttgtatttttagtagagacagggtttcaccttgtgggccaggctggtctcaaactcctggtctcaagtgatccgcccaccttggcctcccaaagtgctgggattacaggcatgagtcactgcacccggccttcccttgttcttagaagcttgttaagtaactcatcttgtacttgtcttaactatcctaaactttctcatcagtaaaataggaggatgataaccaaataattgaggcttaaatggcattagcgtgtaaaagcaattctacaaaacgttttccatttttaaagaggaaaaaaaacccatccaactctcaaaccatgaaaccaaacctgttttcccttcctcaagatttaggatttgaaagtattctataaactgattatatcaccagagaaagctgtgaggtcaagaggaccttaatttatttagcagtcaagtaaccaccatgagactttgttcacgtgggactgaataaggaacgtatgctgtagtaaaatggaataagtattctctttatttgtatgtcttaataattccttttttcctcagtagatgtggagttattcccttgagaactcctgtaatagttaattcaaatttcagtaagctctcaatgattagtcttgaccttctgagagaatatttatgttttcattttcaaaaatggaagtaagcttttaagaatgaaatcgtatctggtgtgtaaaaaattgttttaaagttgattagtttgacaggatgatcaggatttgcaggggaaggtaggtcttttgaatctttcttcctactttgcgataagattcctgctctctcctgtgcaccacaaggcttttacttacattgaccaaaagcagttgtgaataaagtctcaatctgtagttcaaatggaagtcacagagaccaggacacctttcatggatgttggccaagctaggtcagcgtatgttgtatatggtgtagctgtctgaaaagattggaatcaccaaaattagtaaagaaaaagagttcatttgacttcaggagttgatagtgaggcagtgaggtcaaacatgcatgtgtgttttgacaataatagcctatcttaaatgctctttttcctgtgagttgctgagaatattatttattcatttgccccagcagcagtgtggagacctctcatgtgctcttcctttgaactactttcaattcctgtgtaccagaatagcgtttttttcattcttgctgtgatatctaagaatcatagactgttccctcgtgctctataatgattttaaccacggagaatattttcatggtatgtaggcaacactttcttcgcattgttctggttcacagttttggataactgtgattcacaaagccaggcctcaaatgaattcttttgtaaataaggagtgatagtttttatattgtgagcactcctaggtggaacaggaccagcctggggtcttttttcaattcagattcttgaacccaaaccacgagattataattttcaatgtttggatggagacaggaatcttatgttccgagaagcttctttttggaatgcaggtggatttaggagcctctggatacgcccttctgtgtttcagacccttaggctctgcgtggaggtgggtgggggtgggttggggatctgcctggcggaagaggagctctcggtggaccagactggttctttctgcaggctccttgaccactgctggttgttaactgagtaattccaggaagggaatattaaaaacatcaggtagttagctaagggcgttgtaatttctgttttctgtctttattgcctggcatgtttgtccaccagaatgtaagtgctttaaagctcagattcattttctggtcattattttccacagctcaaaatactgcaatcgttgcataattgttgagttactttaatggaagagtgaattacaggaatgaatctccattcctgactccttacttacctcgaggttcctcctcccctaagcattatgcctcttgctgttctttttactcttagttcctcatctgcttacatggtttcaactctagaatggagaatttcactgtttcccacacaaacttaattctcttcagccttttaagctgggcaaggttttggggttcacgttctctaggaagtctggggagggcctattatgagtctagatatgactttaaatccaattataacctcaaatagaattttatgaaaatttaaacaagtacatatgagcatatttcagagggagagaatcaagagctttcatctgattctcagagggatataggacccaaagcaagtattaaaaactgcatcgagacctttgaactaagacttatctgtggctgccctccacggaccactttgacattatttttgttgaactgtcctctgccacaaattacagtaaaaccatattaaaacctcactgattgggtttagaagttgtatgctatttctagtctttaagtggctaattttgcagctatgcatacatgatgtctaaagatagtcagtatttaatggcacttctgacaatgtaaagattttacattccttgaaccctggtgcattcctgaactcacatgctactgctttcttattgcccatgaaaaaatccctcatcaaatagaacattattattttatacaacctttctttagattcacctctgacttcatagtttcttcaatcagatcgtccatcttctatctcagaacttccttctgggatttttttttttcttaagtgtatcctttagagatttctttagtgagggactatggatggaaaagtttctaggttttttttttttaattattattatctggacatgtctttattttgccatcattttttgaaagagaatagtatttcaaataaaaccagttaattggttaatttctttcagctccttctgaagatggtgctccattgtcttctgccttgcctttgcactattcttgagacttttttttttttttttgaggtggcgtttcactcttgtcgcccaggctggagtgcagtggcatgatcttggcttactgtagcctctgcctcactggttcaagtgattctcctgcctcagcctttcaagtagctgggattatgggcatgcaccaccatgcctggctattttttgtatttttagtagagatggggtttcaccatgttggtcaggctagtctcgaactcctgacatcaagtgatccacccgcctcagcctcccagagtgcttggattacaggtgtgagccacactgcacctggccaagactgttgtcagcataggtgcagtcactttataggagatctgtcttctgtctctggttgttcttgagatcatctctttgactttggtttcctcttgtttaatacgacaatgtattttgtgtgattttttattagttaggtgggtatatgttgtgctgctttttggatttgtgcctcatcagctcgaaaatggatttggccagtttgtcttcaaatactccttctctgtactcgtcaggaattccaagtagacatctatcagatcatttcattctctcttctttgtcttttaccttttcatttccatctccttgtttgtgttttgttttctttttatgtgctgcattttagctatttccttggatctaaactatagttcactaatgagctgtgtttaatctgctgttttattcaaccattgagttttaattttcaataattacattttttacttcgaaatattctggggagtttttacctaatctgcaattcgttttttaagtctttggtgtttgtccattttatgatttagtcattattttgggttgggggcagttactgaggcagctgggatattttccttgtttcctacaattgctatatggtatcactgttaatgagagttatattttattaaagatctagttaatttgtaatgagagggccctttggagtcatgtttgctttattgccagaatctgaagaaaccttcttgatttggaatttgtgacatgagcagggattgaggctttgaaccaacacttgagatttacctgatgatattgaaaatgcaaaacagtagttttcaagaggactgtttatgaaaatggattataatagttataacgcaattgcttctgaagcaaaatgttcaatgtctttgttcggcatgccttgatatatagtcttgtaccacataatgatactttggtcttacgatggtggtcccgtaagattataataccacatttttactgtaccttttctatgtttagatacacaagttgatatggtttggctgtgtcctcacccagatctcatttggaattgtagctcccataattcccacgtaccatgggagggaccctgtgggaggtagttgaatcgtggggtggatctttcccttgctgttctcctgatagtgagtctcatgagatctcatggtttgataaaaaggagttcccctgcacaagctctcttgcctgccaccatgtaacgtgtgaccttgctcctcattcaccttcctccatgattgtgaggcccccccagccatgtggaactgagttaattaaactcgtttcctttataaattacccggtctcgggtatgtctttattagcaatgtgagaatggactaatacacaagtcctcactattgtgttaaaattgcctacagtgttcagtacagtaacatctgtacaggtctgtagcctggaagcaataggctctaccatacagcctaggtgtgtagtaggctacaacattgatgtttgtgtaagttcactctgtgaggttcgcacagcagtgaaattgcctaacaacgcatttctgagaacatatcactgtagttaagcaacgtgtgaccgtatagtatactttcttttttgtggagaggttagcttcaatatatctagagaatgtcttttatttactttttgtcttatttccatttgtagtaggctctctgctatgtgaagttttctttgttggtagcttcctagtgtttgttgttaaaacccaacaatgttgactgcacatcatgaatgttctttggttaaaatgtatccgtttttcacttgtacccatttttcattagtagtttactgtttaggaattcaaggcatcacatagttgcacacagaagcttttcttattttattaatagcatgtaactaatgtggatatcccagctctttagtgtatctcagaaccaggacaaaaaaagtcatcttagtttgcaaaaagatgcaccaccccatgcacactggacaacagctctgggtctctcttggagactgttgacatttcctttaggcattatgtacttggacttgactggcacctttagcatgttagaaacaggttatttggtaaaggaaaaggctctgccagaggcaggtgaattgacgttaataagtttgttcatgaagttcgctgaagagggtagctggtgatggcactccaagtcttgaggtgacaggctccgtggggccagtcctgcgccccttagagcaagtgaagggcatgcttatgaaagaaaaggcatatgttgcaaagagctatcaagaagagtttttaaaaagtgttgctatgtaagtgtaagcgaaaaaattaagtctacttttatggtaaacttaaacataaattttatggtcatttccacccaagttctccagacggcagaggagtcagcaggaattctcctaaggaggtggaggtgggagggaggaggaaatggcctttgcaagcctgacctgttgtttgaaatctcaagttaccttacatgttttatgatattaaccatgtagtccatacaatttttgggattcaatatgaaatattttaaacatatttaccaaggagctcttctccagagatccttgatttaggctgatgtttcaggaagctgagctgtggattagtggccctgtgtgcccttggtctcttgctgtgtgtgtgtactctggcttcagaagcagagacggactgtgttaccttccataatgatgccgggtaaaggaggcattagctgatctggtgaaatgtaaataagatttgaattaagtagttcaaaaaaaatttaaaaagtttgttttagtaattgtttttaaccaataaagattaaaaatacttgttttctgtctgcagtcatcttactgctaggggttcaagagaaggtgcactagtagtttttatctcgagtctcgctgtttattctctgtactttaaaaaagtgactgtgctgttgccttgagctggttgtgggagcatttgtagggtccctgttggaatgaggaccaatctgcttcataactcctctctgtctatgggctagaccaaagtacccttggagaactccatgtcttccaggaagtttccaccctttttctcctccctctttcctgagtgttattgtctgcatgtccagctgtgtccctctaacctgattttcagccatctgccaggtccctcgagttgaggcttcactcctcctgtcctgattcttgaccctggcttctgcacttgctggtggccctgcagagctctggcctgggaagtagaagaatggctgcccacttgtgtttgtgttacctggcttttcatctgcacagtccagagggaagttctcaactgtcttacaccccaggcacgtgaggtagagtgtagccaactctcccagcaggacagacttctgggattcttagtcctctaacttctctctcatatgcagatgagcttttgaacttaaagcaagaggcgagtgattattttattagcacctttagggatgcaaagaagtaggagtgtgtgtttgagggaggtgctaactagactgattcgttgtgcccttccttcagagtgcacctagacgagtcagagtcagagtttccccagaatcatttggcacgccatcctgcgacaccactggtttctgctcgtaaatgagctttttgaaaaaatcttgattcggttgatagatacatatctaaatgtgcattcctcagtccttcctaagtagctctagattggggctgcttaaaaatgaagaggctgcagtgactgtatagagtatgttgaaaagatcatggaaatgaggtcctgtggaagtgcgtgctcataccttggcagaagttcagtgctgagaccagacacattcagcttgcccaggaacctaacgaaagtcaacagaaaagaaatcgtgggtctgagctgggcagcttcatggcaacgctgccccctcacctttgacagaaaggcagctgggagagaaggagaccaaagacatgcaggtggaggtgcggacaggctgctctgaaattcaagtctttttttttttttttttttttttgggagacagagtctcgctctgttgcccaggctggagggcaatggcacgatctcggctcactgcaacctctgcctcccagttcaagtaattctcctgcctctgcctctccagtggctgggactacaggtgtgcgccaccacgcctggctaatttttgtatttttagtagagacaaggattcaccattttggccaggctggtctcgaactcctgacctcaactgatctgcccaccttggccttgcaaagtgctgggattataggtgtgagccaccgcacctggtcgaaattcgagtcttatagtcataattccactgaaaggaaaggtcagggtccttcttttgggtctccagtggctcacttctgtagcaggaaagggacatgacttggggtttggtgaactgtttaaaaaggcttttcaggctgggtgtagtggctggcgcctgtaatcccagaacttcgggaggccaaggcaggaggatcacttgaggccaggagttcaagaccagcctggccaatatggtaaaaccgcgtttctgctaaacaaaaatttagccaagtgtggtggtgcctgtagtcacaagtactcgggaggctgaggcaggagaatcacttgaacccaggaggtggagttagcagtgagccgagatcacctcactgcactccagcctgggtgacagagtgagactctgtcaaaaaaaaaaaaaaaaaaaaaaggcttttcagtagtggagcaggtctctgtgaagaaaagtgcttcccttagagtttgaaaaggaacccttggggcaaataaggacgtccctaggccctgaaggtgggtcaggaactctcaaagattgaaacaccacccctcccccaccatattcctgagccctcactctcctgggtcactggggtgggaactgtaaggatggaaattccaatcctttctgtgcttccccaccaccattcggcagcagaagtgtgtaattcatatctagtgtgacccgtgtttctccggaatttgtggtctgcctgtcgaacagccagcccccttcccaccccacctgttaggatccccgcaggctttgctctgctgttctgggatgaaggatgttgctgcttcctccattgtgccaggtggaccagcctctggccctgtccctcaaggtgaagctatgtgagttagagccctccctgtcttgtagctacatggcgggccaggtgctgctcctcctggctttacattctgtcccgggaatagccaagccatactgcttcatgcagaagctcctggttttcgtgttttttgtttgtttgtttttgagacagggtcttgctctgttgcccaggctggagtgcaggggcatgatctctgctcactgcagcctctgtctcctgggctcaggtgatctgcctacttcagcctgccgagtagctggaaccatgggtgtgcaccaccgtgcctggctaatttttgtatttttagtagatacggggtttcgccatgttggccaggctggtctcgagctcctgggctcaagcaatctgctccttagcctcccaaggtgctgagattgcagacgtgacctgccgcgcctggctgctcctgggtttcagttgcgcttctctcccctagtggtgtctctgggcacggtgggccctccgcaccacatctgtcttgctgggccggttttatttctgtttccctggccctggcagcctccccgccctaggcatctcccccactcccagtgggcaggaactccagtgattcaaacttaaatggctgctacccagtacagtccttgaggagctctgcagtgctctgtgagcttttgaggggccatgtgcatcagaaagcacctgccactaaaaattgttgtagaatcagttatctgaactctgggttcagcgttgttcccaaatgactttgctctgtttccctagctctcctgcctttggccctatctggctctttcccacctactctgggtgttactcttctcacctgcccctgggtagggcccccgcagcactccatggagtaatggggagttgaaccattcagagaagtgtagtttcctgttcttaatgaaagacatcaggtgaacaataaaatcctcctgttcctctaaaacaaatcgcctttcagacgacagaaagctgccctttatgcctttgtgctcccccttccctgtgggttatttgtccttgctggagaatgggttttctctcctgctgtacatcattgaggacatcatcctgtcagggttttgctaggctggtgttgtgtggatattgataatgataaaaagcaacaagcatataggaagatttgctgttctcctcagttatctcttttggatatatgctgtattagcaagaagctatttactctttcagtaagtgtttgttaagggtggtggtatttgaaagccttgagtttataaagtactaatgaaaccttttaaatacgaagacagctttttacttaacaaatgtatagtgagcagttaacaatgggacttaatactatgtgtaagtgaccttttgcatgctgtataaaagcttgtcagagttcaggaggtgttactgctgtggttttgggtttgcttgagaacattagatgttatttttctccaagacacatactagtgaccttaacaacaacaaactcatttttcttggtatgaggactagagttaggagaatttctgaagcgcttttggaaagtaggcggacatttgagttcctcatctgccttttcccctggtcatcatacatgggatcattaagcagaacacagagcagacttgactaaagcaatgacattttgtaatgtagcttatggaagtagaataggaaggctcagctaattacctgtaatttcaaaggcagccagtaggtttcctgtgtacagcaccttggaaatcttttgtatggacccaaaaatgagtgactaattacagaatagaaaatgaataagctttgtacgaggttaagcaaatttgcaggaagaatgtatttaatgcatcatcatggaaagcaatttttgactgtcatcaacgatttcaagttaagcaagtatctgtaatgaagcacaaaagattgataaaaacagagaaaatatcagagattggatttgtccaagtaggctaactgaaaatttggtccaacaaacatcagcaagtgctcactttggaagagaatttgagtttttaaaaaattagaccccaaaggtaggtacaaactgatgatttaatatctgttattagtgtttcttagagaaacagaacgaagtgtaacgtctttggagaatacattaagggaggaagctttccaaaacccaacatgaagactcatatacagtggccagcattgacattcctaagaatcaagaaagcatcatatgatctttgtcatcaataccactgttcactgtataaccgattccataggctcagagagatgtggaaatcaggatgttttgagaatcagtgaggtggagggaacagggctgggccctagtgatgaaatttttaacgaagacctttcattttgtgtgtgagaaaccacttttgatttacaatgtatcatcaacctcactctctagacttctagtactgaagtactttagttcacgtcaaaatctgtttctcaattagggagtgaagatttggcaccatagagcatattcaaaaaactgtgttggagggcagtcctaaaagagaaaaagttctgaggatattctgtgttgtcaacagcttctttgaactgagagtttggcctctgacgtcttggcttgaactagctgacatccacttggcagacaggccctctgaatttctagcatttacatggtctcattaccttagtgtgggacgtatataatttaagggccctgtgcgtgtttactgagcaaagaaacatcaaagaaagaaaaaaaaaaagtcccatgccctaccaccctggtctaactactacgaaccacagaagaccattctggacagaagagtagatgtatacagttaacagttatttcataaacacagaatcgtatgcatggtatttagtagaagataaatataagttaataggaaggaattgtagaatttttttttttttttttgagacggagtcttgctctgttgcccaggctggagtgcagtggcgcgatctcagctcactgcaagctccacctcctgggttcacgccattctcctgcctcagcctcccgagtagctgggactacaggcgcctaccaccacgcccggctaattttttttttttttttgtatttttagtacagacggggtttcaccatgttagccaggatggtctcgatctcctgacctcgtgatccacccgcctcggcctcccaaggtgctgggattacagatgtgagccactgcatctggccaggaattgtagaattttatatgaaaacattttacatcattggatcacttttattttgccttttccttgttgatttgttggagatcttggtatataatagattctaatctttgctactatatacgttggaaatatcttctgatatatggctttgtcctttttaaaatcaataatacatttatgtttcacttgccaaattaaatctgacattttaatgtagtcaaatttttatttaaaaaaaaattttttttttttttttgagacagagtctcactctgttgcccaggctggagtgcagtggcatgatctccgctcacggtaacctccacctccctgttaaagtgattcttctgcctcagcctcctgagtaaagtagctgggactacaggcacacactaccatggccgactaatttttgtatttttagtagagacagggtttcaccatgttggccaggctggtctggaattcctatcctcaagtgatctgcccaccttggcctcccaaagtgctgggattacaggcatgagccaccgcgcctggcttctctcatttcgttttttgtttaagaaatccttcctaccccaagatcattgtctgctgtgttttcatctaaatattttgctttctacagtatgaactttcacttacctatagtttgtttttacagtgtagcctgagcttggggttcaacttatttttaaaatgtggataatccataggcactgtttagtaaatagaccatctctccccattatttgccacctctgtcatagatgtttccatccatgtgtagggcagtttcttctgttcaattggtatttgtctttcctgattcataccatgctggcttgactagcatggctttatgtaagtcttggaaactcgtccttccaggtatcttcattgtgttctttttttctggcaaatttctctcctcatggtggtgtgctcttccatctacaccctggaatcatcatgttgattacgtgagaaaccctgttgaactggggttggtactgcatcgcgttcatggattaatctgtggcactggagatatagcagcgggcatgaccgctcagccactgcccgcccaccttcaaggagcttttattctagtggtggcaacagtctagtgagaatcggagtgctagtggctggtgggggtggtgttatttttaggtgaagcaatcagggagagcttcattgatagggtaacatttgggactggggttggagtgaggccggcaggaggccagtgtctctggaaaccaagggagagaatggcggatgaggttgggggtacttgtaggacttcataaatgtgctaagaagtactttgagttttatttgtagtaagatgggaagccatgaaggaatgatgtaataaaattaaattattttaaagtttatgccagatgctatctgggcaactggagggagacttagaaggaagccgggagaccaactaggaggctggcaggataatccaggcaaaggatgatggtggtttgaaacccaggtggtgacattgggaggtagtaaggagtgattgcatttcggggatattttgaaggtattgctgagcaggatttacccatggatggatatcggatatgagggaatgagaaggaatagaagggacctggagtttttggggttgagtaactagagtggacttgccatttactgagatgggggttcatgtgtagggtgcagctttgactttattgccctggagggctggtgggtatttaggagttggattttagatgtgtcgagtttgagatcccttttagacatctagtgggagcggctgggcagctgtgaactacacaggattatagttcagggcaggagagaattttaggagttatccatgtagtacacttggttcttagagccatgagtgcatttaatcatccaggaggtaagcataagtagagaagagatgtgaagactgaatcctgggggcactgtagccgtcatcacatagagcttgcggggagataagagacacagtaaagaagactgagaagagacgtggccagaggaggaggagaaccgagagatagtggtgcactggaagaaaacctcaaggagggaacgagccccactgtgtttggtgctgctgaggactgagaattgactgttagatttggcagcgcggaggccacttggcagcagctctttcagtggagtatggagactggagtctggcatgggctcatgagagaatgggaagagaggatttagaggtggtgattatgggcgactcctcggaagggtttcatggaaagagaactgggagtgccgggcaggctccggggtttgtttgcttaaagacagaggaatgatggtagttgtgtgatgatgggaaagagctcgggaaggggagggccaggagagagagagtgcagggacagtggctggaatgatttcctgagatggccagaagggattgcatcgaagagcatggggtgcatgtcccttactcgtatctcgtctctctcagtaatgttttgttatgaaccttttgaaagttttgcataacctttcttgattgattcctagaaactagagtttttgttgttgttgttgttggtctcgttgatggaaaagcagttggttaatgccagtacatagaaaggctgtttatgtatatctgatcttatatctagcagacttgttaaactgtctttgtatttgaaaaactgtaatttcttttagatttatatgtagacaattatatcttgtgcaaatagggatagttttttttttcttttcgaactcctgcagtacctgttatttcttgtactgaattggctaggaccgtcaagtacaacgttgaatgtaagttgtaacaacaagcatttttgttttatttctaattccaaaagagtggatctgtaaaattttactattaaataaaagctgtgaatatttgttagatgctcttttttaaaaaaaaaaatctggttaaagttttattactagcttgtgaagagttttaaatcttggttattgaatatgtttctgcatttattgcagattgttgttttacccttatttttattttctgatgttgagccatccttacatttctgggataaatgtgactctgcttagtcacatgtattattttgtgtatattgctacagtttttttcctaatcattgttataattagtcacatgaaagagaaagacacaactgaatatttttttctcttctcagtttttagaatttttggaaattctgtttttttctggttttggctttacttgcctaaaaaatcatctgagcctctctgctgccttttaggatggaaggtgaactatttattttccatcgagaatttgatcttattgatttatgagtactatttcttgaatcaattatggtttaatgtcttttatattagaagattcttaggatacttaaacatctatactggctctgtgattcagcatgcctcattctttttgtaccttttctcttagaggtatttcttttctctttttttttttaaagaatcagtttttgtctcggttctttctgttgcatccttgtctttcattatttctggttctttatttccttctgcctttaggttatttggttctttttatagctcattgagttgaacattgagctcgtattgttctttcatgaacattatcctctaaatgcagcttttgctgcatcctgtaagtttaatttcatttttttcactttcagattttttttctgtttatttaaaatacattcactttttttcctgagacagagtcttgctctgttgcccaggttagagtgcggtgcagtggtgtgatctaggctcactgcaacctctgcctcccaggttcaagtgattctcctgcctcagccttctgtgtagctgggactacaggcacgcaccaccatgtaacagggtttcaccatgttggccaggctggtctcgaactcgtgacctcatgtgatccgcctgcctcggcctcacaaagtgctggcattacaggtgtgagccactgcgcctggcccacttattttttgagtaggatatttattcataggtctaaaaggccaaaaagtataaaaaatgaaaaccaaaaaatgattttagtttgatgtgagaacatttacatttctaaggtgaaaagtttttttcttgtgattttataaaatattttatattgggattagatttaaatatttgttcagggttcatatatgtacatatatgtcaaatgtattttctttatgaagtatttactatacccttcattgttttctggcccgatcttttaattaactggcacaaatgagttggtttcctaagattataggtttgccaataaatattttgtatattttgagcctaggctttagatgtatacaaattcatgatcgtttattgtattaaggtgtagtgcccatcacttaatgaatttttcccttaaaatgtgtttatgttgctgtaataactagttttggatagtatttactagttgaatctttttccttccctttttatttaaaaaagtttggttttgtttggaactctgtcttgagagcaccatataactagattttaacacttcagtagtatcttttatcagtttaatgtgtttaattttgttattactataatgtttggaattcttagtgtttgctgtttatcattcttcttggcttacttttagtgttagcaccttgttggtatgagagatttttctacatggatttgctattactttgctgtgttgaactatacagattctgtgtctgaccttgtggttgccattagtttctttgaattctgcttatctgttattttgattaaattattcaataatttctcctggaatgtgacaaggatattggcattcttcaccttttgaatgtattctctctcctatttgacatgtatctagaatttttaattcttttcagtgtaccaaaaatgaaatatgtatattactttaatttatatccatctttcttgaagacacaataaggaaattcactgattaactcttcattctaatctgtaatcttaccctccactagattaattttaactttagaaaacacatcaataatacttctaaaaatcacaggttacttaaatttcccgacatttcatttgagaacttactgttttctttattccttctcttctacgtgggctgttttttcttcctgaattacatctttttcttttcttttcatttctttttttttttttgagatatagttcacataccgtagaatttctccttttaaagtatgtagttcactggtttttagtgtattcacaaagttgtacagccgccgccaccactatctaataccagaacatttttatccttttggaaagaaactccatgcccattagctgtcaattcccatcttactctagacccctggcaaccatgaatccactttttgtgtctgtgagtttgtttatcctgtacatgtcatataaatggaaacatacattttgtgtctgacttctttcacttagcagaatgtttccaaggtttgtgttgcagaatgtatcggtgactcattcctttttgtagctgattaataccccattttgtggatacactgtgacttgtttatccattcgtcacttggtgggacatttgagttgtttctactttttgtctattatgaatatgagcattcatgtagaagttttagtatgaacatgtattttctgtgttgttgttgttgtttgagtatgatacccaggagtgaacatctttttttttcttttcttcctttttttggagacaggattttattctgttgcccaggctggaatgcagtggcgcagtcacagctcactgcagccttgatttcctggactcagatgatcctctcacctcagcctcctaggtagctaggactgtaagtgtgtgccactacacctggctaatttttgtaatttttgtagagatggagtttcaccgtgtttccctggctggtcttgaactcctgggctccagcaatctgcccaccttgacctcccaaagtgctaggattacatgcatgagccaccatgccttgccagacatcttttaataattattttagtgaggatttggggataagttcttggtattcatttgtctaaagataattgcactattgtcactagtaatgacattttagctggagataagtttattggtttaccgtttttatcagtcttagagctgatgaaaagtctcctgtcctccttttctaagttatctgagtttctgatagtttaagatttcttacctttgatagttctgtagttttattacagtgggtctaagagtagatatggtatacttttggtctcagtatgaattgatctgaagatgttaacatatcttttaataaatgtcagtgccttgaggaattgtgtctatcttcataaggtatgtcagtctataattttcttatttcacatcacagttaatgctggcctcataagaggagttaggaagcactttctctgtttctcaaattgaatgtattgtactggtttggattctttcatgaatatgtactaaaatttatcagtgaagctattggggactaagattttctttgtgataagtttttagattatgaattcacagcctttaattaaacataagctagacttaacatttctccttgggtcagtttttgtgaaagttgtatctttaaaggaatttacctcatctaaaatgttgcgttcattagcagatacttgcttctgctctttattattattacctttactttcagtttaatttgctttttctgttttggtttcttaaggtggaagtttaggccattgctgtattgtcttacatgagcatatagtgctgtacatttacttgcagctctgcttcagtctatcaaaatttgatatgctttcattagaatccagttcaaaatattttctgggttgatttgtgatttcttctttgacccctgggtttagaattaggttaaattgtggatatttgaggtttttctaaatgttttattgttgattttgaattccattgtagtcaaagcacatttcctataagatttcagttttttggaatctattcagaattgttttatggcccagtatatggtctgtcttggtgaatgttctgtgtgtatttgaaaagattatataattctctggttgttgatggagcttttcataaataccagctaaactacagttggtatggtcacataggtctcccattttttttttatttttttattttttaggcaaggtctcactcacccaggttggagtgcagtggcgtgatcatggctcagcatagcttccacttctcaggctcagatgatcctctcacctcagcctcccaagtagctgggactataggtgtgtgccaccacacccagctagtttttgtagagatggggtttcatgatatgcccaggctgatcttgaactcctgagctaggcgatctgcctgccttgctcggctcccaaagtgctgagattacagagcatgagccattgcgcccagccaagatctctcatctctttgttttattgttttttggtccaattttatcaattactgagaaatatgttagaatttccaaatacgattgtgcattggttgtttctgtttctgtttcacgtattttgaagctgtcattagatggatgtatatttataatattgttatattttccttttaaaatcactatgaaacgtcttttttgtttctagtaatacttttcgaagtctactttgttttacattaatgtatccattctagctttggtatatctttttccagtctgttacttttagtttgtttctgtctttatatttaaaattgttctttagaaaccagaatatagtcagttcttgcctttttaaaataatcggatagtccatgctttttaattgaaattaatccatttacatttaaagtaattattaatatggttatattaggtctatcattttttgcttttcttagggaagggattttatttgcttttgttcctcctcttttgctgattttgtgttaaccaaaatttcttattaattttaattcttctgttggttttctagctatatgcatcttagctttttctttaatattgaatcactttggataagacatataattttttcaatgatgtgtttccagttccactacttatccttagtattattgtcacagttgttgcatttatatactttgtaaacccatcagtagtgttgtattttttgctttatgctgtcatcttttatagaaaactaagatattacatatatccacataattaccatttctggctgtcttcatttcttcctgtagctctaagttgccatctagtgtagtttccatttggactagagatctttctttagcatttcttgttatagatctaccaatgacaaatagtttatttgaaaatgcccttattttaccttcatttttaaaggaaacttcttctgaatactagaattcttggttgactggttttcttccttttccttcttcagtaatttgaatatgtggtcccagtgtcttcagacttaaaagtttctaaggagaagtctttgttcttatcgttattgttgccgttgttttcctgtttatgacgtcattttctctggctgctttcaagattttgtttatccttggctttctaccatttgactaaggtgtgtctagaagaagttttgtttgtgttattctgtttgaggtttattgagcttttgggagatatttcagttgttgtgtcttcagatgtcttttcctcctttcctctctctagagtccaattaaggtactgcttcctgttgtcacatttttgggaattctacttatttttcattcatctctttctctttatgttcttcagattattctgtattcaggttcattgcagatggcagaaccaagcatcaatccgttgcttagccagtctaatgcatttattttagtaaatgttttgttcagatctaggcttttagtttttctggtttcatttttctcccttgagattgccatatctgttcacttattgataccatattttccttcaattctttgggcatgtttttcagacgtttttgaaatatttatgataaatgtttgaagtctgttaaatccaacatttcggctcacttggaatcagtttctgttgactatcattttacctgcagagggtcaagatttcctatttttttcttgtctagtggaaagttggacatatgctgtagtgagtctgaactcttgtgttcttctgaggattattgtgtttttattgtagcagactgttaataaactgcttggtcaaactacacactttgtttttcctgtgatatgcagccgcttgtagctctcctctgctcttaggtctttgcactggtggtggttttagtgtggcaccctgtgagtctcccctgtgtctgcaaaatttgaaagttggctaaggatctgagtagagatggacttttctctgtggttgtctttattctggggattcccctagtttctagcactccaccagctttgagctctgtactctgacatttcaagctttatgccgccctagcttgagcatagttgggaaagagcatcatattcacagatttggctccatgttactcttttttaaaaatattgctttctggtttctgactgctttttcaccgtgctgcttgtggtttcctcagcacatatgtagtatgtagttcagctgtcagctagggatttcagcatcttatgctctgaatttgagtgtcacctctatattctagtgctgtcagagtgctttaaatttctagctgcttccccaattccagattttgatatctggcacctttagttggtgaggaactggcttttgtttgcccccatgttttgcagcaatagctgtgggagttgagcagtgccttgagccaagatgccacaaactcacaattcttaacccttctagttacagtttttgagatttaactctcttcctggcttttgcaaatactacctttagatcattgaaaaaaaaatcactaattagcttggcatggtggtacacacctgtaattccagcactttgagaggatgaggcatgagtctcacctgaggccaggagtttgagacaagcctgggcaacatagtgagaccccgtctttactaaaaataaaaaaaacttagctgagtgtgatggcagtgtgtgtagtcccagctacttgggaggttgaggtggaaggatcacctgatcccaggaggttgaggctgcaatgagctatgattgcaccactgtattccagcctgggtgacagagtgagaccctacctcaaaaaaacaaaaaacagttattataaatgttatctgtgagtgtttgtgtgacctcttcacccttcctgccattacagaaagttgatatttttagttttgaaatactagggtgagtatagcttgtctgtttcatgagcgtgtctttctgttgtgctttcattgcttttagggtcattattcagtttattttgttctttttttttcccttgagataagtttgtatgagagtcagccaccatcctttttctgttcttctttttatttgaaattaggttgtgtgcacttgtgcagggagggtgggcgggagaggttttcagaggccacaggattctcttttccggcatctcactaagtacttgacagtgtggcctggtaccttttgagctcaagggctgtcctcccattcctctccttccccatccatctgggctagaccttctctttccattgcgtcccccaccccacactatccctttcctgctccattgctgttctgttcccagcagtttttcttagtagaaggaggctttggctggctagtttcaagagcccttcagccttagactgctgcagtcccttcggacctggctgtgatcacttgcatccacctatagatggaagtgtgcaaagacccttctagttttggctgctattctcagctggctccctgagttttcctgtgaggtgcctgttgacagtgtcagggttcttctgctcccatccatcagacaccctgttgctatcctctgcttcctctgcacagatcctcatccacctggtcctgcagcttttgcccatttatcatccctttccagtcacttagttttctcttggctattatctcaagatttgagggattgggcaatttttgcacctcctctgctgtccccattctcctccatctgccttgaagtgaagcagattttatcctgctctgaagcctggggcatggatgagaattctttcaggattctctcaccaactttctccagtaacaggattgacagacgatagacaggtgtgggctctgttccctggttgccctttcacttgagagtgtagcccctgaccttgcctgtctgcgtgggctctaatctgaccttacagccccgtcactgtggctctgtgtccctgtccagcatcagcacgtggcctcgggatatctcctggcttcagacttggctcactttcctgattttttttttttttttttttagttttcatctttattttcctgatgacttctcttcattctagcttgtaaatgatgtatttttaaaagtagttaaaagatattttatccaactctatgtgtgtatgtgtgttttttgtactaggaggaattttgggggtacctttgtccttatattggtggtgtaaattatattttttaaaacttttctttttaaaaatagcttatgtgtctcatggcgtagcgtgcttttttttttttttgctctcctaagtctttttgatttttaaaatactttgtttgccgtgcatgttttaagagtttgctctctttaggaaaccagtcaaggtccataattttatgaaacttgggctgtcagttatttacagactaaccagtgtggacagaagtaagaggaaaagtgtaacacttgtgttatgaggtctgggagagctgaggccactccccctgttttacaggaggaaggtcctaagcagtggcctcgcccagtcagccaacctccagtttcacccacgagaatggtgggcctgagaccaagagaaggccattattcagtcatgttgaagtgcggggcgctgcctaagaacctagctcctaggctccccacatcactgcagggcaggcattagtcaccacttttagagctgaagagaatgagtctttggttaagtgttgaaatagaagtacagttcagatctcaaaataaagacctttgtcttacgaccgcatctccaggccagtggcctgggagccagagagagcttgttctctgatgcccagggccctgctcttcctccccatcagtaggaaacgatggccttggaggcttattttgctcatcactctcgccccactgctgtaaataacagaatggccctcgctctgcggtttctagaccctggcactgtttttcaaacttgactgtcatagagaccgctgctaaaaggaactgtctgcacgtccgtctgggtccattctcctactcatgaccagtggtggaaattttaggttgtttgaaaaaatgtcttttaatggcaaattaacattcaagaagagtaattagacttaataactggaaggcttttttagtccatcacttaaaacacaaacgtggaaaatgtcacagaactcttggcccatgtagcgcatgcatctgtcccatttctatacttttatctgagtgttccaggttacacttgttttaaataagagaagaaagagggagaaattgttcatagtagctgcatggttaacggtgttagctagtttgaatcagatttctaaatcagaccaaaaaaaccccaaaaaacaaaaacccagaaaacagactagatggtgcttttgaataggaataatatataaaccattgatctcaaaacactaaaaactagtatatgctcatcagtcagtgaattagctttttactctaaacttaagagtaagttttgctttacttttagaaacttttagaaccaaacatgggaactcatgtaatctaagtaacttagtagtgaaactctattctgctccccattgggggaaaaaaaagcatatgcttggtagaaagaatgttagaacttgaaagtagaaagaaatgttagaactcgaatcaggcaaggtaccatcagggctcagagccacactggtaattcgaatggcggaaatttcatagaattgttggagaggtgtttaggatcctccagagaaacgaacccataggttagagagagatatatagaaccagatttattatagggatttgtttatgcaatgatggaggcctagaagtcccatgatctgctttctgcaagctggaggccccggaaagtggtggtggagttccagcccaaacccgaagtcctgagagccaggggagccagtggcgtaaagtcccagtgggagactgaaggcccgggaaccaggggcagtgacgtgtgagggcaagagaaatggatcctggctcatgaagagggaaaggggatttgcccttcctctgtctacctctttgttctctccaggctctaagtggattggatgatgcctaagaggcttaagagggcggctcttctttccttagttcactgattcaaatgccagtgtcttccagaaacacccccacagacaaacccagaaataatgttttactagctacccatctgggcatcccttcagcagtcaagtggacatgtaaaactcaccagaggggctgaaaggagatgtgtacagaggggcagctgcagcaagccgctggcgcaggagcatgaggaaggagctgagagcagcgcagcctgcctgctgctgagattcgaccgcagggagcgggtgtacatgccgcagggacgcaagacctgccagtgctggacagagtggccatccacaaagtcctctgaggtcagcaggaggggccctgcatgccgacccaccggctgtgccacctggaaaaccacatgctggagaagaaaaggaatgcttgcagtccctccagcaccctctgttggcaaagcctggcatcaagcgtcacccaggatttcagagcagggcagggcgaggtctgcatctgagaagcagcaccttcacacctcctccacgctgctcccagagccatctttccaaaatgtgaaattcattctggcatccccctaccagaggatcttcatggctgtcaaacagaaagtgtttcaactttttattttgcagtagttttagagtttcgcagcaaagttgtaaaaatgatacagcattctcaaataccactcctccaacttcctgagtgttaacatcttctgtaacattgtagcacagttaccaaaaccgggaaagtctttgggaggagctatgcaggctgtattcacactgcacgttttcccatgaatgcctttcttctgttccaggacccagcattgcattcagatcctgtctctttaggctccttccttctgcgacggttcctcagtctttccttcgatgatctggacactttcaaagagtgcctttaagttcttttgtaaaatgttcctaaattctggttttctgtcaggttagtacatttttggccagaattccatagacacaacactgtgtccttctgtgttagtctccttgggcagccgtaataaaatacacaaaccaagtggctcaggcaacagacatttgtttcctcactgtttctgagggtgcattccaaggtcaaggtgcgggcaggatgggattctcccgagggcttccttccctcagaggcttgtggatgacatctctctgccgtgtcctcacacgctctttcctctgtgcgtgcgtgcaccggtgtctgtgtgtgtccaaatttcttcgtatgaggacaccagtcatgttagattagggctcaccctctagatctcatgttaactcagtcaccccactaaaggctcttgtcttcaaatgtggtcacattctgaggttataatggttagggcttcaatataggagttttaggggactgcagctcagcccatacatttcagtgggtcgcttatagatggggtatatgatgttgtctaattactggtgatattaactgtaatcacttggttacggggatgtctgccaagtttttccaccataaagtaactacttttcactttgtaattaatacatatcttggggacgataactttgagactgtgaaaatagggcatttctccttgaacttttacccatctttagcattcattccattggcctgcagcagttctgtggtgcttacctaatggtgattgtctgttcctttgtttcttccacatttgctaattggagttgttttgcaaggagaagctattccttctctgtatatcattcattcatgtctttttttttttttttttttttttttttttggagataggctcttgcactgtcatccaggctggagtgcagtggtgtgaatgtggctcactgcagcctctacctcctgggctcaggcaatcctcctgcctcagcctcctgagtagctgggactacaggcatgtgccaccacacctgactaatttttaatttttttctgtagagatagggtcttgctatgttgcccgtgctggtcttgaactccttggggtcaagcgatccacttgcctccacctcctaaaatgctgggattacaggcatgagccaccgcgccgggctcatttatgtctttatgcacttagatttttttttaactctatgtattataatccagtattcttattctgttactcagattgtcgtagctttggtcattggaagctcctgcagtttgggtcctatgtcctttcatcatgttttcccaatttcttattttcagctaccacaggacactcagggtgcatcttgaattttctttgctccagctctggagtcaggcacttgagggagcactgtttcattttattggcaaacggcatttagaaatgcacatgcggggcaacacgtgcttgttgccgttgcctctcgaacctctaggaggacaaagcttggaagtgcatgcctgtatcttagcccacacaaacctgcacatctatatatggatctctctgcatatgcagttaaaaatgagttcctattgatgaattccatttccagtttaacaccatagcattcattctaaccttcttcttttccttaattgttaactcctttctccagcagtgagaaatccatactccgctgtctgtaatacatttactcatttgctcaactctagtataacatcaaagtagtttcaaatttgctaacccaaatccctctgagaagcagctttattaactagaacacatgccagtgaactgtagcccatgggttcaatctggcccgcttgatgtttttgtaaataaagttttattggaacacagccccgcctatttgtttatatatcacgcatggttgcgagagagaccatatggcctccaaagctgaaaagctttactgtctgaccctttatggacatggtttgctgactcttaaagtccaagaatatagattttgtgtacggctctttttgtctttagctttatggtgtcccagtcaaaatactgttttccaagattgctttttcttttcacctccttcaatgtggttattttattcatttgtaattgagttagattaatttgttactgcttggattccatttttttgttccccatacacacatcctggttgattgtcattgtgtgttttggatgtgtgaaatattgatgtggcttccaagcgtgagagctgtgcaccagggtatacactcagaaaagcctcctcgttccagctttcccattcccattctgtacgccctccactccttttctacccaccctctgtgggtgaccagtctctttagtttctagtttgtctttcatgtatgttttgtgcaaatcaacagatacatatgtattttattgcattatctttcttaaaaaaaagagcaggtagtatggtataagatactcttctgcacttgacttttttcacttatcaatatgtcttggaaatcactcacatcagctcttaaagatcatcttcattttaaaaaatagccactccttcgtgtggatgtaccatagtttattcaaccactctcctatgtatggcatttagaatgtttctggtgtttgtaattataaacggtgttgcaatgaataaacttgtggatgtgtagttttatactgttggaggcctgccttcaggatagtttcttagatgtgggattgccagtttttaagagtactttgtatgatagggatattatattagtccttggtgatcctttgtatggtaggggtattatattagtccttggtgatattttgtatagtaggggtattatattagtccttggtgatcctttgtatggtaggggtattatattagtccttggtgatattttgtatggtaggggtattatattagtccttggcgatattttgtatggtaggggtattatattagtccttggcgatactttgtatggtaggggtattatattagtccttggcgatactttgtatggtaggggtattatattagtccttggcgatactttgtatggtaggggtattatattagtccttggcgatactttgtatggtaggggtattatattagtccttggcgatactttgtatggtaggggtattatattagtccttggcgatactttgtatggtaggggtattatattagtccttggcgatattttgtatggtaggggtattatgttagtccttggtgatattttgtatagtaggggtattatattagtccttggtgatattttgtatggtaggggtattatattagtccttggtgatgtttcttggacatactttctccccgttggcttttgactttgatcttggtgtatgtgtgtgtgtttatttttgcctttatgactcgcccttgcctacgggataatgacataatgcatagttgtctaagtgtgtgatgggttaccctttgccttttgttgtttgcattgtacttcctaactcctacttcacaagatttcagttcaggcatcagttccgaaatgatttctcaactagcatgagttaaagaaagagattatgttctgccttctcagagggtgctacttttaaaagttgtttgatcctcatggtaccctttaatgactccctgtgattatatgtctagtaccagttaactatgtcagagttactttcagattttatcagttgttgtgactgtatgggatgactcagtgttggacctgagactttgcctccaattttaatatatttcatgaatccatttccactaaaatcttttttgttttagtatataataaaatctacacatctcagttttgacttgcctggtgtcatagtccatttggagagctgtaacaaaatactataaactgggaggcttagaaataacataaatgtatgctcatagtcctgggggcccagaagtccaaggtcaaggcacccagcagattggtgcctggcgagggctgctctctgcccttctcacagtgtcctcacatggtggaagggactagccaggtctcttatcagggcaccaatcccattcatgagggcagagccttgtgccactctcctatgtatgagacctagttatttctcaaaagtctaaccttttagtaccatcatactagggattgggtttcaacataggaaattttgggggacacaaatattcagaccatagcaagtggtcatttgtgtctattcagttattgcaggcaattccttcagtaaatagagaaagagcttgtcaatgcatatcatcttgtgtcagatcagccgtacagaggtccatttactgggagctaatgaagcttcagtttcaggtctgacagaagtttttgatagttggcgttatagaggggacatttttgcatgctcattaattctttagtagttaagaaggatttcctctggaagcattaattagcaagaatatgaagtaaaagtaaaacatagtagaccatgtaaaaacttcctgaactatgttgcatagataatactaaagatagaactagcagttgtttatttttaataagctctctagacttaaactattttaaataaaaacagagcacctgacttaaaatagcatttttaaaagtacctcttcagtagtaataggctgtcactgctagcttattggttattttccctcagctcttgctctcttctggtcagttatggattcttgtttgaggagaggagctggcaacactagttggccctctctgtacttaacatcatgaggctcctagaatttagtaaggagatactcaaaagtagtctatatgggtttttaaaaactagcttttaattacacaagtactcaatgacattattctttttttttttttttttttgagacagggtctctgtcatccaggccataatgcagtggtgccattatagctcactgcagcctcaaactcttggcctcgagtgatcttcctgccctgcctttccaaagctctgggattacaggcatgagccaccacccctggcctctctcttctttaacaaatactaaattaatttatttagtttagagatgggtctcactgttacccgggctggtctggaacattataaagactcctgttggccatctcacttgactgttgtcttccaccctcttccccattcatcagctcttagtgttggtctcccctggaaccttccacatcatctcctgtgcctttgctgtctgcagggtggtccatggactggcagcagcatcaagcttgctggagttggttagaaatgcagactctgaggcaccgccccaatccagttgaattggaatctgcatcttaacaagatctttggtgatttgtagggacatggttttgtatacatgttttctatagtgaacatagaaagtactgccaatgtgtgtttagaatgtacacaaacgatatgatgtaactttttccatcaacaagatgccctagatacctctaaagatcactctgtgtggtgtgtgtagacctgtctcattctttcttagttgcttcctaactttacttctgcagtgttaaatgattagtcacttccccattgaaggacattaaggttgtctgcagcttttgtttttttgggatgtccggtgtagcggtgaactcactctagggcacgtcttgtgtacatgtgcccagaaagtagctggatagaagagtgtgaacatttttaacttaaacatcctgctaaattgccctccaaactggttgtatcaatctgactcttactttgtttcagtgatcaatttacatagtctttattctttataacattgttttaatggccatagcattataatgttttcatatcaagttgcctatccctcccctttgctgtaattcttcaaaattatattggcttttaaagaaattccacagtcttctataggaaatttaaaatcagcctgtcaagttctgtgaaaaattctagtagggatttttttttttcatggctgaagattgtattgaatttctagattaatttgggttggagactaggtatgtgaagtgttgagccttctgatactcatctctgaacatggtatttctcccaatttacttgtcttcttctgtccttgagtaaagttttatagctgaatgtataggtatatgtgcatttgtatgtgtgtgttgtgtattgtagttttgtctgttttcttttagatttattcttaggttgtttttctagctattacgaataggattttcaaaaagactgatttctaattgattgccgttgtataggaaaatcactaagttttcatatgtttaccttgttcctttgctggacactgttttaatggtcagttagagctctaggattttggagtcggcagtcttctaccttcgaattaattatagttcgtacttgcttttccttgtgtttatgcatccatttcattttctcatctggtgtaggctgggaacttccaggaccattttgagtagtaacatggtagagaacactgccgtcgtcatcttcgcctactggagtgcttctagtgtttcaccattgaagtatgagcattcccaaaaatgtctagttgtagatattctatccagatttgctggcgaagaggtctttgttactttttaaaatcatgagtgggttttaatttgatggtgtgcttttgcagcatccgctgatattcttaggttttctcctgtatctaatgatggtagtgacagattttctaggactgaattaccctgttatttcagggacttactctactgggttatcatttattcttctgccactgatggattcattttgctaaattatgtgtttaggatgtgtaaatatctgctgtgagattgacggatccatttgtgcatgtgtgtgtatatgtgcacatgctgttctggttttattttatccgattgttattagaatctaattagttgtttcttgatgttttggtggaatttgcctcaagtttctatctcagacttgtaaacagaattgttggtgcaatttgttttttcgtttttctgttttttttcaagacaggatcttgctctgtagcccaggctggaagtgctgtggtgcgattatggctcactgcagccacagcctcccaggctccaacgatccttccacctcagcctcccggctggaactacagaagtgtgccactatgcctggctaattttttttttttttttttttgtagaaacaggattttaccacattgcctaggttggtcttgaactccagcttgaactcaagtgatccacccaccttggcctctcaaagcattgggattacaggataagccactgcacctggccaagtattttttatttctaataacaatgaacttttggtgcatctggataggtagcattcccattattttcatttccacattgagttaaaattatttttggcaaacttttgggaacaaaacattttcttaaaatgttgaagtaagttttcttaaactttcttaaaatgttgaagtaagttttcttaaactttgtgtaagcagctatttttatgttagttaattattttagagttgaaatcatgagaggggaaaaacaacctttaagtaattgacttgaacctattagaaagtgaaactgaacaggtattttactgttcatggagcatatgcagagtcaacctaagaggtcaaaggaatttaacttataacaagaggaagttctgcttcagttcactgtgaggacttaatattagaaaagtagagtttacagacaaatttagtattttgttattgttgttgttttggagacagggtcttgttctgttgcccaggctggagtccagtggtgcagtcctggctcatactgcagcctccacctccaaggttcaagcaattctcgtgccccagcctccctggtagctaggattacagccggctaccatgcctggctaatttttgtatttttagtagagatggggttttaccatgttggccaggctgctctcgaactccttgcctcaaatgatctgcccgcctcagcctcccaaagtgctggaattacaggtgggagccaccccacccagcccaaatttaggattgagaatagatcctacagatgtgccatgtgggattcatgtcagcttgttgtagggttttgatggaatccattcaaagaagagggagaggatgaagagagccagccagattaaggggcagtgttgtagggtctgccagtcccttggtaacagatctcttattcagaaatattctcatttttcctggtttgtgacccttagtttgccttctcttcaatcccaaagtccgatttttaaagctgccagtaggaacttgagctttaatagtacatgcttatgcttttatactagtaataacaaatacttacagatggaaataggatatgtctgtgttctcaccctccctcaaccctaaccttccagaatatgcctgaatatgtatgtatgtgtatatatgcatatgtttatgtatatatcgtgtatcacataaatagatttttaaacatgcaccagaggtttatataaatatagctataagccttttaattttggaacttaagaatattttgtatgtcactatgtagtcagttaccacatatcaaccttctctacttaagagcctcatagttttattccttagtgtagaatactgtcatttagccatttctctgttgatttttaggttgtttacagttttttccaatagacttactatgtcagaaggaacacacatttaaaaaatctgtataaccagattgccttccagtgtatttgttcatactcacagattgagtgcctgccttcctgcatgtgtatcaatactggttattatcagtctttaatttttgctaatctaatggacagaaattggcatgtgattgttgtaatagtgagatttcacttttttttttttttttttttaccttttttttttcccttgtccaaggtgtgcctatttaatgttcttcgatcaggcagttggcactttccatattatattcagtggtcccgtgtcagcattttctcctaatttactgcctgttttggcttttaaaaatatatgtattttttgctctacagaatgtgtttatcatcaactctttctttatgacagctggcttgtgtgtcttggttaaaaagtccttttctttatcaacattataaacaccctcctatattttctttgagtatttttataggttttttttttttttgacgttatcctattggaggatattattgtttatgtttgggaacatagagattgagctttaaaatttttccacgtgaaataaccagttgccccaatagtttattgaatttcatgttttaaaaatgctacccgttggcatacactaaatttctgtatatttctgaagtttctgttcagcttcatattcagtagcagtggcagagctgtcgttaccccagctgtagaggacgcactgagcatcaagcacgcaaatctctcgcgtccctgttttttttttttgtcaaaattctcttgattatttttgtgtatgtaggttgactttaagagttttattttggattttgtaagtagtaaaggggttgcattttacaaagccaaaaatacaaatagccccaagaaactactactacgaagatttatttttatttcccatctgctgggtattgttttaagtactttgcagatattgttacagaagaagcagttatactttgatttatttttctttctttcttttttttttttttttttaatggagtctcactctgtcaccaaggctagagtgcacagtagcacagtcttggctcactgcaacctccacctcccaggctcaggcagtccttccacctcagcctcctgaattgctgggactaccaccatgcctggctaatttttgtatttttagtagagacggggttttgcgatgttgcccaggcttgtcttgaactcctgagctcaagtgatctgtccatctcagcctcccaaagtgctgggattacaggcatgagccactgtgcccagcctatattttgatttcatagtgagcaaaaaattggtctgattgcatgactgtagtggggaaatgataataagctgacacctatgtgttttagctgagacagtataaaattgtgtctagtatagatttgaggtgtactgaggttccacttgcccctcaagggacacccccaattctcatatacccaccttgaacacagttaacagtgtttgtgtcctgctttttataagtcatgagcatttcctgatatcatcaaaatgcttttagaaatacaactaataaatatattgtgtcttgcctgttgtattgttgcgaaatctagttattcctacaggcattgtatttttttggtggtatctttcttttgcagttgtgttgtatgtgaaagagtatgtcacctgtgaggtatggagcctcctaaagagacctgggagccagctaacttcagccggagcctaatactcatgcattgaactgtgtgctctttccctcaggcctttaattacaggtacacagttacaagtaatactgtgacctactcttcaatcaccctttcctttttaagagaattaaaaaaaaaaaaaactgtgaaattcctggatcagaagccatggcttttgtcagagccagctactcactcccaccggcagtacctgagtgaccatctgaacattcccttacgagccaccactagacagtacattcaaaacttagctcatttgatagaaaagtgttatcttttaatttgcatttcttagctcactagaaggtaagtgatgtgggaatttttgttaaagttagtatttttatcattttaaacttttaagtctgtaatttacatatctggactttattctgcccagtgttgtgtcttgagggcctaaatctcataatcaattagccaccgtttttgtattattcatgactcatcgtgacttccaaagtttaaacttctgtgtgtactagggtttgttttgggctggttgctgcgtcagaattagatgaatttgtctgtagtctcattgcttgagacaaaatatcttctaaagaaactgaaataacatctttttcatattaaaaacgtttaggcattggcacttcttgttttgtggctacaactaaagttgtattttgtcagcctttaaatgcttaagtaagatagtagctatttacatttaatatggaaaagaggccaggtacagtggctcacgcctgtaatcccagaactttgggaggctgaggcgggcagattgcttgagcccagggttcaagaccagccttggcaacatggcaaaaccacttctctacaaaaaatacaaaaatcagctgggtatggtggcacatacaggtagtcctagctacttgggaggctgagatgggaggatcacttgagcctggaggtcgaggctgcagtgagtggagattgtgccactgcattctagcctgggtgataaagtgagcccctgtctcaaaaaataaaataaaatataaaataaaataaaatggaaaacaccaagaaaaggagtgtgggcaatataaatggtattgatattgttaaacctttctaagaaagattgtttctatgaaagggagattttctaagccttttgaaggtgtttgatacctccctgtgttaatgcggtgtgaggtatgtacagtgaacagctgaattagtcagcagtctttgcccttagttgattgtgcggaccttgggggtgttagaattttcttcagtgtgagtctgagattggagatgtattcattagatgcatagagtttattgacttttgggccacaatttgattgtcttccatgagcaaatggacatttctcttgtgggtgccttgttttcctactcatattatgcttatcctgctttgtctgggcatttttatcaccagattaattttccttcttcaggagggaggcacagttgtattccgtagtagagatgctaaatgggtaaggtgtgaaagctgactctgaccacaattgcttagcatgaaaactgtggatgtaaaaatcatgttaacttgagtgtaactgtatcaccaggtgactgaggagagaggcacgagggcttatttattcagttactttttctttttccagggattgatcccttcctgcctttaagaccacaggtctgttgtaaaagttaatgcaggtgcggtgtcactgctatcctctctgtaggtccctgtgaattgggagtgcttcctgataccccacagaggtgagcactgggagtctgagtattgtccataaatccaactgtttttataccttgataatggaaatgctacctggctctttttctttttaggttcgttctctctctctctctctctctctctctctctctctctctctctctctgtgtgtgtgtgtgtgtgtgtagctcttcaccagtttttcatttttcgtgaatagggatgttatttatgtgcattggatttaatgcttttattataaatcattaaagtcttacttgtatgttgaaatttggggatactttattcatactcaactcatagaagtaaagaattacgtgtgtcaatcattggttctcaagcttcctttgttaagatgttcccactccctcattggacaggtggctgaggggtttgcccagacttaaaaatttgtcatgtctaccagatagtggtggcttctgccctttttctttctggtctgttgacaaccttcatgtattgggaacttgctgtttttggggtccagctcattgctttaaaggtatcatcatgacaacatcttgaggctcaggtatctgcaattttgtagttaagaacttcaggtcagagaggttactagtgatgccatcttccttgatctctgcttatttcttctctgatctcataatctgatatcaggtgtttatgacagtggttttcagagggggaggtagatcaaattcaccctcaagggacatttggcaatgtctggagacattttgtgatggtcatagccaggttggggttgaggggctgtgctcctggcatcttatgggtagaggccagggattctgctgaacatcctgccatgcataggatggccccacaccaagagttacctggccccagatgccagtagtgctgaagtcaagaaaccctgtgttatgagaatgtaccagatactggtggtggagtggaaggtctggtggtgacttcagcaggacaagagttgttaagggaggctgagtagccagagaaatgaggagaggggccatcctaggccgtggtggggaatgcaggctgattcctaatccatctccctctgtgttctctgtggtgattcatcctatggccacacagatgcacagagagctcttagagccacagatgccagcacagagagctagattttccccaaaagtgcataaatgcacccaacaggtagattttaaagtgtggtttttcagcagttgtagcatttccctgttatttcagggctctgaatatacctctgtgacttgaaagtgatcgtgaaaaatacctgatttactctgtggtgagacaacagatgttaaagacagcttccctgatgttaggctataaagctaggcgtttctccctcctcacagcaaagttttacatatcaggttcaactttctgaacccagcttgtaccacggtaaagagatgggttcctctgagggttgggttctgctattttcctctctctctctctggcagcatcggacctttggggtcctgaggtttggctcttggaccttcgggaggcatcccagtgagggaatcgagggactttgatcttcaccacagccctctcactagtggatgttatgttctcccccaccagattgtatttaagaagaggctgcatagacaggaaaactttgaggagctatatgaaggaaaacaggaccaaattaaaccagttcccttgtgagtgcactgggaagtgattggaagtgatgcccacaagatgactgagataccttaattgcaggtgtggaaacagtcctgcaaaacgcctgtgaaaatagaaatatagtggacactaaggcagagcggcagcctgcagcgtgcagaaacacgggaatcatgagacatcttgaaatctgtaaaacatccgcaggccttgactcacatctggaatgtgacatccacaaccagaattgtcttacatcttactcagttcttggcacagaataggtttcagtattaatagcagtgggagccatctttacattttctaacctggcttttgattgtattcatcttattaatgatgtcatgtagaatctcattttacctttatcattattcatttctttcttgccttttcatctttgtggttctagtgcctttatggtccaagtgaaagttgaggtatacaaaatataaatcttaggagaacagctctctgaagaaaaaagcacaacaaaatgtaaatcagaggagaggtgattatcatggtcatatgggaattctttttttttttttttttttttttttttttgagacggagtctcactctcactctgtcgcccaggctggagtgcagtggtgtgatctcggcttactgcaacctctacctcccgggttcaagtgattctcctgcctcagccaccccacgcccagtcggtcatatgggaattcttcatataaaagcattccttgtggcccggcgtggtggctcatgcctgtaatcccggcactttggggggccgaagcgggcggatcacttgagctcaggagtttgaggccatcctggccaacatggtgaaaccccgtctctactaataatacaaaaattggtgggcgtggtggcatgcacctgtaatcccagctattcaggaggctgaggcatgagaatcacttgaataactcgggaggcggaggttgcagtgaactgagatcacaccactgtactccagcctgggctctagagcaagactgtatctcgggggaaaaaaaaaaagcgatccttgggtttccatgtgttcctaatatttgtggcttaccagatttaaagcatgctcctttcagagtacatagattaaaatatgcacctacattgtccatttgaggtaattgtagccatataataattttccaaattttagttgttcttggtggttgttgcaataacgtatgtaccagccaaatggttacttttttctttaagtaaatcagctttttatttatttatttttttgagatagggttttgctctgtcacctaggctggagtgcagtggtgtcaatggctcactacaaccttgacctcgtgggctcaaacgatcctcccaactcagcttcctgagtagctaggactacaggtgcacaccacagtgcctggcaaatttttcttttctttattttttttttctttctgtagagatggggttggcggggggcatctcactgtgtcacccaggctggtcttgaactcctgggctcaggtgattcacccacctcagcctcccaaagtgttgggattgtagatgtgagccactgtgcccggcaaaatcagcttcttaacagccttttcttttaaacgtaaatattattttgccataaatggagtatcattcagcttaaatagaaatataaaaagcattaacaaagctacaaatttaatctggggggaaaaaatcaatggtaccattcatctgttaatagttttggaataaccagcctgagagtcaattcacatgtgtacacttgtaaagtataaaagctattttaccattttctttattttggttgaataccaataatttctaatcctggcaatgagggtggcttgggtctccaggagccaccagcagccattctctggaatctatctgaatgtgtcaaagtatgtgtgtagtatccagacagtgggataagagggccctttgccacacattgctgccatctgctatggaaaatgaaaccctatttcatgtgttttcagttctcttcataatgtgcaaaatattttcagtgagttttcagattaatatttgtctcagtcatgtagacaacaacaaaaccgtcctgtgttttgttgttcagatgtgaccccacaggtctacttctgtgctcacaagggaatttctctcttcttgcatgtccagtaccaccttgtaaggataaattcaggtgctttaaatgaacaaataacttagcagaatacactgattcctgaagcctgcccaattccttctgtgctctgacgtagacatggctgtgcattgtcgtaagaagtcgacaccacctatctctatagaaagcagaggggaaaagtgcaggattcagcagcttttcttaacaaattgtaacattttgagttggcttccatatataaacaaggagtagataagtttattttagcattttagcaaaaacacttagtaatttagtatatttccgtgacatttacctttaagactctttttaattacctaattgatcttatccatgatgggttcaacacaaagaacaaatattcagagaacagtcccaattccatttccaaattatgtatacttaaacataacatacctactaaaatattgctggcttctaggggtgacttttggtctgtcactggtaagagtgcatggatacacatggaaagtcagtgttcagaaatcttgattggcattcatgcatgccttccatactatctgtagtccttttctcttgtaataaaatacatgtaacctaacatttgccattataacaattttaagtatataattccctgacgttaatcacaatgttgtatttgtatctccaaaacttttaaattcccccaaacagaaactttgtaaccgtaaaatgtatgtaacctaacatttgccattataaccattttaagtatacaattccatgatgttaatccaatgttgtatttgtatctccaaaacttttaaattcccccaaacagaaactttgtaaccggtaaaatatacgtaacctaacatttgccattataacaatttgaaatgtacaattccatgatattaatcacaatgttatatttgtatttgtattttatttgtctctccaaaactctttaatttccccaaacagaaactctgtaaccattatgtaaaaactccccattcgcttcccccagtccctggaaatctctattctactttctgcctcagtgaatttgcctattctagatatttgatataagggagatcttgtagtatttgtccttttgtgtctggcttccttcacttagcataatgttttcaaggttcatccgtgttccagcatgtatcagcactttattcctgtttatgactgaataatactcttacatagatacaccacattttatgtatccattcatcttagtggacatatgcgttgtttccatattttggctactgtgaatgctaccatgtaccttgataattccagtatataattgagtccctgttttcaggtatttggtatatatgtctaggagtgggtcctgtgggttgcatggtggatcattgttgggtcatatggtaattcgatgtttaactttttgaggagctgtcaaactattttacacaatgaccacaccattttacatttccactagcagcgctcggctcggcagcacttattttccatttttaaaattatagtcatcctcatagatttaaagtagtatttcattgtgattttgatttgcattttcctaatgagtacgatgagcatcacttgatatgcttattagctatttgtatgtcttctttggagaaatgtctagtcctttgcccatttttcattgggttatttgtcattgttgttgagttttgttgagttctttatatattctggttattaagcccttaccttaccagatatgatttgcaaatatttttatgttggcttttcacttgcttgataatgtcctttgaaacacacaagtttttaattggttaaagttcagtttacctatttttttttcttttgctgttcatcctttgggtgacatatccaactgtttctttttcaagattgttttgactttctgggaccttttgcaagtccatatgaatttgagtacaagcttttccgtttctgcaaaaaaggctgttggattttttttttctttgaaacagagtctcactctgttgcccaggctggagtgtggtggcatgatctcggctcactgcaacctccatctcctgagttcaagcaatttttgtgcctcagcctcctgagtagctgagattacaggtgcccaccaccaagcccagctaatttttgtatttttagtagagacagggttttaccatgttggtcaggctgttctcgaactcctgacctcaggtgatccgccagcctcggcctcccaaagtgctgggatttcaggcatgaatcaccgtgccccactagctgttggaattttgataggccttgcatgaacctatcacttttggttagcatgcattgctagtatatagaaacactctgatttttgtgtgttatcctgcaactttgctgaatttattagctttagtagcattcctgtggatttttcaggattttctatatataggatcgtgtcctatatatagaattgtgaatgagtagtgatagttttacttcttttcaatttggatgccgtttgttttttgtctaattactctggctataacttccagttatacacttcacaattgagtgtattagctgtgagtttttcataaatgtccttatcatgttgaggaagttctcttctattcccagtgtgttgaatgttttaatcatgagttagattttatcagtgccttttctgcattgattgaggtgatcctgtggttttcctttctttgatttttctaatgcaatatattacattgattgattttctcatattaaaccacccttgtattcctgggataaatcccatttggttataatccttttagatgttagatttggtttgctcgaacagccaatcctcattattcatggattccatatttgcctatttgctaaaatttatttgtaacccaaaaattaataatgcagtggtttcatggtcatttatacatacacctagaatggcaaaaaaaaaaaaaaaaaagagagtcacctgacacacatcttcctagctgagactgcccataacaacacactgccttgtttcagctgtgagaccaccagcgggtggaagtgatgggggtaatgcagtgtagtaccaaaacctttggcctcagagccacttgaagtggtttaaatctcaactctggcacctgttagtgggacggtctcaggcaagtcacttaacatttttgagtttcattttctccattctgtaaaatagaatcgactaggatcagttgtttgtaggattataatctatgtgagatatgtgtgtgcatatttaccttatgagcaggtggtttagtatccattgattcaatggtcctcacctttatttctaattttagttatttgtgtcttttctttttttctctgtccagctaatggtttctcaatttttattgagttcttcaaataaccaactcttaatttcattgatttttcttttcttctattctctatgtatcttacccgtaatctttattattttcatccttctggtaccttcgggtttactttgctcttctttttctagctccttaaggtgtaaagttaggctgctgacatgagatctttttttcttttttaatgtaacctttacatctataaactttcctctgaccactgccttcactacattgcatactttttctgtgttgtgattttgttttcatgcatccctaagtgtcttctactttcccttgtgatttcttttttgacccatggttgttgaaggagggtgttgttttaatttccacatatttgtggattttcccatttttcttttggtgttaatttctagcttcattccacaagataactttgtaagatttcaatttcttaaaatgtgagacttgttatgaggtctgacatttggtctgttctggaaaatgattcatatgcacttaagaaggtatattctgctgtttggtgaagtgttaggtctagttggtttatagtgttgtgcaagtcctgttttgatcttctagataatctgtcctgtactgaaaatgtagtgtattgaattctccaactgttattgtaaagctatctttttcccttcagctttgtcaatatttgcttcatgtattttggagcactgttgtttggtgcttacatgtttataattgttatattttcttgttgaactggcctttatgtcaccatcttttgtgtcttgttacagtttttgacttaaagtctgttttgtctgatattagtgtagccacctccagctttctcttgcttactatttacatttaatatattttttactactttccctttcaacctttttgtttttgaatcttgagtttcctgtagataacatatagttatataatgtttttatatccattctgccagtctctgccttctgtcagaaaagtttaatttacatttcaagttactactgacaagcacttcttccatgttgctatttgttttctgccttatacttttgttcctcattgccttaattactaccatttgtgattagttgatcttttttctttttaataatggattgtttggattcccttctcatttccttttgaatatatagcttttagatattttctttgtggttatcatgggaattatatgtaatatccacaattgatgttgttgtttaagtcaatatcagcttcaatagcatacaaatgtctgtctatacagctccatctgctccctttatgttcttacaaagtacatattttatgcattgtgtgctcaataacatggattgataattatttttcatgcatttgtccttttttttcttttttgagacagagcctcactctgtcacccaggctggagcgcagtggcatgatctcggctcactgaaacctctgtttcccagggtcaagtgatctcctgcctcagcctcccgagtagctgggattacaggcatgtgccaccacgcctagctaatttttggattttaagtagagacggggtttcaccatgttgactaggctggtctcaaactcctgaccttaagtgatccgcccacctcgtcctcccaaagtgttggaattacaggcgggagccatcgcacccagcctgtgtatttctcttaagtcatgtgtgaaagaaaaagtacattcaaaattcctaaatacagtactactggcttttatatttgctcatgtatttaccattaccagagagctttatttctttttcagctttgagttactgtttagcatgctttcacttgaagcatttctttcagggaaagtctagtggtgatgaacttcctcagcttttatttatctgggaatgtcttactttccccctcagtttcaacgttagtttgctggatataggacttttaacaggttttttttttaactttcagctttttttttttttttttttttaagagattgggtcttgctctgttgcccaggctggagtgcggtggcatgatcatagctcactgtaagcctcaaactcctgggctcaagtgatctcctgcctcagcctcccaagtagctgggactccaggtgcacaccaccatgcctggcttcagcattttaaatatgttgttccattgatttctaccttccatgatttctgttgagaaatcagctattaatcttattaaggataccttgtgcttgtcaagtcacctcctgctgcttttaggattttctttttgtcttttgcttccaatagtttgattatgatgtgtctcagtgtggatctttttgagcttattcggcttggaattgattggctttggataagtaaatcatgtctttcttcagatttaggaagctttgtccattatttatttagataatcactttgtccctttcttttctcccaagtcttccataatttatttgttggtatgcatgatggtgtcctgctagcctactaggctctgttcattttttctttattttctttactttctacttttcagattcagtaattttaattgtgctatcttcaagttcgttgattaatttttttctgttaaaaactttctgagcctctctagtgaattttttatttcaattatgtacgtttcagctccagaatgtttgcttggttcctttataaaatgtgtttctttattttgtttataaattgttctgatttccttcagttcttcatatctttcttttgctttttgagcttatttaagacagtctgcctgggtttccttctggctggtttctgtcaattattttattattttgaatgaattgtacttccctatttctttatatgctttgtggggtttttgttgttgttactgttgaaaactgcacatttgacattataatgtaattctggaaatcagattttcttccttgttttgctgggatttttttgttgttgttgttgaaggctagaattggctgtttagtgacatttccacactattctgtagagactgtattccttattgtttgtggtcactgaagcctctgttcctcagattgtgttccactgtgttttggcagagatttctttggaagcctggagctaagcaaacaaaacaaaacaaaacagagcacttctcctagtttttgcatttaactctgtgactccaggtttgcattgagccaggtgatcagtctgaggtgaaagccgagaaacttctcaggtctttctgagcgtgcatcttgccctgggcttgtgcatggctgtctttccccttacacccacatgctttagaatgtcctgatcttccaaagaaactctcctgcagcttttctgggggtgcctgtggacttgtttgtatatctcaacttgatcatttagcctaggtgtttgtgggtgttagtttgtgaacaatctcccccatttttctggcttaagggcccaagttcagatgtcgtgccgtggtcttctagatagccttcagtcaggttagaacatacctacacaattatttgtgaataaggttggctgtgctccctctagaaccaggaaccagggactttcccactgggaatgcaggctgtcaggccagggaggcacagcaagtacaagtaaaaataccacaaacctttcctgtaattttgaagttgctagcttcttgattcaatgttcacttgtctgctgccaatctttgacttatttccagagtcctgataatgttggttgtaagaataattgctgttttttggaaatgtttctgtatgagaagtcagagcttcctactctaccaagtctgcccctgtctgtacatctgaatggttgtggtggaaagtcactgacaattttcaatattcaaggtgtgcgtaagcaccatccctgcaactgtgagtctgtgtaaaagggcttatcaccgcactacccatttaaacaattggcgctggcttatgattcttctaattatataataaacagtgttaataaatctaaatattcatccttatgccatctagaagtcatctggtggaccactaggaggatgtacatcatgctttgggaaactctcttctgccataagtacagatcttggctggcattgatagttttccttccccagccccctgctatattctagatcaggctaccccattgtgtctgtggtcacagccacatttactggcaggcactccacaactcaggaatagtttgtgttctgaagctttttgttatttttaaattggtgcttgatctggaaactttgaaatatgttattcataaggcttaggtttcttttatttatttattttaattttttattttttcattattatactttaagttttagggtacatgtgcacaatgtgcaggttagtgacatatgtatacatgtgacatgctggtgcactgcacccactaactcgtcatctagcattaggtatatctcccaatgctatccctcccccctccccccaccccacaacaggccccagagtgtgatgttccccttcctgtgtccatgtgttttcattgttcaattcccacctatgagtgagaatatgcggtgtttggttttttgttcttgcgatagtttactgagaatgatgatttgcagtttcatccatgtccctacaaaggacctgagctcatcattttttatggctgcatagtattccatggtgtatatgtgccacattttcttaatccagtctatcattgttggacattagggttggttccaagtctttgctattgtgaatagtgccgcaataaacatacttgtgcatgtgtctttatagcagcatgatttatagtcctttgggtatatccccagtaatgggatggctgggtcaaatggtatttctagttctagatccctgaggaattaatgcctaggttttcttctagggtttttatggttttaggtctaacatttaagtctttaatccatcttgaattgatttttgtataaggtgtaaggaagggatccagtttcagctttctacatatggctagccagttttccctgcaccatttattaaatagggaatcctttccccattgcttgtttttctcaggtttgtcaaagatcagatagttgtagatatgcggcattatttctgagagctctgttctgttccattgatctatatctctgttttggtaccagtaccatgctgttttggttactgtagccttgtagtatagtttgacgtcaggtggcgtgatgcctccagctttgttcttttggcttaggaatgacttggcgatgcgggctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttgtatcctctttaatttcattgagcagtggtttgtagttctccttgaagagacccttcacgtccgttgtaaggtggattcctaagtgttttattctctttgtagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagatgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgtccattcagtatgttattggctgtgggtttgtcatagatagctcttattattttgagataagtcccatcaatacctaatttattgagagtttttagcatgaagcattgttgagttttgtcaaaggccttttctgcatctattgagataatcatgtggtttttgtctttggctctgtttatatgctggattacatttattgatttgcgtatattgaaccagtcttgcatcccagggatgaagcccacttgatcatggtgaataagctttttgatgtgctgctggattcgttttgccagtattttattgaggatttttgcatcaatgttcatcaaggatattggtctaaaattctcttttttggttgtgtctctgcctggctttggtatcagaatgatgctggcctcataaaatgagttagggaggattccctctttttctactgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatatcccctttatcattttttattgcgtctatttgattcttctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagagtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtccccagtagtcattcaggagcaggttgttcagtttccatgtagttgagtggttttgagtgagtttcttaatcctgagttctagtttgattgcactgtggtctgagagatagtttgttacaatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtcttgttgatctgtctaatgttgacagtggggtattaaagtctcccattattattgtgtgggagtctaagtctctttttagatcactcaggacttgctttatgaatctgggtgctcctgtattgggtgcatatatatttaggatagttagctcttcttgttgaattgatccctttaccattatgtaatggccttctttgtctcctttgatctttgttggtttaaagtctgttttatccgagactaggattgcaacccctgcctttttttgttttccatttgcttggtagatcttcctccatccttttattttgagcctatgtgtgtctctgcatgtgagatgggtttcctgaatacaacacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtcttgatggtctttacattttggcatgattttgcagcggctggtaccagttgttcctttccatgtttagtgcttctttcaggagctcttttaggacaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttgattccattctccctgtcactttcaggtacaccagtcagacgtagatttggtcttttcacatagtcccatatttcttggaggctttgttcatttctttttatttttttttctctaaacttcctttctcgcttcatttcattcatttcatcttccatcgctgataccctttcttccagttgatcacatcggctcctgaggcttctgtattcttcacgtagttctcgagccttggctttcagctccatcagcccctttaagcacttctctgtattggttattctagttatacattcgtctaaattttttttgaagtttttaacttctttgcctttggtttgaatttcctcctgtagctcgtagtttgatcgtctgaagccttcttttctcaactcgtcaaagtcattctccgtccagctttgttccattgctggtgaggaactgcgatcctttggaggaggagaggtgctctgctttttagagtttccagtttttgtgctctgttttttccccatctttgtggttttatctacttttggactttgatgatggtgatatacagatgggtttttggtgtggatgtcctttctgtttgttagttttctttctaacagacaggaccctcagctgcaggtctgttggagtttgctagaggtccactccagaccctgtttgcctgggtatcagcagtggtgtctgcagaacagtggtttatcatgaaccacgaatgctgctgtctgatcgttcccctggaagttttgtctcagaggagtacccggccatgtgagatgtcagtccgcccctactggggagtgcctcccagttaggctgctcaggggtcaggggtcagggacccacttgaggaggcagtctgccagttctcagatctccagctgcgtgctgggagaaccactgctctcttcaaagctgtcagacagggacatttaagtctgcagagcttactgctgtctttttgtttgtctgtgccctgcccccagaggtggagcctacagaggcaggcaggcaatcctccttgagctgtggtgggctccacccagttggagcttccaggctgctttgtttacctaagcaagcctgggcactggccggcgtccctctcccagcctcgttgccgccttgcagtttgatctcagactgctgtgctagcagtcagcgagactccgtgggcgcaggaccctccgagccaggtgcgggatataatctcctggtgcgccattttttaagcccgtcagaaaagcgcagtattcgggtgggagtgacccaattttccaggtgccgtctgtcacccctttctttgactaggaaagggaactccctgaccccttgcacttcctgagtgaggcaatgcctcgccctgcttcggcttgcgcacggtgcgctgcacccactgacctgtgcccactgtctggcactccctagtgagatgaacctggtacctcagatggaaatgctgaaatcacctgtcttctgcgtcgctcacgctgggagctgtagaccggagctgttcctattcggccatcttggctcctccccaaggcttaggtttctaagtcagccacaaatgctacccaaaactacataaagaagaaaaaagttgcatagaaccaaaaagtgagttttaattatttattttatacgtgtgctttcagaattccaaccccctagaggagttgggattttaaaccagtgtgatacattttctgtttgcttcagtttactttttatttttttcctttcccttatgggttctgggaattgagacttcggctttccttcctgtgataccacttgccactgtgtgtccattcgagagcatggctctcaccagcctctcccctctcctgtttttgcagtcagtactttgtccttctaaagtcctttaaaagattgctcattagaatatttttaaaatctgttagcaatagataattacagccttatttctatgctgaccaccatgcagcaaggaaaaatgtgcaaaggaaaagaggcagaaaagaactgtttatattgaatttaggggctgtttcaggccttggtatgctggtctctagtgtggctgaaggaaaaaatgctgggactgagtgcgaggaagggcagtgagtacatttctgattctggcaccttgatggagatggtcctatcacttgtagaccttgcgcctggttacagaattggggatacagaagtttgatggaacaaaatggaattatgtgagtgccctggaatggagtgatgggtgtgggtgcaggtatgtgtgtctgctcccacctctgctgggtggaagtctctctcatgagagtgagggcagcagtggtgttcacctgtatatccccagtacctcgtacagtgccttatacatagcagacactctcttgctgaataaatgaggatccagataagataggtcaatcattgttaaaggcatagacctgagtcagtgggtattacatgttcagggatatgaattggcaatttgttttattttactaatttgcttctgtgtacattcctcacagtgttacaacttgagtgacaatataatttatcattcaaatggaggcacatgaaagcaaaaggaggactgaaaattgttatacaatcttttggaattttttttgaccaatacatttgttgtagtgatagacataaagtagttttattaaaaaaattttcaaaaaattatgaagtaaacgtcagtgcgttacaataaagggatcacctgtacattacaaaaattagtaaatactcttttttttgttgtcgttgtttttttttttttttggagacagagtcttgctctgtcgcccaggctggagtgcagtggcacgatcttggctcagtgcaacctccacctcccgggttcaagcgattctcctgcctcagcctcatgagtttctgggattacaggcgagtgttaccatgcctggctaatttttgtatttttagtagagacgaggtttcatcatgttggtcaggctgctctcgaactcctgacctcgtgatccacccacctcagcctcccaaagtgctgggcttacaggcacatgagccaccgcgcccggcctcttattttttcttttcccgttggtttaagacagagtcttgctctgtcgcccaggctggagtgcagtggcatgcacatggctcactgcagcctctgcctcccaggctcaagtgatcccaatacctcatcctctccagtatctaggactacaggcgtgcaccaacaaacccagctaattttttttttttttttaaatagagatggggttttgccatgttacccaggctcatctcgaactcctgggctcaagcaatccgctttcctcatccttcaaaagtgctgagattacacttgtgagctatcacaccaggctgtaaatattcttgatacatttttatcatgtatctattgtaatgccttgtgactctttaaaagtttttcggtatgtctttttatttttttattttaataggtcttttgggaacaggtggtgtttggttacatgaataagttccttagtggtgatttctgagattttggtgcacccatcacccgagcagtgtacactgtactcaatgtgtcgtcttttatccctcacccccctcccaccctttcccccaagcctcaaagtccattgtatcattatgcctttgcatcttcatagcttagctcccagttatgagtgagaacttaggatgtttggttttccattcctgagttacttcatttagaataatgatctccagttccatccaggttgctgcaaatgccattatttcatttctttttatggttgagagtattctatggtatatatacaccacagtttctttatatacttgttgactgataagtatttggctggttccatgtttttgcaattgcaaatataaacgtgtgtgcaagtgtctttttcatataatgacttcttttcctctgggaagatacccagtagtgggattgctggatcagatggtagttttagttcctttttttttttgagacagagtctccctctgtcacccaggctggggtgcagtggtgccatctcagctcaatgcagcctccacctcccgggttcaagcgattctcctgcctcagcctcgtgagtttctgggattacaggtgagtgttaccacacctggctaatttttgtatttttagtagagacggggtttcaccatgttggccaggctggtcttgaactcctgacctcatgatcctcccgcctcggccttgggattacaggcgtgagccaccactcccggccttacttttagttctttaaggaatcctcacactattttccatagcagctgtactagttcacattcctgccagcagtgtgtttcctttttttaccacatccacaccaacttctattattttttgatttttcgattatgaccatcttgcaggagtgaggtggtatcgcattgtggttttgatttgtatttccctgatcattagtgatgttgagcattttttcatgtttgttggccatttgtatatcttcttttgagaattgtctgttcatgtccttagtcccactttttgatgtgattgtttttttcttgctgatttgtctgagtcatttgtagattctggatgttagttatttgtcagatgtatagattgcaaagattttctcccactctgtgggttgtctgtttactctgctgattgtttattttgctttacagaagctttttagttgaattaagtcccatctatttatctttgtttttgttgcatttgcttttgggttcttggtcatgaagtctttgtgtaagccattgtctcaaagggtttttctgatgttatcttctagaatttttatggtttcagtcttagatttaagtgtttgatccatcttgagttgatttttgtttaagatgagagatgaggatccagtttcattctcctacatgtggcttgccaattatcccagcaccatttgttaaataaggtgtcctttccccactttatctttttgtttgctttgttgaagatcagttggctgtaagtatttgactttatttttgggttctttattctgttccattggtctatgtgcttatttttataccagtaccatgctgttttggtgactatggcctggtagtatagtttgaagttgggtaatgtgattcctccagatttgttctttttgcttagtcttgctttggttatgtgggcagttttttggttccatatgaattttaggattttttttctagttctgtgaagaatgatggtggtgttttgatgggaattgcattgaatttgtagattgtttttgacagtatggccattttcacaatattgattctacctctccatgggcatgggatgtgtttccatttgattgtgtcatctatgatttctttcagcagtgttttgtagtttttcttgtagaggtctttcacctccttagatccactcctaagcatttttttttcaactatttttaaaggggttgagttcttgatttgagtctcaccttggttgttgttggtgtatagcagagctactgatttgtgtacattagctttgtatcctggaactttgctgaatttatcagttctaggagctttttggaagaatctttaggagtttcttggtatatgatcatgtcatcagcaaacggtgacggtttgacttcctctttactgatttggatggcctttctttctttcttttgtttgattgctctggctatgacttgcagtatgttgaatagaaatggtgagagtgggcatcctcgtcttgttccagttctcaggggaatgctttcaacttttcaccattcagtgttatgttggctttgggtatgtcatagatggcttttattaaagttatgtcccttctatgctgattttgctgagggttttaatcgtaaaggggtgctggattttgtcaaatgctttttctgctctattgagatgatcatgtgatttttatatttttaattgtgtttatgtgatgacaacattgacttgcgtattttaaaccatccctgcatcctgatatgaaacccacttgatcatggtgggttatctttttgaagtgttgttggattcagtttgctagtattttgttaaggatttttgcatctatattcatcagcgatttttttgttttgttatgtttttgtttgttttttgttttgtttttttgttacatcctttcctggttttggtattagagtgacactggcttcatagaatgatttaggaaggattccctctttatcttgtggaatagtgtcaataggattggtaccaatttttccttaaatgtctgataaaattcagctgtgaatccatcaggtcctggacttttttttgttggcaacttttaaattaccatttcagtgtcactgtttgttattggtctgttcagagtttctgtttcttcctggtttagtctaggcgggttgtatatttccaggaatgtgtccatttcctctaggttttttagtttatgtgcataaaggtgttcgtagttggcttgaataaacttttgtatttctgtggtatcagttgtggtatctcctgtgtgaattctagttgagagttttggatcttctccttgtcttggttaatctcactaattttatttatcttttgaaagaaccagctttttgtttcatttaccttttgtatttattttttgttggaatttcatttagttctgttttgatctttgttatttcttctgctgggtttgggtttggtttgttcttgtttttatgattccttgagatgtgaccttagattgtctatttgttctctttcagacttttcagtgttaggcgtttaagcatatgaactttccacttagcattgcctttgctgtatcccagaagttttgctaggttgtgtcactattatcgttcagttcaaagaattttaaaatttccgtcttgatttcattgttgcctgagtgatcattcaggagcaggttatttaatttttatgtttttgcctggttttgagggttcctttttggagttgatttccaattttattccactgtggtctgaaagagtacctgacatagtttagattttcttaaatttactgaaccttgttttgtggcctatcatatgggctatcttggagaatgttccatgtgctgattaatagaatgtatattctgcagttgttggataaaatgttctataaatatctgttaaatccttttgttataagttatagtttaagtccattgtttctttgttgactttatattaatattatattaatattaataataaattattaatataaataaattaattatatttgtattatttgtaatatataatttatatatattatattaatattcatatttatttatatataattatatattatttatatcatatatttatattatttatatataaacttgttaatataaaattatattacttatatattataaatatattatattatataataaattattaatataaataatataaataataatatataattatatataaataatactaatattaatataaataaaaataaatattaatataaatatctgttaagtccttttgttataagttacagtccattgtttcttcgttgactttctgtcttgatgacctgtctagtgctgtcagcagagtattaaagtcccccactatatattattattgtgttgctatctcatttcttaggtctagtagtaattgttttatatgtttaggagctgtggtgttaggtgcgtatatatttaggattgtgatatttttctgttggactagtccttttatcattatataatgcccctctttgtcttctttatctactgttgctttaacatttgttttttctgatataagaatagctactcctgcttgctttttgtgtcctcttgcacggaatgtctgtttcacccgtttaccttaagtttatgtgagtacttatgtgttaggtgagcctcttcacaacagatactaggtgaattcttatccattctgccattctgttctctttccagtggaggtatttcagttactattgagatgctaggtattattctattcattgtgctatgaatacacaacatgggaacgaatatgaaaacccttgtgggtttttttttccattatgttattgctatatagttcctgtgagatttatgctttaaggaggttctattttggtgtatgtcaaggatttgtttcaagatttatatctccttttagcagtttttgtttcaagatttatatctccttttagcagttattgtagcgctggcttggtattggcagattctctcagtatttgtcttaaaaagacggtatcttttcatcatttatgaagtttagttttgctggatataaaattcttggcttataattgttttgtttaaggaggctaaggatagccctccccaccccaacccctagtcccttctagcttgtagggtttctgctgagaaatctgctgttaatctgttaggttttcctttataggttacctggtgcttttgcctcacagctcttaagattcttttccttcatcttaactttagataacctgatgacagcgtgcctaagtgatgatctttttgcaataaatttcccaggtgttctttgagcttctcgtatttggatgtctagatctctgtctagcaaggccggggaagttttcctcaattattccctcaatatgtttttcaaacttttagatttctcttcttcctcagtaacaccatttattcttaggattggccatttaacataatccccaacttctcagaggctttttctttttttttttttttaattctttttttgtctttgttggattgggttaattcgaaagccttgtctttaagctctgaagttctttattctacttgtttgattctgttgcttagacttctgagagtattttgcatttctctaagtgtgtttttcatttccataagtcgtgattattttttatttatgctatttatttcactgaagattttctccttcctatcttgtatcatttttatggttttattaagttggactttaccattctctggtgcctccttgattagcttaataatcgacctgctgaattctttttgtggcaattcagagatttcttcttgttttgaatccattgctgttgaggtagtgtgatcttttggtgttgttaaagaaccttgttttgttgtatgacccagaattgcttttctggttctttctcatttgggtatactatgtcagagggaagatctggggcccaaaggctgctattcagattcttttgtcccatggggtgctcccttgatgtgatactctctcccttcccctggggatgtggctttctgagagccaaaccgtggtgattgttttttctcttccggatctagtcaccctgcagagataccgggctctgggctggtactcgggagtgtctgcacagagtcctgtgatgtgaaccatcttcaggtctctcaactgtagataccagcacctgagcgtgcttaattgtggtttggttttgttcattgttactagttttgtgttggttggcctccagccagtaggtggcgctgtcaagagagcatcagctgtggtagtatagggaggatcaggtggtgtgggggccctagagctcccgggagattatgtcctttgtctttggagtttttcagctgtcccctggggcctgcagcagcaatctgcttccttcagagggtttgtggattctcttggctttcctggtacgttcctgccgtagttcttggagcaaaagttaaggaggtgagtccccacacgctgctctgtccgtccgagtgggagctgcaaattagtcctgcctttctgtctgccattttccttgtgactctgaagaatatttttcccccaacatgggtttgtttctgagattctcataaaagtacatacttcttaaaagttgcattttcagttagtacatttgagattgttgacatttggattttattcttctgtaagccatcattttattattgaaaaagtttatttgtgctgaggtaaggtagcttatgagttcagagcaactagtgctaaaggaaggctattttgttgtttttttaatgagatgtgaagtattatagctcaaatattttcataagaactgtctaaacctctatttagaatacctatattcaacaaataattttgcaagacaaaaaagttgtcaaataaattgcctttttcattcttttgaatcttttgctaaatttagatgctgtaaaatgttgtttttatccaatcaaaaatagaagggccatgaaattattctttctacaatttgagatactccaaagtgcacttactgaatttcaaaattattgtacattgctctatatattccatttttgtctgtcacttgatatttttagaggttaatttcactgcatgcttacttgcaaactttgatttcaacaattgcagtttgccaaaaggttcaaaagctgacttttcaaaagacagttgtttgttgaaagttttgatcaaaatttccagctgattttgaacaaaaggtaacccaatcttagaggtctcaccaaaacaaaacaaaacaaaaggttccaagtcattttgcgatgcctggattggttttcaaagtagttttttgaaggctaaatgagttgagtgccaaagagaatgggtactgccatgatgaagtattcttaactttagtttaatttgttcttcgttattgtgtatatgaaaacctgtatttgtattaaaatcagaataacaaatagtgttcctcattgagcttttacgatattattaacagtagtgtttaaccttttaaggcaggattcagcaaaccttttctgtaaggggtcagacaataaatattttacgctttcttggccacagctatctattgcaactcaacttctgccttggtagccttaaagtagctatagacagtatgcaaacaaatgagtgtggctatataccaatacaactttatttatggagactgaaatatgaattttgtatacttttcatatatcacaaagcatcaacttttgatctttttccaaccgctgaaaacgtaaaaaccattcttactttgcaggccatgccgaaacaggtggcagggtggatttggcccgcagaccaatttgttgacccttgttccacgagttgaatgaaaaaaatagaactactaacggaactgatctcctatttgaaaactggcacaatctaattgcctgtaaagttcttccaagctaaaggagccaatatttaactgctattatgtatgtgtttaatgttcaggagaacatttaggggaaaaattggcttaattatgttagaacagtcatttgatctaaatgaacagtcatactttagaaagaaatgtgaatactacaattttataaatgcaaattctgcgattgcacctaagaattagttgtctttgggtactgccttcttaaaaaaaaaaaaaaaaggtggatatggctattttttcagatgttgtctggttttcatgtgcccactgatagcaccccaaccccacagggtgcacggcaaatgtggagacatgtgcaaattactatttactattaactttcttgagaaacggaaatgtagtacttattaaatctgcatttttattttttagttcattgctcctagaatggcttgtaaaatacaaacaatcaaaacaataaaatagttgtggatttacactatacatgacaaaatcattataatacaagctgtcagactaatattctatgtaattgcttcccatgtgatgccagcatgctttcttccgtcagagtgctggagagggagctgttagttatcttggacctggaaagggcccagaaaataggtgatttattcctggttgactttcagagttaacaacacattgaagtgtgaactctgttcgctgtatgtgtgtcttgcatgctactagatgagatggtgacagaagcaagacatagaaaaaataggttatttattaaactcaaactggcttattttaatgcaatagtgaatcataatatttaattaaaaatgaaaaatacaaagacaaaaccagattggacattgagacagcagttgtaagccaagactgttttaggcaaaccaagacatatggttgtcctatttaaatccataaaattaaacttttctgtaatttggatagttctactctttccttttcccattttggtcagcaaagtagccccctattaggtttctgcagtagtctcagatccacttagatctgtgatccccccattcttattctgcacactacgtttacacagccctgctgtgtgaactaatgagacccagttacagtcatgtctatctgctgcttaaaacccagcatggaccacccaggaatgccaccagtggccctctaactattgcgtgcaccaaaatcatcagtgtgtgagggtagttgcaaatttctggttccctcctagagattggtattcagtaagtcttgggaaagccctggtgcatcaaagttgagtctctgtgcatctcattactttgtcacttgccgcccccatccgtccctgtctcatggtccacccagctgttgtaggtccccagtgtcctgtttagtggacctgtctgtctttttccccacattctttcagcagctaaggagctgctgttgtacatctttctgttgaaattaaatttattgctctttgattccatttttctctagctgagcatcttgtgtgatagcagggtctaggtctcagatcatctgtattcttaacctgatgcctgaaacttgtagttactgttgagtgatggtataagattcaagttaacagtctttccattgtttctcttgtcatgaactgaaggttcagtgaattaaagtaggatttgtgtagtcacttcattgtatgtatcaagttctgcctttaaaacttcagttttctccaggatcaatcagtgtggtaatttcaaatttcatactttaaaaattgagctttagaacgggcaaaaatgcctcctaaacatttacaacttctgctgtcttttgaattaaaataaaaactgtgtctccctacagccaaggtagggctcaacaaacgaaagctgaaaggtgctggaagcctcctgcactttgggaatatacagtcaggaacaattgtcaggagttctgtagttgattctgtaggttgggattgccataaggttggttagaaaaaagatgtgcgaaagctttcctgagggtttttgcccttgctttcacatgtcccataattgaaattaagaactgctggcaactggttagtgaccagtgttgaaatgggaaaatattactggcttatgcttttgcttatagatattgaaatttaataaaatttaaccatagttacatatgattctatgaaattaggtaggctcttcaagaaaaatgtgagcaatgtaaggcagggtatttttgggaggggggtgctttattgtataggcaagctctcgaacagtgtctgataattagtagtgtctgacaatatttgctgaatgagtgaactcatggtaacataactccagtatggcagattgattcttggtgctttttttccagtggcaaacttttatagaaattggagagtttcgtaaagacttttaaaaagttgtcagaattacctattatgtcctttcctagataatcaatttggaaacaattgctggtaccttaagcccgatgtatgcctcctattatagtgttgaaaatgttcttttgacaaatgcatcaatgaccaggcacatgagaacagtgcacagctgtagaaaaacaacaatgaaggtcttcgacacaggagagagtctgcactgcatcacagctgatccgaaagttaaattcaatgaaaaggcaaatattttggtcaggagaggaattcttcctagggagtattagcacagtgtatttttagttgtgtggctatttatagctgcccaatggcttgcgtctgagtctttatttggtttttaggacatgctaaggattgagggtcgtgggccttaattgtatagaagacgcagttgcgtttggttgcctggaggcttctctgtgaagcctggtgggacacctgctggccagtttggcccttcttagtgaaggtgatagagacaagggcagaaggtcattgtatttataggatatttgaagcttatcttgtttactttgttaataatacttgagtcatttttctaaacattctttgcataacagcaaagattaaaaagataagtaatgtaatatattaggccctagttgtcattcacctgttcttgtagagctgatacttttttcttgatcaaattttaggtttaatcatatttagcttagaagagtggtctgtcttaagagtattctgattatttaggaacatctagatgaaacttctttgccttagtccatcgtttctcctttaaattcctaaaggcaggaatgagtgtttcttaaaaccaacatgtataaagcaacattttaggcaaactgggatgaggaaaaacatcttgaagggggcttcataatggtgttggagcctgttaaaaatgtggaatggaaagccgatcatgaaaacagatagtactgacttttggcaaaatgagtctttatgaaaacataccttaatgattatctgacaaatgcaagtgctttttgaggttaacagaattataaacaggagactgcagacactaaggtcactactgagcagcacgataattcgtgtggtgtgttctttttaaagattaacaatcttaagtcttttgtatgttatgttgctaagttatttgggggaaagtgttaaaataagtgctcttactttctttctccactgcttttgcacaaaaactttactgttcaaagaatattgtccattcagtttactttttatttttaagatgaagtatcccccaaactggtcatgccaggaaaaaaaaaaaaaaagtctcttccttccaaatttaagcatgtcagaaaattcttacttcttttgcacctgttaagtgccaggcacttaaaagttcaagggacatagcaggaaacagtactaatgaactgccttcatgaagctcacatgtagaccacaaacacagaaagaaaacacagtgtgtttgatggtgagatggtgtgacgtgctcaggagaaaacaggaggcagggaaggggatagaattggggggaaagggtggggagggaggggggcagttccagccctaccactaactagagtggactagctgggtgacttcatttaactctggaacctgttttctcatgactggattggcaaaaatataatacatgttcaacatacttcatagagttttgtgggtaagaggaatattattagtagtaacaagggccttataattgcacataggataactgtatttgcttactgaatcttcatagtaatgcttcacgctaattgccagtatcacaattcattctctgattaattcagcaaatacttgttgagtgtctgctaggcacgagggatatagctagattttagatacacaaaactctgttctcattctggttgagctatgactgaagagatgtagtgtcttatacctttcaccgttgctgtgtattttatctttaaatgttcagtttggtgacttttgtcaattaactagaaaagtcgatgttttagcgaaaaagtttataattttaatagagcttgtggtagggaactcacagtggttttattttcctattacttactcttggggctatttaaactagtaattttgtttattctataagtttcttaattttaaaagtattcatagagttcttttccttgtaagaatgctactgtatagccctaaaatttataatggttcaggagaactttggatataatacattttgtgataacagtgtggatcaagaagtagaaatgaaatatgccatttgataattgaaagcatatagttagatcgtgaaagccacgcactagaatttgtctaagttgatgaaatgctgactgatgaataaggtgaatctttcttcatttgggccagtagaatggagagatccatataatttggatatttaacaaaaattttcaagtgttaaaaaattatttgaaaaaatgtataatttgcattagccagtacagaattcttaactaacaagcagaaaatccaggagtactgctcattttttaaaagtttttgattaccaggggaaatataatggcaccgaggcacatggcaatgactaattaaaactgagcactagggtctgtggctctcgactgactagtatttgtgatttaatcatactgccctaaagatttgggcgctcacttgggtgggcatagttattacagattggcctacacgttccctttcagagccagaggacatggacgtcttatttagtagaaagtagtaatctgggtcttccaactttgagctctgtgctagttctgtaacctgggccaaagttacctttggttttcccatctgtaaaatggacgtaacagcagggtggtgagaatcaaatgagttaattgatggtaaagacttaacctagtgcctggcatgtagatatactaggtactttattattattatctatcatacaaagctgaaggattgtcagaaaagaatcatgagtgcttcaccatgttggagagcttctgggctggcaaatgtttaactttccctataggtggttaggggtgagcttttgaggtcttcattgtggcaggcgacatctgggacagctcctctcttgtgggtgtaggaagctggagtctgggggctctctctgtttaaagatctttcatgagtagaaacagacgatttgctcggccgtttgtgaggggattttcaggtgggcacgaggacctggctggaaaggaaccaccgtttaattcttcactgcattcgcagacgcattgcatccaccagcaccttggtaaaaagtcttaacgcaacaatccctgatcgtggctgtgcacgtagtcattcaggctttgtcagcctcatgttagaagatgcacatggctgtcattcttcatgtttaaacctgagaaactgaacagtcaaatttggggaatggtccaggactgaggagtgctgaatctaccagcccccagttgaggttcaaataagtgggggtgataatgatactaaccaaaaacagtgtggcattttacacccttttctatgtcagtcccctacttttatttatttctatagtgactttttgaagtaaccaggccagttgcttcttggtggtgtgtgtaatttatttctctttcccttgctcttctgtaaagcgatggcttcccctttgctcttagcagataacctgttgggtgacatctaggcaccaggcagaaatcccatttcccgttaatgtttcaacatgtggatttagcatctactgatgatccttgctgaatcttcagtgggtgttacaattggaagattttctagtcctgtcgttccttctgtggttaccaggtggaactattttgcaaggaagagctgtcaccaactggggcaaatgatgattcctcctaaaaaggcagggccagtcttccttccttccttccttccctccttccttccttccaatcttccttccttccttcctccttccttcctatcttccttccttcctccttccttccttccaatcttccttccttcctccttccttccttccttccaatcttccttccttccttccaatcttccttccttccttccttccaatcttccttccttccttccaatcttccttccttccttccaatcttccttccttccttccttccttccaatcttccttccttccttccaatcttccttcctccttccttcctccttccttccttccttcctgtttagatttaaatcaagtttacatttggtgtaaaatcattgattataagcaaagatttaacatttttgtgtgtgtatcattgtgggtttgtgatttttatttgatgattcaaatacattatttttgtttgagttgtacaatttttagccagtgggaaccctttctcatgggtttctttgttcttttttttttgagacaaggtctgtctctgtcacccaggctggagtgcagtggcttaatcacagctcactgcagcctcgagctcctgggtgcaggtaatcctcctgcctcagtcatttgagtagccgggaccagctaccatgcccagctaatattttaattctttgtagagaagaagtcttgctttgttgcccaggctggtcttgaactcctggcctcaagtggtcctcctcttgggcctcccaaagtgctgggattataggcatgagtcacggtgcctagctcctttgttcttttgacatctgcccatactccctcattagtcttttcctgctttttgacacagtaaggtagccaaggctcaccttatacttcctcatgcagttgatgacagtaattccgtagccattactgagcatgtacatttgtcaggtactggtttgtactttaaaagaattaccacattcagttctcataacaaccgcgagggtagatatttttatttttcccggtaaaatagaggacatcaaagttcagagagctgaagaaggtaacataacttatccaaagctaagctgctagatggcagagcctgcatctgaatccaggacttccaactgcggaacctccaaaccgttgttcctaatcactgccagttttggcagacctcttccttctcttcctccttctccttctcattcccctcctcctcccttcctctcccatttttagtaccaaggatagctcttaaagtatctcttgagtctcttctcagcttcactgctgtcttgcttcaggtgctggtttttcttttagattactgcatcgagtccctgtctcctgcctttcttctcccaatatccacattcctgtcaggaatatcttttaaaaaggaaacaaaacaaaacaccaggcagctgtcacctttgcgtacaggatagagcccatcaccgtttgtgtggcacactggctcctcacacctgtccccacacctgccccagcttctcctgccatgccacagcacacctgcgtgtgcagaacagcatggcaggcacctcttagctggcctcgtgtgctcccgtgccttcgcacaccttgtttcttgcttcttgggatcctcctcccactttgtaaaattttgttttcccgaaattcagcacagatgggcttctgtgaaggtgttgtcctgattctctgtgcagaggtgagctcctgctcgtggtgagtccccttgaagtgtgtgtactttgcacacgtgtccctgggggtgtagttcactgtgcacacacggcctcctccagcagggcagtgacaaagctgggcctgactcatcttcgtaggctgctagttctttcagtcagcagataaggtattgttaaccctcgagacctgtgcgagcacaccagtgtctggctctcctcactggaattgtcgcttagattcttatgtaatctgagtgatgccgtcttgcaggcatggctcagatcctctttaagatgtttcctcaaaactcagcatccgcagttcacatcaccctgtttatgttacgcagtttcatactagtcatgtatttaccccatcagatcaccaagtttgcacttgaggtttctccccagcacaaaggactgtgtacaccccacaggctcccagtgagtcattttggttggtgaagtggtggaggcgcttggtcacctgggagctctgtgtgtgtttctttcagtggtgtctagagagaggataaagacgccaagtcttctactatggcaggtgttttcaaatggcaaaatgctacaccacctggaataaaataacctcatgacactacaagaggagaaacaaggttccaaggcttgggggaagcatgtgccgttgagggcacacacacctagcaggtaagttgtcacacatcagtggcagcacaaggaaggctaggttccaggagtcagcccccagggtgacgtcgaaacaaaaaccagccaccccaggggtgtacatgaagcaccacacaccgatttaggtttggcctgtcctcttttggccacttgccttagaagtgtaaagagttaggtaagattaaaggaagaagtctacagaggcccctgataattgtcagccaagactcatgttgagagtcagggctaaggtcggagttcaacccgatccggttataattatgaaatatatgaatagggtcaatatgagctttcttatcaagtgttggaattctagaaatagtctatgtctagacaaggttgctttaggataaaatgagagaaataattatttcctggataatacgcttaggattttagattgactatatagatagattggaggatggtttatttaaattaatagatctgcaatggattctaaaaagagaaccaatgaaagcccagtatttaaccctttgaagtaaaatgaaagataattgacccttttctctattaatatcctcccatcaaacagtttaaaattttaatttttttagagatgaggtcttgctctgtcacccaggctagagtgcagtgttgtgatcacagtgtcatgatcagagctcactgcagcctcgaactcctgggctcaagggaccctcccacctcatcctctggagtagccgggattacaggtgcatgccaccacccagctaatttttatcagcagtttttaacctatttaagcccagggtcccttctggaatgtgccaagaaggcatagattctcaacctagaaagttgcacacatgcacccacgatttttcacacagtttttttccatttggtggaaggaccaggggaatcacaaattcatctgaaagttatttgtggatcttttatctcaaaaagttttctggactgtagcccacagttgaaaatgtagtttacatcacaatctacacgtaagcatataagatgaaaagcttcatagaatactaacctgactatgggcaacacacactgttctgttctggctcgttttatgaaatgattttatgacacactaaggggtctccacctgcagttagaaaaatgtagctctcactatgcagagtgggtagactttagaacccttgccttgtcacggccaagctcagtactgggcatctcatgctcggacgtagttcttatgctcattgtccatttgttgccaaggttgattctggctaaatgcataccccaggcagttagaaaagaagaattgcaaatcaacttctgacacattaaaagtgttatgatctggcccacattcatatagattatagagatctcacatgctcagcaaatgtgcctcctttgtggtcacagcacaggtatctaaaaacaccagggtatagcagtgaacaaaacaaacaaaagttccagccttctagtagaggagaggggcatcacatgagatcataaaatatgtcagactgtgataaatcataaggagaaaaaataaagcagagagtggggtatgaagaattgggataaggtttgaaattttagcttggatcgctgggttgttggtgtcactgaaaaagcgacctttcctgagtgaagtgaagaggtcggccggatagataattgcagacaggactttgtaggcagaggccatggaagtgcacagtccctgaatgagacagagcccagtcgtgtctggcgaggagggaaggggacaaggggccagaagggcagtccacacatgtccatgggaccttttggttgtgccaggcagcctgagggtggcagggtagaagcaggggaacagctgtgaggacgctgttgcgacagtcggggccagaacaatggtggtgtggtcctgagggatggcagcgggaagagcgagaaatgcatgaattctggaaagactgaacctgggtgggaaagaaagaagagagcccaggatggccccagcccagaactctgatggggaagactgagatggagtagcttggggcctggggggaacttcaggatctcaacttggggcaggtagaactttgtgaagccttttacacctcattggaaaagtcaagaagataatagaatcattagttaacaatttttgcacatttcctcactaatttgaaagagaaactctaacctgacctggtaagtatagtctggatatttttgtccatcactgtctcatatgatttttaatgtggggctgaattcctggcagttcctttctcagccagccgggggaagtccacagaggtgagagaagccaacttaagagaaaggcaacttgccttcatctttcagtggtcatgcgtggttcagtgttatagtttgtggccttttacaattagaaaaacacaggcttttttcattgtaaaaattgagttttttaattggtgaaatatacgtgacaaagtttgccattttaaccattttctgtgtacagttcactggcattaaatacattcacactgataatcaaccatcaccaccaaacatcgccagaacttaaaaaaaatgaagttttgcattgagacacccttcccaaaagtatttcagaattacccaaatttctggtgaaaagttttacattaataacaatgcgtttttatatacacgagagtaaacatcgaatttaagggtagttgcaaatgttgctctaggggaggacttcccttcgtggggcaaaatatgctgaaattcttgagaaataagtctaagagactcttactagactctgcctttttctggtaactcaccctttagcaaacttaaggtcttctttgtagctttgtaggcctttgaagtcccttcagaacaggtagatcgttgaggactatttgttgccggtttggtgtgtgtggatgctttctaaaagtctcctgataggcaggtctccagggcatgacctgtgctcacagtaccacctgttcatggatctcttctgtctgtttcaatacaatctgtcattggacataagaatattgtttcttgccatgcgcttctcagaaagctctgttgaattaagatgtgtcccaggtcttccatttaactttacagggaattatctgatgattgctgtgttccttgaacccttgctgaagaaattaagtcagcttttgcccatactcacttctcattatgcctgttaagaagaaaaaccacctctttgctgaaatagtgatttaaagacgtggatttgccaagttggattgtatcctttcagcctaaaggtttttctacccgcccccgccccatcttgtcccattgacttaagcttctgtatcgcactagttcaaggctctgcctccttcacttattttccttgcccttcaaaattgtgcttatttctgaatgcaagaagttcaactaggagccttgttcatccactttctttcatttccttttatcttaaaatatacttcttgtccagagtgaggctttaaaaagatttttttggttgtatttaaaaaacccacatattttcctagaaaaattcaagtagtaaagaggaagggaaactcggaaaaatctaagactcagtactaaaccaccgtttgatttgattattcttctaggttattatcttactgacatgtaataatggcgaacacaaacacagtcctggcaggtgtcaggcactaaaatgtttcacacccaaacacttccactacttgtcacagcagccctctgagggtcagcactgctattgtccagccgtccagtcacctggatgagcaaaccagagctcacggagcttaaggaacctgcccagagccacacagccccagccacgggatcgagcgccaccctggccagcctgtctgggcaatccctcttggctggcatgcttattcatcttgtcctgtgacctgccttttgtttggttttaaattcaaggatatgctgcaaatcttgcagtatttatgtacagacttgcaatttaaggctgtcagcttgaaggtggagagtgtagacttgaattagactattagactgtgtgagtttgaatccagctcttccagttactgctcccttgacagagtgacttaacctctgtgccccagttcctcctctggaaaaaggggaagacagaaatgatatctttcatagggttttgcaggaattaaatgagttaacagaggtaaagagcttaaaacagtggttgccacataaacactgggccaatgttacccaggttaaatgtcagctacctgcaggggtctctgctcattctgggctggttcatgactgatgggtttgtgagagtatacgtgcttttagagtagtcctagagctagaatcatttgtacacattttactgatttgttatttctttaaaagcctttttcatgggaaggttttattgttggtttggtggctggcagttcttttactaagctttccttcatgctctctattttgtgatattttcagtgagtcacacagcagagacatgttctgtggaacaaacctatccttggattacaacagacagtgacattttctttctagtgtgagctcaagtctgtgagctgtgtgcttctacttgtagtcttttttttttccagtaatggtcattgcggattacttgccattgtgtaggtaggtcagctgcccggggtgccttgcttaaaccttctcagtcctgagttggttgcccttgcatcacagaagaagaagtggatggagttatgtccctgccacggtcccctggcagagccaacggtggtctccagagcgctaccacactcactccctctgtaaggaaagcacaatttaagggtggcagccttgcctttgactgtcccaggaaaggggattttgactgtggattctgtccttaggtaattagattattttgatgagtgctagttctgcacacttgctaaagttttagggactctgccttacttaggagataattctgtcttgagataccccgtttacagaatgctttctaacttagatgtttggtgaataagggcatctgtttgccagcaccagctctcctggctccctgtgctggttttctctgaacacctcacctgactgcaggcagacagctctgagtggctgcctcgtggctagactagtgggatgacttttgccaacacaaacacagttcataaggatctttttttgtctttttttttctttttttttttggagatggagtctcgctctgtcacccaggctggagtgcagtggcgcaatctcggctcactgcaagctccgcctcctgtgttcacgccattctcctgcctcagtctcccaagtagctgggaccacaggcgcccgccactacccccagctaattttttgtatttttagtagagacagggtttcaccgtgttagccaggatggtctcgatctcctgacctcgtgatccgcccgcctcggcctcccaaagtgctggaattacagacgtgagccaccacgcccagccagttcataaggatcgtaagaacaagtttatacttccagcaaaagaaaaacttttgaactgtgactttagtgttaacgtttcgttacgtgtgtaatgcatatgattgttaccaccggttcttgccatccatattcccctcactccccccttctttccctccccattctcctaactactatggtgaagctcctgatagtgtagcatgcaggtgctagcatatgggaagtgagtctccagttggggagcttgttagcaattatattagggttctcttagagggacagaactaataggaaatatatatatataaaaaatatatatataatgtatattgtatatcatgtatatattacatattattatatatattttgtatattatgtataatatacatatatatcatatatattatattttgtatcatattatgtatattatataatatataaataatatatataggagtttattaagtattaacttacacaatcacaaggtcccgcaatagccagtctgcatgagaagcaagaagccaagagccattctgagtccccaaactgaagaacttggagtccgatgttcaagggcaggaaacatccagcatggagaaagatgtaggctgggaggctaggcctgtctctccttttcacgtttttctgccactttatattcactggcagctgattagattgtgcccaccagatgaagggtagatctgccttccctagcccactgactcaaatgtttatctgttttggccacacccacccagacacacccaagattaatattttgtatccttcattccaatcaagttgacattcgggattaaccatcacatcaataatcaagacagtatagaaagtgagactagttcattaacggcagttacttatttgatgcagaggatctaaaaatatagaagagttaaaacataaatatcaatgaaaaaatgtgatgctatgagcaaaatgggaagcctatctgtgtcctttctggctatgtgtatggcgtatacggtgatgcctaggttaccattctctggggtgtgcacccaggcctgaaaggcactaagtgcaaatggagtcgttaactgtgggcataagttgtctcagggccaggctggtggctggggaggaggtggccccaggacttcttattgaaggttggagtgtcatctgcccctaagtggcttttgtggtcacccagataatagagccagagatgctgtccttggccatgtttgagctccacttccccgcatcagatgttttttgagggccaagagggccagtaaatcatggtctgccttttctcaagaagtagggggaagagactgtaggacaggaaatggaaacctgaatcctaagacatagtccacgtctaatatgatgtctaaggctatgttttcatgagtaaagctgtcacaatattttcctatgttgaagttatcttaacttcatgggattgctccttaaagagagtagattttaaaagctgttcttcttgatgcccttggaagctgtcacatgatccagtttgttgccattgcgcagtactgtatctgtctctttacatgtgcttgatacagagtgacttcctgcttgttgtttgtccttaggcagtttgacttctccactcagcaagcctttaaagcacctgggttatgatgcgcatggatctggttaagttacaaagacccatgaccatctccttaaaatccagcatccagtacaaagtgtacattccccattcaatcacatagtcatttttataaattcatagccctggtcctaaacaggaagtaaagggaccctgcctcctccccgacccctactccccagaaaccagaaacaaaaagaactgtcagactcctggatatcttgctcttgcgggtactgtgcaggtctctgtgtgtgccaggttctgttgctgttttaacgtcctacgtaaataaacaaaacaccctagaatgaaaagtaacaagtcacctccttccctgtaatcgcccctgatcccctggcatagtctgtaggttttagctttgaaataaatatttgtttgaaaaagagagaggaaagtgctgctgtttcactggagatattttcgttcttttttgagggggtgggatgagttaattctgaccatggcttaagcctataaagtaggctttaagcccatgacgtggccatcagctctgcctggtgacagctcaccctacaactttcttttgtggagagtaatttttacctgagccttataaacataaaacccatagtaaataataaatattgtgatatttattaaaagagtattccctaaaagtaacctctgaaagagctgtaaacatgatctaataaacaatgatctcaaagctccctacctttgggggctgttaagttaatgtgaatgcccactatagctattagtgtgctaggtctacaacattttcacataaaacactttagaacagttaattaatttgcttatacttagtttgtaattcctagactatttcctcatttatagcttcaaagagaaactctatggcagtaattttccaggtggtccacttggttaagaatatctcttccctttctcaaagaactaaaattagaactgtcatttgacccagcaatccctctactgggtatctacctaaagaaaaagaaatcgttctgtcaaaaagacacctgcacatgtatgtttattgcagcactgttcacaatagcaaaatcatggaatctacttaagtgcctatcaacagtgtactggataaagaaaatgtggtacatatacaccatggaatactatacccccataaaaaagaatgaaattatgttctttgcagcagcacaatgcagctgaaggccattatccaaggtgaattaatgcagaaacagaaaatcaaataccacattttcacttataagtgggaactaaacagtgggtacgcatggatgtaaagataggagcggtaaacactggggactccaaaaaggtgggagggagggaagggatcaaaggttgaaaaaactacctgttgggtaccgtgttcactgtttgagtaatgggttcacgagaagcccaaaccccagctttatatattataccattgtaacaaacttgtacatgtagtccccgaatccaaaatcattaaattatttttaaaaagactacctcttccccttctttgcctcgcttttcgtggcaaaaatagaaaaaatcgagtcacataatttcttgttcttttggaattaaaaaaaggtcactttacactcaaaaagaatgatccttccaaaggaattaacagctaactaggtattgtttgacatttgcatttggtggcattcttctctaagagatccttgctttgatgcagctggttccagttgcaaaatggtatttcccatgagtgtgaaattatgaagagttgctcctagaaagccattttgttctacaagcatgtttaatcaagaaaataaatatccttttgcaaatttttataagcatgtaaggcatatttcttgcagaagctgagacatatttaatgcagaagctgatttcaaattggcttaatttttaatgcctgcattggaataaacctgtatcccatttcctttccttatgtgggacccaagaccttgtctcaagcacgagaaggtccagtttaagtaaaattagtgtttctcaggagacgagagaggccctgataagatcctcaagttgaaacacgctaaaaccctagcaaattgaattgagacctagatatattattagaaagtacagaccctcaaaggtaaagtagaagatgttgaaggcacagagggagaaagagagatcgcctgagggtctgtaatgacactgactatggatttccacagtaatcatagaagtatgaagatggagctgagaacgtaactgccaacctagaatactttactaatgtaaaatatgattcaagaaacaaaatgaaatggacactttcaaacaagccctgaaatttttaccactggtggactcttgctaaaaagatcatgaaaagatattcttcaaaaagaaagaaattgaactcagaaaggcataagatgattggtgagcaaggaaatgggagatggcaggtatgtctaaaccacattagttgtacgaaacagtaatactgattttgataaaattgggaaacattttattgactaaaatttgtagcaacaagaagaagataggtgatcaggaataatattttatcctgtccttttattatttgggagggaaggaaataactttagattttaatagataagcatgctgatatggtttggctgtgtccccacccaaacctcaacttgaattgtatctcccagaattcctacgtgttgtgatagggacccagggcaagggggtaattgaatcatggggccggtttttctcatgctgtgttgtgacactgaataagtctcacaagatctgatgggtttatcatgggtttctgcttttgctgcttcctcatttttctgttgctgtcatcacataagaagtgcctttcacctcccaccatgattctgaggcctccctaggcatgtggaactgtaaatccaattaaacctctttttgttctcagtttcaggtatgtctttatcagcaacgtgaaaatgaactaatatacatgctaaagctgtaaggataacaactgaaaattacaaattataggaaggaagggccaaagaactatagaaaaagcaagagtgttagagtgaactccaagtttctcttcaaagaatcagtatgtcagtgtgttcagctctcttattctttgattctccattttaaagtttaacttcctggttctctttgcccccttgcctctagtttcagtaaacaactttcctgccagttctaatcagtagttcacatctgttcccctcatcacctgctgcatcttgagtcacccctggtcacctgctctgccctgagttactcctggtcacctgctccatcttgagtcatccctggtcactggctctgacctgaatcatcctgggtcacctgttctgtaacctcccttcccgccaaactactcatcccgccactcgggctcataccccttctgtctttaaaatagccaattggaattagcttagactgtgcggtccaaccctagccaataggggaatgacacagcagtaggggctccctgcatcaggcataagaaccccttcccctcccttttccaggtttattctcgccattgctccatctgtgagtcacacccttctatagaagtaaaaattgccttgctcagaaaaggaaatttatgttcgagtgctgttttcttgcagcaccaagtaacaagcatttgtttctaacgaagagtatagaatgaaatggtcaaaataaatacaggtaaaatgtgtttgtaatccgaataggtaaaaaaggattaaatttcaggtaaagatcagagatgatcagattggataaaacataattttaaggaggaaagaagatgaaggtggtcattgtacagtgataaaatgtatagttctccatgaagataaagtgattttaaacttgtttgccttcggtagcatagtttcaaaatagttaaggcaaagccaacataattttagatctctagtcagtgtcagttgttgaatgacttctctgtaagtaactagtagattgatcagaaattacaaagatcagaagatttgaacagctacagttttaagtggacataaagaaccttacctttaataaggagataaattattttaaaatacaagagacattcaaatttctttacacactaggccagaaagcagttagtatcaacaaaaaacacatatcatactgtgttatctgatcacaattattagattagaaactgaatttctaatcttacgcattttggaaatttgaattcaatataacttgtgggccaacgaagaaaacaaaccggaattaagagtggttgtcaaaattttggagtcggtcaagtacccaagttaaaaatcagacagaagagtgaatacagttaaaggaaaagagatgtttttctttgttttctttaagaatgttaaagagaagaacagaaaataattccaaaacaaggatacagttaagaggatacaagtgcaaaagtggttatttatttatttttttaaaagtggcagtttatcaagtagaagaaagaagattaaaacattaggaatgaaaagaaggtcacatctacaggaatagcaagtatttttaaaagactacaaacaactgcatgccaacaagtatgagatattatagtaagttctcacttaacgtcatcaataagttcttggaaactgctactttaagcgaaaagacaatgccaagtccttgaataagatcattttcttcagtgtcattttattataacgttgatgagggaaaaaatggttgtattataaataaatttgcttaaagtcacagtttccaaaaacctatcaaagacagtgaggacttactatataatacttagaatataagcagttttctagaaataaccaagtttacccaaattgactaaaaaagagtaggagaccattcaataaatgaatgggttaataatctataccctctcactttgcgttctacccccatactaggcccagagagttcacggatgtattctaccaaacagtcaagggaatggattctcaaaattttacaccattatttccagagagaagaaaaaaaggaactaaattgatcctctagtttggttttattttcaagctatcatgaaaagcttcaaatttctgtcacaaataagtataacaaataattgtgaacccatcatcagtcgcctagcattaacaattagaatattttgccattagtgtttcatcgataatttctcacagatatctttttttgttcatttgttttaaaatacttgttgtaactgtagctgtgacctccttttcatttctaatgttttgtttgttgtttctggagtatgttaaaacaaatccaagccttgctaaactcatttattagttctcaaaagtttttttaaaaaatttcttaatttcttcctgcatactggatcataccatctgtgaataaagacagttttacttctttccaatcaatgtagattttgtctttttctttaccaagaatctgcagacttgctgagaatgaacatccttacttcattcctgggatctttggggaaacatcttcagtctttcacattaagtacgtattagctgtagggtttttatagatttccttatcaagttgagaatgttcccttttatttctaatttgttgagagttttggtcatgaaatggtgttggattttattaaatgctttgtcaatgactagtgagatggttatgtggtttttctcctgtaatccattaatatggaatattacattaattgattctctgatgtgaaaccaactctgaattcttgggataaactctgcctggtcatgatgcacaatcctatttatctgttgctgaatttggtttgggattttcatgtctgtgtttatgaggaatattgttttgtaggttgttgtggggttttttttttttttttggtaaaaaagattttgctgatttccttttcttctggagtcagttttggtaacttatagtttcctaggaatttttgcattttgtctaaattgcttagtttgttgacatagagttattcagagtatatcgtgtttccttcctttctgccaggtgtaggtagtgatgtctcctctttcatttctgatatgggttatttgtgtcatctctcttctttttttgggtggaagatcattctagcgaagagtttatcagttttgttgaacctttcacataacttattttttggtttgaagtatttttctgttgctgctgctgaattgatttatacttggatctttattgtttcctctcttctgcttgctttgggctgaattcgcccttctgtttcttatttcttcaatagaaagattagattattggttctttcacttcttttatgacataagtgtttaaaactacaattttctctaagcactacattggctacatttcataaattttcatgtgttgctttcattttcattcaattctaaatactttctaattttccctatattttcttttttgactgatggcttcttttttagaagtgtgtttttttaatttttaaattttggagagtttccaaaattgttgatttctaatttaattccattatggccattaaacacaattttctcttgtctttagcttttggtagtttgactattatgtgtccaggtaaggatctttttatatatcttaaatctttttaaaataacggagtcctgttttatggcctacattctggtcttttgtagtaaatgttctgagtgcacttggaaggaccattgttggatggactataaatttcagaatgagttggttgacagtgttcaagtcttctatatcattgccgattttctgttttggtctatcagttattgatagtgggctattgaaatatcaaactataaatgtagaattgtgtatttcatttctgtcagtttttgcctcatgtattttgaggatcatacatacacacattcatagttattacatcttgaaatactgaaatacttgaaatactgaaatacttgaaatactgactcttttaccattatgaaatgtttctctttgtctgtagtaatatttattggctaaaagtcttctttgatacccatacagtcacttcttatggttattgttttcatgtcatattttttcctatccttttactttttaccaagttctgtcttagaatctaaaatgtgtctcttgcagacagcatatggttgctttaaaaaaatctgatctgatcatttctttcttatttttttttttttcgagacggagtcctgctctgtcacccaggctggagtgcagtggtgcaatcttggctcactgcagcctctgcctcctgggttcaagcgattctcctgtctcggcctcccaagtagctgggactacaggtgcccaccaccatgcccagctaatttttgtgtttttagtagagatggggtttcactgtgttggccaggctggtctcaaactcctgacctcaggtgatccactcgccttggcctcccaaggcgttgagactacaggtgtgagccaccgtgcctggccttgatctagtaatttctgcatttagttaggagtgtttagttatttcacatttaatgtagttattgatatggttggttttagtttgtcagtttgctgtttttctgtttatctcttgtcagtttatttatcctttcctgctgcctcctagttaaatgtgtttgtttttattttttggcctgtaccatattctctgaattttaaaacttaatatttgaattattttcttattgattgctgtagggattataatatgcattttaatttatcgcagcccgcttgggattaataactaccctaattctagtcagtatatcagctttactttgtatctctccatctcctcccccctcctttttggtaatttattcatatttattatacagaatgtgttaaatgtgcatagtgttgtaattaatgctttatacaatgttatgtcatttaaataaagagaagaagcaatattcaaatagtcttctgtatttactcacatatttcccatttccagtgctttaccgttcttcccatggttttgcattactgtctggagtcctttcagcctataggactttatgctttctgtcaggcagctctgttgacaagagattttcatttatttgggaatatctttattttgctttcattttttttcttttttcttttaaaaataatttattcatttattgttatgagatggggtcttgatcttttgcacaggctggagtgcagtggtgtgatcatagctcactgtaacttcaaactcataggttcaagcaatcctcctacctcagcttcccaagtagcttggactacaggtgtgtgccactgaggtgtgtgccactgtgcctagccttgtcttcatttttgaagaatagttttgctaaatatagaattattgattgttttccctttggtgctttgagtatgtcattcattctgctttctgacctccatcatttctgatgaagagtcagccattatatttgtatatatttttattcctgtataaattatgaattattgttttccttgctggttttaagatttttatctttagcttccaccagtttaagtaatatatgtctaagaatctctttgtgtttatattatttgggctttgttgagcttcttggatctatacataattgcatttgattttatttggaatatttttagccattatttcttaaaatgctttttctgttccttctctctcccctctcctctccttagggtattcccattacatgtatgtctgcactgttgctgtttccccactctctgaggtttcgtttttcttacatctttttttctctctgtctcttggataagttctgttgatctctcaaatgttcactgattctttcttctgccatttcaaatctactgttgagtccatcattggatttttaaactctagaattattatttttttattttgatacacgctttttatttgttggcattttctatttgagtcattgtcgtcatgttttcctttagttcattaaacatggttttaaaaaatctttcaagcacaattaaaatagttgatgtgaagtccttttccactaaacccaaattctaggcaaacttagtttccactgactgttctaatttgagtatgactcatgcttttcctggtgttttgttttcaggattttactttaagttttgttgttttatgagtgtgtgtttatgtgtgttttaagtcacttgcctaggtgtaagttgagggatcttgtcctctctacattgaatgggcactgaattttgttctcttcatcactccctgtccccctttcttttagtctgactttctaggggtcactgttttagctgcatagtttatttgtgagccatgttttggtcagggattgtggacaaacatcttgagcccataaggcttccactccctgctgttggattttaatgtggattggaagtgcattcaaattttaggcaggtttcaaggctgccccaaaaagttttggattttagagcattttggattttggattttcagattatgattgttcaacccgtactatatcctcagcaaaaacaagagggctgatgtgtcataggggttcaataaatattgctataatggaagactgcagttagtgaaaccagactctctaggatccatctggttaggaggctccaacacactgaagggtctcagcattgcagcctctcacgtggcagacctacaagctagtgtcaaacctggagcctgcaaatattgactgtgcatctgtgattcgctctagtgggttgggattttttgtaaaatttatatttggccgtgtcctctccaccctaaatagtctcccctagatgagctttagaagaaatacaaaggggcgctttctcacaaaaactgctaagtacccctagtctgtctgacactcatcttctgatattcatgttacggctctaggaacctaagttcccactgacccctaatattccgcattggcattgtgacagttttgctgttaggagcctgcatcgtgaggttggaagaggtcctgcctccataacatcgcccaggatctctgtgcaggagttgcagtttgggtttctgaccagagctgttgtattctggttcctaaatgctttatctgtctgtcattggtctcagtatgtgtgcgcaagtgtatcagtgtgtggtttgagtagtcttttgtgggctgtggaacagctttgctgcatttcactctggagtggattttattcctctggtggaaatactcattcttgttagcagagggcttagtttttcaacactaaggtaccctctctgtgagtgatcatcagactgcagctgtgaaacctgtcatgacctttacaccaagagcttactatgtgcctggtgaattctatacccatttaattttggcatgtcttggtgttttgatttggctttttttttttttttttggttggtacattaggtttaaaagcgaacacgttggcagagttttttggttttgtttttgagacggtttttacacttgttgcccaggctggagtgcagtggtgcagtctcggctcactgcaacctccgcctcccaggttcaaggattctcttgcctcaccctcccaagtagctgggactacaggcatgtaccaccatgcctggctaatcttttgtatttagtagacacagggttgcaccatgttggtcaggctggtctcaaactcctgacctcaggtgatccacacgccttgacctcccaaagtgctaggattacaggcatgagccaccatgcccagccacaaagtttttataatttaagatatgtgaaggcttgcctataacactgtagttcctaactttgccgttttattatgaaaatagaactagatagaaaattcttaacctcaaaaatcctagtttatctatttttagtacctgaacagttcatcttggtctctatccatttcataaagccagacagtaaagcatagtagcagtgattccgattcagaacaggaatttctttatggcttcttcaagctttctgtttaacatttttggtttgtgttgtcaatgggaaataataaatgctttgttatcttttgaggtatctgaagaataatacagttgttatgaatatgtttttgtagtttttccttctcagttgtagcagctgtgtgggaaaagttctgtttatacaatacacatatatagacatgattcaatttgtgatttgtcaagtacacaaaagagcaagtggttttatttgtaccagacaccattctgcacttgttagaacaaaacactagcaataggacttgtcggtatcatttctacatggcttaacttttttttcactgcccatttcttagcatgaataagtggcttaacctcttaaatatttaaatcaatttttatttgggtaggccatgtaagaaaaaaagtggatagatatgataatgactactatgacttttagcaaaaggggtatatttaatttttatgcacatagaattcccaatctcatattggggaggaagagaataacaatatgttattcttctacttccttatgtatatactgagagacatttcattgctgtggtatttggtttccttatgggaaggaaaaattgggataatgatgatactgttctgtgcaatttttaatgggatggatagaaattcacgcttgttaataacttaaatcatagcatttctcctttgtttttggttagaacattaacttacatttaacactggaaaacatgactgtcagaaatttctgtaccttaattctacccacctgcttgaagaataaatggatgtgataatatacaattctgtcattattgaagaaattcagaaatgaagtttagcattcctgtggtgacatgttttattgtgaataggctccgagagcctggtttgaaaccgccaagtaggaacatcgcacaggggacaccttcacatgcgccgcagctgtgcagatttcacctcctgccactgcttgctcattctggttcccgccttctgcctgtctgtacctgggtacacatgtgcgtgtcttttgagcccccattcagttatttccttgtgttcattccttagctacattcccaaaccacagagtaagattgttttaaaaccttttggtgctcatcgttcagttgccctctaaaattcttcccactcacacactctcaacagttaaagaaggtgtttcttcacacctctgtaagccttacagacagaaaacggttcactttggtgaggttaaacgttactcatatttattggccatttgtatttttttttcatgaattgcttactcagaatttggtgggtattctttgtgttggccttactgatttgaaagagcgttttgttaataagccatagcctcttatttacagcttgtcagttttatttcatagcgtttcttttttatatgtacatgtgcacgttattcagtgtttctgttcagcgttggcgttagggttggcgaggccttccccactgtgtgcctggcaggaactgttgctctgtgctcctcatgggaagctctgcctgtgaggaccccacgctctctgaaaacccagctgcagtgttaggtgctgttggccagaagcacctctccattctaagactgatcccagactaagcgctgcctagcctcctttctgctaggtgcgttaaatgagatatggcttacgtacagtatgtgcacaaatcttaagtgtatagttggtgagcttgacaaatgtgtacacctgtgcaactaccatctccctagaggtacagaacattttcaccacctgacagtttctctgggctcccatcgccccatcaccatggataagcactgttctcatgtccctttccacaggtgggtttgcctcttctaggatttcatacaaacacagtcatatagtatgtacttgttcgtgtctgttttcatttgctgagcatggtgacgtttggattcgtctgtgttgtcgtgggatggtgagcagtgttccattgtgtgaacatacccagcatgtttatccactttgctctcagtgggtacctgggctgattccgtttctggttcttatgactaaagtggctatgaacattcttgcgtgggtctttctgtggacaaacacagaaatttcttttggcaaaaatacctaggagtggaattgctgagggaggtgtgtgtttaagaagctccacatggttttccaggggagttgtgccactcttgactctgacaggcatcgcaggagagtccctgttgtcctgcatcctagcagcactgacgtttttctttataattttagccactgtagtaagacttgaatttcggtatggtgagagctgaagaactttgctcttctctgatgagattgtttttgctattctatttatacatttgctgtataaatgttaagagtttcatggaaatttgtcagtttccatgaaaaagcctttgggacttgtgattgggattgtattgtatctgggtatcaatttgggaaaaattgacaaacaatattttatttgtcaacttataaatatggcatgtcgcccaatttataggtactctttaatttgtctcagccatgttttgccatttttgttaaacttatttctaatattttggctttttattatatggtaaatggaaattttaaaacctcactttcagtttacaactactatataaacatacatttgatttaaaaaatttgacatcatatctgtgactttactgaattcactttttctggttggttggttgtgtatttattttctgagaatttttaaattgagaatgaacactgatttttttcctttttccctcaccttttttaattatgaaaattttaaacatacaactaagttgaaaagttattcagtgaatgtttataacccactacaaagaatgtcgttttactatgcatccatccatcagtccatcttattttttgaaacattttaaagtaaatggagacatacccctaaaaataccttattcagcaagcatttcattaactggaattccagtttgttcatagtttttttctttttatgtaaaatttcctaacaatgaaatgtgctgatcttaaatactgcaaccagttgcttagctaaacaaatgcatatacctgggtaacctaaaagcttatcaagctggaaagctgtcagtcaccccagaaagttcattcatgtcccttcccagtcagtttccctcccacccttgttgtttgttgttgttgtttatacagtagtttttgttctagaattttcttttaaatggaatcatattacaaagtattttttgataatttataccacagtttggtcagtcacctgttgaaaacgtgtgctgtttctagtttggagccattaggaacagagctcctataaatatttttgtacaagtctttctgctgacatgtgttttcattcctttggggtaattaggttggggattgctgggtcacagggtaggtatgtatttagttttataaaatgctgtcagaccttttgccaaagtggctgtcccattttaaaatcctaccaacgatgtatgaatgtcctagttgcttacctttgatatttttttcattttggccattctgatgggcatgtagttgtaacttattgtgcttctaatttgcatttccctcatgaacggtgtgatattcatcacttcaaaaaatgtttaattgataagtaaaatattcagcactttttaatgtgctcactacacattcatatactttagggagtatatgttcaaatctttgccaacattttaattatacttggtcttttcattattctagaaactttttataggtcttagggactaggggctattgggatgaaatgaatatattttgcatgtgggaatgacatgaattttgtgggaatgacgtaaattttgcgggaccagaggtagaatgctgtgttctgaatgtttgtgtcctgccaaaattcatatcttgacacttggggattaacgcagtgccatcatggtactgggaggaggttaggccatgagggcgccaccatgggatctgtgcccttaataaagaggcccaagagagcttctttgtcccttccaccacgtgagggcacataaaatgtgccatctgtgaggaatgggccctcgccagacactgaatctgctggcatcttgaccttggaattccctgcctccagaattgtgagcagtaaatttctattgtttatgaattacccagtctgaggtattttgttatagtggtccaaatagaccaagacagaagttggtactgagagtgggtgtttcatagatattatctccccatctatggcttgtttgtacatctttcaacattttttttcttatttattctgtcctcacaatctgtccccgtcaacattgtttttgatgagaagtttaaaatttttttaatgaaatctttttttaaatcaattttctttctttcctggttattgcttttttgtgacctgaggaacttttgccttccccaaagtcacaaggatgacgttggtttgctctaaaaacgtcatcgctttagcttttatacttaggcctgtaatgcatcttgaatgaacttctgtgtatatcgtagtttgtggttcacttggtaacatatggatatccagtatcccagctacatttttccaaaaaacttgaccaaatagatttcttggggatctttgtaatcaaaaatcagttgtgtaatttagaatcataaatgaaaatctatttctggtgctctcttgtttcattgatgtctttgtagatacttacacaggtactgcttttccttgaaatctgttgctttatgatgttatatcttgaaataggttgtaggagccctacttagtacttctttttcaagattgctttggattgcctttcaagtttgttgcctttccttgtaaatgttaaaatcatcttgttggtttccacataaaagcttgccaggattatttttgggaatgtgttgtatctatagatgcatttgggggaaattttatattaatatttgctcttttaatttgtaaacatggactgtctttacattcatttaggcttgtaatttctcagcagtattttattgcatctattgaaatatggcttttctcttctattctcatagtatggtggattatattgattttgtaaaccttgcatttctgagatatgccacatttaatcatgacattttaattggttatatctttgatgtcagattgttaatactttaatatggatttttacatctgtattcttgagggatattggtccataatttactgtttttatctacctctttttttaagattatgttggcttcataaagcaaagtaggaaatagtctctcattttctgaaatgatttctataaaattggtattttttttcctcaaatgtttgatagaattcaccagcaaagccatctggggtttgatgtgtgtgtgtgtagaggtttgggagaaatttgtgtgtgtgtaacattttaatatattataaattaatatgttaatgtatattatatacaattttatatgtgtaaaatagccatatatgtatatattcatacttctgtttcatcttggtgtcagttttggcaagttgtatttatcaaggaacatgtctacttttacgatgatgaatttattggtataatgtttttcataatattttgttattttaatgtctgtaggatctgtagtgttattctcttatatttcgatattggtagtgtgtgttttatttccagactgttttgacttagggctatatcaatttaaataatattccaaagaagcatcttttggctttttaattgttatttgtattgctgttctaatttatttctgttcctaattatttccttatttctactagtttgggtgcagtttatttttctgtttttttcaagtagaaatttagataattatttttttctaaggtgaacatttaaaggcaccatttccctgtgaacattgctttagctggatcccacagtattttctaacattttttgtgtgatttcttctttgactcatggtttatttagaaaaatttactaattgcttatttatttctagatatgatattgttattggtgtctaactcccctgcagtcagagaacataacctgtaagatattccattcactcttttaaaatttttattgagacttattttatggcttaccaagtggtctatcattgtgaatatttcaagtgatttaaagatacattcgacagttggatataacattttgtaaatatcacttagtttaatgtgattaagagtgctgttgaagtctttagtgaattatatatctatcagttactaaaagagggatgttaaaattttcaactgagtttgtggattactttctcccttaagttctgtcagttttctttcatatattttgaagctgttgtattaagtgaatacacgtttagggttgttatagcatcttaataaattgaccttataataaagaaatgtccctatttatgtcttgtaatgctttcttgaagtttacttcggtaaacaccagcattaagaaaaaataaatttagtttcatgagagtctcctgatatctaagagtagttataatatttccatttcttttttgtggggtttttttttttttttttttttttgagacagagtttcgctcttgttgcccaggctggagtgcagtggcacaatcttggctcattgcaacctctgcctcccgggttcaagcaattcccctgcctcagcctcccaggtagctgggattacaggagcccaccatcatgcccagctaattttttgtatttttagtagaggtggggtttcaccatgttggccaggctagtcttggactcctgacctcagatgatctgcccgcctcggcctccgaaagtactgggattacaggcatgagccactgcacctggccttgtggttttaatagactatttttttaaagagtagtttcaaattctcagcaaaattgggctgaaaaaatagagatttccctataccctctcgcacgcccctacacacatacagcctccctcattatcagcattccccaccagagtgatacagctgttacacttgatgcatctacattgacacgtcatcaccccaagtccttagtttacatcagggttcactcttggtgttatgcattctatgggttagacaaatgtataacaacatggatctagtatcatgcagagtagtctcactgccctagaaatcctttgtgctctgcctttatgtttcctcctaccctctcttagcaaccagtgagctttgtactgtctccacagttttgccttttacaatatgttgtatagtttaagtcatatagtatgtagccttttcagatgggcgtcttttacctagcaataatatgtttaaggttcctctgtgtccttttgtggcttgatagttcatttctttttggtgcagaatagtattttattgtctgggtgtaccacaatatacttacctatccatttacctactgaacgacattttgatggcttcacaagttttggctattatgagtaatgctactatataaatatttgtttggaaagtttttataagttttcattcatctttcttgggtaaatactagggatcgtgattgctgaatcatatggtaagagtatgtttcagtttgtaagaaactgccaaactgttgtccgaagtggctgtgccatttgctttccatccaacagggagtgggcctttctattgctccacatcctcaccagcatttgctgtcatgttctggattttggacattccaatagatgtgtagtggtatctcagtgttgtattaattgcatttccctagtgacatattctgtggcacatcttttcatgtttatttgccatcagtatgtcatctttggggagatgtcttttgcccatttttaaatcagtttcacttgttaagttttaagatacctttgttttggataacagccgtttgtcagataagtcctttgcaaatattttcttgcagtttgtggtttgtcttctcattctcttgaaacaccatcttttaaattattatttacatagcattttcttttaccattcttttatttctgacttatctgtgtctttatgtggcatcatttgtagatagcatgtacttgggttctgtgtgtgtgtgtttttaatccattttgatgatttctgccctttaagtggagcactcagtccacttacatttagtataattgttgatagggtttgatttgggtctagtgttttatttttttctagttctctttttttggtttttgttcctctgttcctcttttccactttctttggctaataatattattgaaatttgacatttcgttataattctctaatggcttttagttatacttgttgatattattatggtttctgtttttgccttttttttagtgatcgttgtagagtagtgcttctgagtaatcactcaggctcagcatcgaatgggaacttgtttgaaacatgaattaccaggctgcatcccgggcctcagaaattctgtgggagagacctggcatttcatggtttaaataaaggtatcagatgcttctgaaatgcatgataaaaatctgttgtaccaccttatgtaaagcagaagaatcttgtaacagtataattcaattgagttttcttatttgtgctattgttatatattttctgtctacatatgataaaccccacaatagtgtttttgggattttgcattaaacattattacactgtcttacaaaattaagagaaacaaaaaatgagtatttatatttattcacaatttctggttctcattcttcctgtatatctgaggttccatcggtaccattttgcttcagcccaaataattttcattagtgtttctcatgacagaaattgttgggagacaattctccataggtcttctgcatttctgcaccttttgcaagcagtgcactggctgtgtttcttctagactactttttcaaggacattcatagagaagacaaaagtcatttctcctgccagaggctggagcaggcatgctcactatccatcataaaagtttgcctttttaagctcagggttctgctcctgtgacatcgtccattgcacgcagaggtgtcatcctctggggactgaggcacagcacaccggagcaggaacatgttggtaccctgggtactgcgcttgctcccagttcacattgatccatgactcaagagtctcttgtcgtctgtgagcgttcttgaaattgtggcaagctcacttgttagcttctgtcctccttgtggtttttctcaaagaggaggatgggagtctcatgggtcaatgggtgagattttaggaaaatccatgggatttgtagctgacatgttgaccaaattgttatcctagtgataaatggtccttcactttgctgcctgctaatgaggggaaattggggagatagttttaaacacagctgcccaaacaatgccctggttattgctaattcttctctgggtgggaggatgtcttcaccctttggtgggcagatggttctgacccttttcaaacagttaaaggagagaaattgataaccaccaggggtggaaagcaggcaaattgtttcatctgaatgttggctggttcttttgggagaagaaggggtgggacttgttaaggcagaaggctaacagctaggttgccacatggttggctcttccagcactggtcctgccaacctcagatgcactggtagatgacagtaaaaggcttaattatttttgtagtggaccctggcagctttagggatgtgcagccctgtcgaagattaccctgacatagacaaacacctgtgggaaaatattagtgtctaataagatcatcaactagtattccagctcttactgccccagatgaggtttccaatgctaatgatgatgacccactggagagtgagaaatttaacccaaacaagttgacgtacattcttgccgtccactccactgctctgggaaattctcccctggcccttccattaaagccacgtgataacccatgagatgttaccatgactgtggggcccgcattggtcaaaatggaggacataatcaatctgtgtaagcgacctaaaattgccttgtccctcttgcatctggcccttgcttacagaagggctgggtatgagtagggtatcattggtaaacaggtgaaaatagctcccgaaataggaaacatacaattttgtcctggtggaaggagagcaacaatgctagtacctagggaagtggggagtgcattacaccttgggaaattctgggacagggaacattaatgatccttgtcattcagaaccacccctagagccttcctcagggatgaaaaagccctggtgtggttctcccagatttttgcaagggactgaagtgaagctttcagatctgccattcctccttgccagaccactctggtgacgatttggtgcattcctttgacccatgcggagaattctatcagaagcagcaggggatggtgccagcgcctgcacctgccacacagaacacctgctagcacctctggctgtctgcccacccatactcatggccatggcacagatgagtgccacctgactggtggagcaggcaaacaggatagattggactgaccactgtcaggcagttcttccaaaaacaagggcaagactcagtgattgaactgagctgtagacctttaagagccatagccatctagaaagctctgttgaaggcactgtcagcctatgcccctatgatgcagggctcactggtaattgtaagcagcactttccaggaccaatgcaacactgagactgcactctccctctgtgaagggcaggtattatctcccttgtcttcctcctagaagcatagtgacttgcaccttagcagtgatcatcagagaactttgagtatgtaaagaaaaaaactccatcagatcctgtagtcctcatagaacagtggcaaactctccaaaatgagtctacccttgagtatctggggcagccccccagagggatcattgactcaccatgtgtgtgcatcctacaagtagctttccccactgtgagagccatagacatggtggtaggaaatttgtccatgacgttctctaaagtgatccataaaagcatctggaagcattcattaatggatgataggattgctgtagatttcctcctttgggccaagacacagttcgtgcaattgctaacacatcttgtattatccgtgtcagtggccccaaccaaaaggaaatgtccagaagcttcaggagaaagccacgtggcttgctaaggtggaccctgatgttttatggtattgctttagctggctgggtccaggatgccgggaagcatggttaaggtcaggattttagtttggctcatcatgataattggagtcctgttgatagcagcttttattagatgtgtgagacaaattgagtggatttggttccagcctgtattagattgatcagagtagctaatggagtggatactcagagggaaatttgacagaagccgagacagtataaatacaaggagtgggtcttgttgggagagagttctccagggatcttttgcatttctgtatgtctctggaaaagagagtgagcgcatttgtggtggactgtcttttcagtagtgttggtgtaagcagttagcctcggagacaagatagtgtctccaggccataggtaagtttgtttactgcgctgtaggataaagatgggatgtgggcaggcatgcccattataagcatttgggatccccaagctcagggatcctttcttgtaatgtaacctattgttccagcagtttttacctgactgtctttgtattgccctgtaggaattacaggctcaggtaaccggtacaagcaatgctaataggctgacagctgctcctgctgtgggtaggaaaagcggtagtccccgtttaccctttaagctttcactttccacagtttcagttacccgtgttcaaccatggcccaaaaatattaaatggaaaattttagaaactatttataattttttttttctttgaggcagggtcccactctgtcacccagtctggagtgcagtggtgtgatcacagctcactgtagcctagacctccttggctcaagtaatcctcctacctcagcctcccaggtagctgggattacaagtgtactccaccatgcccagctaatttttttatattttgtagagatggggtcttgctatgttgtccaggctggcctcaaactgctaggttctagcaatgctgccacctcagctttccaaagtgctgggattacagacgtgagctactgtgcccagccaattcattattttaacttgtgtaccgttctgagcagggtgatgaaattttatgttgtcttgatgtgtcttgcccaggacgtgaattgttcctttgttcagtgtctccatgccatagatgctaccacctcattagtgacttagtagctggttcagttatcagatggatcagagtgcatatagggctgggttttatccgaggtttcaggcattggcagggggtcctggagtatatcccccactgataaggggtgactgttacactgtttctctgatgaggactcttgtcttctgccagcatccatgaaaatgtcaaaaacaagttatagcttggtagtttgcaagcaggtaaaatctcagacccttcaaatttccttttgtctcttgcgaaaagttcttttagctcttattcttctgaaagtgtctttatttcacttccccctttctttaaactgcttttttgagattaactcacataccagtttacccatttaaattagagaattcagtggctgttagcatatacagttttgtgtccgtcaccacagttgagttttgtacattttcatcacctcaaaaagaaatctagtatccattagctatcatcttcctatttacccctgttaccttccccccaggcctaagcagccactagtctattttctgtctctataaaatggcccattccggttattttttataaatggcatcatgtatgtgactgacttcttttacatagcgtaaggtttttaaagtccatccatgttgtagcttgtatcagtacttcattcctttctgtggctgaataatattctgtagtatagatatgccacattttgttacttactcatcagttaatagacattcggattgtttctactttttgagtattataaacagtgctgctatgaacattcttctgtaagttttggtggggacaggttttctttctgttgggtagatacctaggagtggagttgctgggtcatatggtaactctattcgaggaacaacgagactgttttccaatgtggctgtaccattttacattaccacaagcagtacatgacagttcccattcctttccaccctcaccactacttaccctttttattacagccatcctaccggctgtgaagtgtacccgcattgtggttgtgatgtgcatttccccgatggctaatgatgttgagcgtctttccgtgtgctttactggtcatttgtgtatcttcttcggagaaatgtctattcaggtcctttgccattgttaaactgggttgtctttttattattgaactgtaagactttatatgtttgatataagtcccttatcaaaacaatttttttcctcccattctgtaggttattctctcactttcttggtggtatcctttgaagcacaaaagtttttaattttgatatctagtttaatccactttttttctttcgttgccattgcttctggtgccatatgcaagaaatcactgcctaatttaaagtgacaacaaattacaccgctatattcttttaagaattttataattttaactctttcttgtagatctttgaccaacttaatgtgtggtatgaggtgtaaaggtccaacttgcctctttggcatatggatatccagttgtcccaagattatttgttaaaaagattattcttttccccatggaatggtagtgacagtgttgtccaaaatatttgaccatatataagggagtttatttcagagccttctattccattaggctatatgtctgtagttccacgctgccagtttcatagtatattaattactgtagctttgtattaagttgaaaccagttagtgtgagttcttcaactttttcttctttttgaaaattttttgggctgttctcaattgttcttaccaattccgtgtgaattttgggattagcatgccagtttctacaaagaaaacaactttaatgttaataagagttacgtcgaatctaaagatcaatttggagagttttatggtattaacagtattaagtccccaaatccatgaacatggaatgtctttccatttaattagatatttatttcaataatgctttatagtttccactttataagttttacacctcttttattcctgttttttttctttttggtgatataactaagactttcttaatttcatatttggtttgatcattgctactgtatagaaatacaatgcagttattccattttaaaaattgatttttgtatgttgctttgtctcttgcaatcttggtgaacttctttgttctaatagtttttaatggactccttaaacttttctgtatagaagagtatgtcatatgcaaatagcaataattgtacttcttcctttccaattcagatacctttgtgtttcttgtctagtcactcagccaaaactagctagaactccaatacaatgttgaatagaagtggcaagaacaaacatcttgtttttctgatcttagggggaagcttttagtctttcagtattctgtgtgatgttatttgtgtgtttttcatagattccttttattaagttgaggaagttccctctatttctagtttactgacttcttttttttttttttaatcatgaagaggtgttgaattttctcaggtgttttttctgcatctgttgaaacaatatgtgattttttcccctttattctattgatgtggcatatgaatgttaattgactttcacatattaaaccagccttgcatttttggaataaatccttcttggtcatggtcatttttgtatattgcggaattcaatttgcgaatgttttgttgaggatttttgtgtctatattcataaaagaggtataggtctatagctttcttgtgatgtcttttgttttggtattaggtaaatagtggcctcatataaagtgtggtaaattgttttctaattactggaagagtttatgaagaacaggtatttttaaaaattttggtagaattcaccagtgaagctatctaatcctatgctttttttaagggaggttttgatgatcagtcttatataggcctgtttagattttcttggttcattttgactagtttgtatatttctaggaatttgtttatttcatctgagttgttaaaattattggcatatagttgttcatagtattttaattatttttatttccatatggtttgtagtaatgttccctctttaattcctggtattagaaatgtggatgtttatttttcttaatcaaaataagtaaaagtttgtcaattttgttaatttttttaaaagaaacttttggttgtgttgcttttaaaatattgcttttcagtttattaagttctaaattgtttcttttctcctgcttgccttgggtttagtttccttttttgccagtgtcctaagataaagggttaggttattgatttgaggtctttcttctttttagtgtaggtgttcactggtagaaatttccctcccatcactgcttttgctgtattccataagttttggtatgttgtggtttccaacttctcttgagacattttggggggaggtggcccattgattatttagcatgggttaatttctgcatatttatgaattttcccaacttctttgttattttcagtatcatccccatttggagatagaacttgcatgattgcaatccttttaaatgtactgagcttatcttaagacttagcatatggtctgtgctggcgagtatcctgtgtgtgcttgagaagaatgtatattctgctgttgttgggtgcagagttatctccttgtcagacttgcataatgtttccatcacaataattaatggagcagtttgcctgcccctggatgtcttattgctccttcacagtctgatgctgagatctcaagctatggctgcctgccggttaactcaaagaatggttttcatacctttttttttttcttttttttgagacggagtcttgcactgtcgcccaggctggagtgcagtggctcgatcttggctcaccgcaacctccacctcctggttcaagcaattctcctgcttcagcctcctgagtagctgggactacaggtgtgcaccaccatgcccagctaattttgtgtatttttagtagagacggggtttcaccatgttgtccaggctggtctcaaactcctgacctcgtgatccgcccgccttggcctcccaaagtgctggaattacaggcgtgagccaccgtgcccggcccacatttttttactagctggaaaagatcaaaagaataataatattttatgatgtgtgagttataaaattcaaattttagtgtccatagatagagggtttttttgtttttgtctttgtttaatgccatttcattcattacatattgtgtctcgctacttccttgctataagaacagggttaagtgattgggagaccagatgacccataagcctaaaacatttactctttggcagtttatgtaaagtttgccaactcctggtctaatgtgtccactatgacttccttatgtatactcagtctggccactgagtatgcctaaaaacggagcacacacctaccgttagctgcggaggctactgttgctcttcctctttgctcaatttcctgaggagggagggacaggatctgcctggggcctggcagcagcaggtccccagggatgctggccctgggggaaccagtggtacatggttaaggagggaggggaaacaaaagcagtgtgctccaccaggctcctgcctcggctctaaggaaacagaggaaagcaaacgggaatactctggtttagtatactgcccgcttctggagtggacattgatttaaggtgggttgggcaggaggcagggggaacattaaacatagctttcctacaagacataatctcattgccccttttcttttaaaactcttaaactatttctgcaaaaacgtcatctatgtggacttttccagaaatatgtcttttacttaaattgaaatacaccctcatacacaactattcacaagtgaaggagcaagggaaaaatcgctttcaagagctttccctgctatgatacggaccgcgtggactcgcccttggtgacctgacgttaattctgactctgtggagatctgtcagacgtgaaatcggccctgtgatgagctaaggtcttgctgttcctaatccttttttctcagaagcaataatatgtatttaattttaggctgttcagtagttaagggcttcagttttctatatctcaagtagatatactggagagttttttatttctttgagagcagagaaaatgatggggatggggtattctcccgttctctacgatcatcagcacttctactcattaggctcgagtatttggggatgttagagaaccaggcatgccacagtttcgcctgacctacctctaactgccagaaatgtactgacgttcttaataattgataggtgcagacctttgcgttcttaattaaagagccactccgtggctgtaggcctctgcccacaagatacagagtcacatgctgcccccaggatgcaagctgatgcttttatagtaactgcagatgtaataacagattctaggtatttcttcagtaacgtatggaggcactgtgtcacataactctcgttcatgtgagtagcggaagatctctcttccatttacgcttcagatgttaaggtagtagaatttgtcacggtgataaaacgtgcttacaaggcagggttgtgtgaattgataaatttgatccaaaatgtattggtcatccatttcaatgattaacagcatctccattgaaagatgttagtgtaaaattaattaaaaccaagatttgaaaataacctgatcgctctagactgttttattacaatcaagtatgatgttctctgttgacctttttagttttaattgagtgcttctgaatgatacttgtgatacagatcatatgtttctttgatggcagtttcacaccacagaaggttctcagcgccttgtagctcattgctgtcaccactccaggctgttgcctgggtgcccgctgctggaaccctgggatgaccaggcacagctgcagatgcctcgagctgctccagccatgagtgtggaaaccaactcggtggtcaggcttcaacacagaaatagcagagagcccctttcagtcacaagaaacataagtcacctaatgcatatccacacgttctcagcataaaaatttagcatcttgtttgacttactttcagggaaattgtccacaacccaaatggcctattactattttattgaggttgcagaagagatcattttatcatctattgtggtttttgctatttttgatgtttcctaatgaaacttgcacttttccccccaaattttgatttttttaaaactatttttttccttttatgaacaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcaggtgcccggccctgtgactgcagccatggccacaggcttagctgttaacgggaaaggtgagtgtctagggagctgctcaggctccgtggtgatcccagagggctcgggtccttctctagagatcaggccttgagctgggcagagtccggggcttctcacggcatctgctggagccttgcagagatttcgccttctcctttcttcgctggaagcctttgatatttctcttaattcggcaactagttttttctgtgtaattcgccatccacagactgtgctaccacactgacttgctttaaacagtatctccctctaactaggttattaggtgataagtttttacagcaagtttctgaagctgtctacctttcttcacctctgaagtgctgagtcttgtctcgtgttaagcgttttcttctaagtgtggccagcattgatacagaagtgcaggttcttattttgctcatctgtgtgaatacccaggaatgcctttcagtgggagcgttgctaacccagcagagcctttgggagccgggctcgtttctctgttgtgatcggcagtgcaggtgccattgcttcccccgtcagagcccagtctgcctggcaccggtggtgtcctctgttttactctcatccccagccccgctcctgggttctgcagctgccttggttgtgccatgacctgtccatctcccaggacagcacaactgggagttcacatgggtggcttccttctcctcacttgccacactgtgccggccacagttttctcttacgaggcctcatgacttctcacctgctggagctttctaatagggcttcctgcttcctgccttctgacagctcccatcccttttcagtcattcttggacgagggtggtgtccactggtgcccccaccccattgccttcagtagcaggtgtgccctgtgtgtctgcgacctggcgctccgctgccctctggctcgctctctctgtcagcaccagggccgcacgtggtcccttcctctccatctgctcaggggcccccaccacctggccctctcctctctctcccttctgagttgtagtcttaaaattgtctctttagccgggcgtggtggctcatgcctgtagtctcaacactttgggaggccgaggagggcagatcgcttgaggtcaggagttcgagaccagcctggccaacatggtgaaaccccgtctctactaaaaatacaaaaattagccaggcgcggtggcgcgcacctgtaatcccggctgctcaggagggtgaggcacaagaatcgcttgaacccaggaagcagaggttgcagtgagccgagatggtgccattgcactccagccagggtgacagagtgagactccgtctcccaaaaaaaaaaaaaaaagagactccgtctctttacctgtgtgtgtctcctccaacccaagctcagtagaataatagcaaacaaaatacaatggtgttggtttgtttggggagctactttcctctaaagcgaagtgttcactaagacattctaaccgtcctgctttggtgcattcaacaggttttctcctcggcccaggcccttgtgtagcaaaaaagtggaatatgaactgaaatctggggtctccctttgacaggaaattgccatcttgccaatgtttttcagatacacacttgacccaaacggtgccttttccggcttcattggagcttgtgaacttgtttgcaggtttgacttcctatattgtttgacctcatggatacagttttctcttacttagttgtatgtgagggatcagagaagttcagaggtagaagggactcacttaatagcacgctctattttgcagttagggaagtcgagtccagagagaagatgatgttcatggagagaaccgaagccagaaggggaaccagagcgcgtgccttagtgcctccctggcgttcttcccagcattgcttgttgcctcctggacagataagcacctccgtcttcattgatgacttgggggccaggcacggtgctggactgtagtgctaccaaaaaggactgatgagctatagtccgtgggcttggccctgccctgctcctggttttgtatgacctgcaagctcagaatggattttacatttcctgattttggaaaaagaaaaaaatcgggaggaatatttactaacgtgaaaatataagaaattaagatttctgtgttcacacataaagttttcttggaacacagctaaccatccattactatgaatgaatggagctatccattcatttacttccaccaccaatcccggctaatttttgtatttttagtagagacagggtttcaccacgttggccaggctggtctcaaactcctgacctcaagtgatccacctgccttggcctcccaaaatgctggattacaggcgtgagccactgcatctgacctacttggctctttacagagaggatacctgatctctgctcttaggaggccatagatctgtgagcccccttttttgtccacaaaagtcgtgtgtgtgtgtgtgtgtgtgtatatgtgtatatacacacatgtgtatgtgtgtgtatatatacacacgtacgtgtgtatatatacacatatgtatgtgtgtatatgtgtatgcatgtgtatatatacgtatgtgtatatgtgtatgcatatgtgtatacttgtgtgtatgtttatacatatatgtatgtatgtgtatatatgtatctatatacacatgtacatatgggtatatatgtatctatatgcacatatatgtacatgtgtgtatatgtatctatatgcatatatatgtgcatgtgtgtatatgtatctatacacatacatgtacatatgtgtatgtatatatgtgtatatatgtatacatgagtatatatgtacatatgtgtatagatacatatatgtacagatgtgtatatatgtgcatgtatacatgtatgtatatatgtgcatatatgcatgtatgtatatatgtgcatatatgcatgtatgtatatatgtgcatatatgcatgtatgtatatatgtgcatatatgcatgtatgtatatatgtgcatatatgcatgtatacatgtatacgtatatatgcatgtatacatgtatacgtatatatgcatatatacatgtatacatatatacgtatatatgtatatatacatgtatacatatatacgtatatatgtatatatacatgtatacatatatgtgtatatgtgtgtgtgtatatatatacacacattttttgttttgagaacccttgattttcaaaacttcgagccaacaaggttaagagctctagtccttaacccgcacgtccagttttggttggagaccacctccaatgcgatcttgctggttccctctcgtgtgttagttctttcaaaatgaactgcagccctcgccagatccacattgcgctttcaccacatgtgaaacaattcgcaacaagaaccttcattcctttatatttcttatataaggaagataataatagcttccatttaaatgaggatttagtgacttcctttctaaaaaacatccatccacacatgtggcattggttaaaccaaaagggatgtgtaagcatagaatcttaaattattttaccttgttgtgcggagttgggaggttgggttgggaatgacagtatttttccaaggccctcaccatcatttttctccaaagctatgatctctacccctctctcacttctgcctgggcgctggtcagatcagccctgacccctgtatactgctgagaatataatcactagttagaggaaaatagaagctgttagggagcatttttaggacagtggtgaatgacatcccctgcggccttgatctaaatcaggcttgcagattaacgaggaggaagtctttctggaagaaaagcaactgcaaagctggtggagcccctgacagcaggcctcctgtggatttgggagggtcagttctgtcgctgccctggtacctgtgcagagaagagctttgttatactctgctagatcgtaagctccaagaaagcattttgtttttccagactaaatcgaactgtgcccagaatggtgcctgccgtgtagtcggtgctctgcaagtacttgtggatggagtgattccagtagaatgggtgcgcatggaagacaagggttgttgtaaggagtcatttgtggcctgggtcttttgctcagagaggagggaaggagagcaggaggggagaaatgctattgaaataacaacatatatggccagaaacacagacattccagaaagccctcgttcgccctctggcacatgcttcctgaatgaggagaagccgcgctgaagctctgttaggctgttggtccacactcagacactttttaagccattgtttgtttttactttctagactaattttagagctacgtaaagaaactgatttgtttttctaaaactaattgaagtagatactggtggagtcattgggaaacgaaccatcattcaaaacattaatcatatactgaaggaatatttttgccaccaaaaaccacagatatttgaatatctgtgaacccaaagaatgaatgtttctggagtattttcacacacactcacttttatagaataaccatatatgtgtttgctttttaattattttaagtatgacgcaaaggcttaaatgaatatattatttcactcagaaatgtgagaaattctaaaatttaggtgatgcagctagctgtcttctttctctctatcaatgtttaatggtaatttcttgctcttttaattccctaatgaattaatcctacaaaagaagtaattgcttttaaaaactggattatcgtaactttgtcctttcatggattcaaacatataattcatcatcattccgtaagtatgaaatttcagaaaatgctattagcaaacttaaaacaaataggtgtaaaccttatcagtgttgtgacatagggttggcttttggatttcatattgaagccaacagacctagtaggaaaatgactgaggaaatattaataccttagcacaccttgcatttcatgagcatttcaaccaaaggaaactcctaagagaaagtgttgaggaaaacctggctgcttctgaggagctggagtgtgatttcctctcagtaagaatatgagtagatgatccatctccctttcctctgtgattatcagggaagtataagaggcacagctgccctctaggaagaagccccagggctttctagggccttttatgatttagtctcagaaattagaacttaaccccagggaagattaacaaatcaggagaccaggccaggtgtggtggctcacacttgtaatcccagcgctttgggaagctgaagctggaggatagcttgaggccaggagtttgagaccagcctgggcaacatagtaaggaccccatcttcataaaaataactattttcctaggttttgaaggtttttgttttttttttttaaattatccaggcatgaggccaaggcgggcggatcatgaggtcaggagatcaagaccatcctggctaacagtgaaaccctgtctctactaaaaatacaaaaaaaattagccaggcgtggtggcaggtgcctgtagtcccagctactcgggaggctgaggcaggagaaaggcgtgaacccaggaggcaagaggttgctgtgagccgagatcacgccactgcactccagcctgggcaattgagcaagactgcgtctccaccaaaaaaaaaatccaggcatggtgactacatgccccctgtagtcccagctacttaagaggctgaggtgggaggattgcttgagcccagtaaatcaaggctacagtgagctatggttgcaccactacactccagcctattccacagagcaagaccctgtctcaaaaagaaaaaaaaacgaaaaggcagcagtgcccagaccagcgcccagaggtagcagctattccctggggccacagcaggaaacctccacttgaaaagagaagacatttgaagtcaagttacagcaaacaggcaattagaagtgtgtttgagggtttgatcaagaaagatttcagtttgaaaccccacaaatgattgacatgtcctgtatagtgggtccatgctagaggcttccacatgtgttatcttgcttattcttttcaagagcaaacccacttacacaaggaaagggtccagaagctagaaatcaaacgagaggggagtagtcctttgagacatgtagatgcacagcctccctcctttctaagcatttaataggtatcctcaggcagaatgatgtgatgcccagcagcaggtgggttcctcagttcctcagagtgagcatagtggtccgcaaacctgcgtgtgcttaaggattctagtgcagagtttcaggcatagagcccgtagagaagatgctcttgtccagctggagccagtctgcttactcccaggaatctttaaaaacatgcacaccataatgattttattttaaaacttaataaatctgcattattttccaatgattgatgtcgaaccaaggccctttccaagggagtgcttgcgtttgccacttggaagagccaaggacttttgaacatggattcattgcttggagccctctcttgtgtaaagcatgctcgtaatgtatcacttactgttaccactttggatttcttcaaagtagagcaaaacttaggtgtacttagaaatctgagtacagccctagcctttttgatttttctcattttctcacacctggttttgacaacagtttttagtctagagcctttccaaatcattcaatgtagttttctttgaaacatcagctccccttttgtaatcatcccctgttgtatgtaaaaatgaattaaatataacaagttcagctagccaaaaaagtgtaagaggaaggagagcgttccctctatcctcttaggtttgtggctggggcctgtgaattacagtggtgaaagacatattaacaggagaaaaggacatatacatttaattggtgttttaaattttatgttcccaagaggtctccacacaaaagaggaaaccccaaagaagtggttaggtttgagggctcatataccattttaacaaaggatgataaattgcggagaagttcctagacaaaagaaagtggggtttctaggcttcttgggggtggtaaaatgtggggaggtggatatacggggaaacaaatggaagacaaaggctgtttagtaaggtctgttgatgccgtctcggcccagtttcatctctctggtaatgaattgttttccttttcctggtacgggaaagtgggaatacctttacagacaggaatttaagccctttcaggcagcaatagagagttctttctgcatctgttgcttctcagttgcctttagctaaaaataatccgtattcaaaagtggcatattttagaattgcatattctgattcccgtcagaagtttagggaacgaaccctgccagctcttcagcagccatatcccgaggggaagagtcacgtgtgagctgtgtggagtcccgtgaccatctcactctggatagggaaccaaggtttctcaaggagtgttttccttcttattctgagagtccctgctgcagactttgagagttttttccctgcaaatgaagtttattgatgtcacagctccagaaatgttaacacacatcctgttgtaaacagaatgtgtaaatgtcatacatttttgcacaagtaatttagaagtactttgagcaaaatatgagttcactgttacctccccctctgaataccaaattccccagagagaacatcagtagtttgatgtgtgtcatttctatctttttctatgaatttatattcttttatatgagatcatactacgtaatttgttcttagcatttgctctttttatttaacatcatgtcttggagaactctctattttaagactcaaattatttctttttatgttttaaactttatataaatatgatttcaaacttacaagttgcaagaccagtacaagaaatacccatatagtatcccttacccagattcaccaattgtttacattttgcctcatttactttccctctcctctttctcccccatatatgtttatacacacatacacatatgcatatacatttttttcctattcgaggatacattttacactatttgagagttagtcggcaacttgctattgtaaacgataaaacacaaggcctgtaattgatttaaaattttaatagatgttgccaaattgctctctaaaaaagctgaaaagattgtgagtacatatttacctattcttaaccaacattttaatctatttttcagtgtctggcagatgagaaattgctatctcattgttttaattttaaaacaggaaaactgtttttgcaagttaattgactgtttgcattcattcttctgttaattccgtatacgtgtgtatatatatatatatatatatatatatatatatatatatatatatatatatcttgcctgtttttcttttgggtggtttaacttccaaaatgtgaacatttcgtgaatgtacctgtctttgcccagggactacactgatcttctctgcatgtttgagctgtggcgtgcatgcttgtaaagagagtgcctaaaaagaggtccatgattcagggtcctccccaccccactcaggggtgaggtaggactatctaggccctgccttaagggactagaaaacttccaattaatgtgcattaattttatggttcctgctcagttttgaatataccaaagtatatttcattactttgggcttatatgaagtacaatttaaaagaaatttagatttcttaggtcagatgacataaaaggaatatttctaactatagttcttgctccttttgaactttaactgatacaaggacaaagggggggaaatcacattttcagattaaatttgctcttgtcgctgcatgtgctactaggaattaagccctgttacaaatcctccttgtctcctctattcccgttagcattgtttttgctgcagtcaggtactggccttctggaatattcctccagtggcatgctgtaccttaaggttgggagcagctatatatacacagggtacaggctctctagcctcttccgagcatgctattctggtgcctttgttctgtcttaagttcctccaacattcatcttcctctttcagagaatccttgttttacagaagaggccgcttgtgaaagagagtgatttgatcaaatcactagcagaattggtgggaaactagactctacgttagaacctactcctgacttccatttagttctttgtactgtgtcacactgataagtgaattttttataagcgtaattgattttattaagtacacagtattactcaagactttcgcttctgtgtcaagtgagtgaaactgaacccacagtggcttaaacatacaagcaaatgaaatggcatctgttggctcatgaaactgaaatccaggcacagctggatctgtggcctgaagttaccatcattctcataccccaccccacccccagcctccactttttcagtcaggccatccttcccgcatggaagcaaggtgcccccgcagctctgggctgccaccctgacctctcagctgaccagacagaaaaggggcttctcttcctcctacgtttcaaggggtgaggtcaacttcatctaaactctgtaacctagaaggaaggggatgagaggataccccaggggaaagccagggctagtaacaatagaaatggcaatagaggccgggtgcagtggctcacacctgtaatcccaacactttgggaggccaaggtgagtggatcaactgaagtctggagttcgagaccggcctaaccaacatggaaaaaccctgtctctactaaaaaaaaaaaaatacaaaattagccgggcgtggtggcgcatgcctgtaaacccagctactcgggaggccaaggcaggagaatcgcttgaacccgggaggcagaggttgcagtgagccaagatcgcaccattgcactccagtctgggcaacgagtgaagctccatctcaaaaaaaaaaaaaaaaagacagtaggtactgagcaagcctggacaatcatactttgaattaatgtcatgttccagcgtttgggtggccctctgaaacagtacacagtcatcctcccaatgcagctgtgcccaagatgctgctcaccaggagactgagctgtgcccagctctgtacttcctctttttgaataggtgttcttcctccttttctagtcctatctttgggagctaggcactgcatttatctcctttttaatttgatatctcaccttttacacatcagtcacattaattacacaaatggactgtttatgaggatccccttggagaaggtgccagggagtccaattctccaaggctcttttgccttgggtgcagaaggtttaactaacgtggcttgagtacttagattggatggatgggagccgattccctagaacagtctgaaaaaataaaatcggatgtttttaaaatatccagggaaagatccagagtagatggacaaattcacttaaactttaaatggtaaaatggaagtgttgtgcagatatttcagtggtctttagaatctcctacattgcctagtccaattgtttacacacattaggggcttcattaacatttgcgtgtacatgagtgagttgttggaggaatttttatcccttctgcttccgttattagtgtttgtcttttaaaaagaagagtaaaaggaatggtttgttagggtagtcgggacaaattaccaaggcaccaagaggcactcctacactcctgccgccctaagcacttaggggacgtcctccaaatcagacgagtcagcaggcctgtgctcctgcgccatgtccctgctgtacgtgcacatgtccttttaagtgaagtcaatatattcctcttcacagctgcatcccagtgctcaagggaacttcttgagagtaagaaccaagacatttcgtcctagtttttctactacctgccacatggtaggcggccactaaactgtggagtggatgaaagcattttcttccgtgatggttcatcttaaatgtcttttgataattagcattttattgaaaattatattgttttatctgagcaaaatctacttaaagggttcattgaacttcaacaacaagtgaaataataaaagaacccacacgatgcacacggtggcttgccagggcttgggtgccggagggaggagacagcttctgtgtcctttctcaccagcagtctctggccccagtggagccccaggctcacctcccctctcccgctttgtgtgctcggcccctgcagctggagtctgctttacttgattcatgttacttggtgtccacacagttgctggctcctgagtatcttccgtggcttctgagttcctgaaacacattttcctcaggttttgaggcatctttttaaagcttgcttttagtttcggattcactctatgtcccatgccatacacccatcagccgtctgcctgggagagtttctggaagctccatgcctcttcataggcacgttgccatgtaccacatggcaggcaggtgtgactggagcttggcattgcagagcccctgacttccaggagctcagagcctggcagaatggatattcaagaaagagccctcgtttctgatgatagggtctgtttgaaaagcattgtggttgacagagccatgccacgctgtctgcagaccagaggccgggcccctcgcagtgttgaaagttcagccctgccgttgtgggtagtgctccctaaggcaagggcagatgccagactattgttaagaagattatactaaactgatccttgtacagccctgcttctcgtggagtgatgacaccgaatgaatgagataaactgtctctttttaaaaagtaattaccccgatatagtgaatacccatctcctccagtgatatggacctgatgtaattggctctcagtctaggatcataaatggcatctgccaaggcatccttaataggaaatattaagaaaacattttaaagcttatctccaaagtgtttgttactgcaggttattttctggacgatgtatttgctcttccgagcaagtggatttgatgctcaattcttccattcactgcgcccctccctgccctggcttttgggaagataacatttcacaatcaggtttatttatgataacatctggtctgtcctccctactttattatttaagacttgtttgtgcttaaaaagaactttttttaatgggaacacactaggttctcaaatatactttcagcccagttacctcagtcatagtcatctctcatttctgtctgcagtttaagttcttatttatgtctgtgcagtaaggagagggagcgtgttgccaggagaaaagctgtaaacggctttgggcctcatcgtacagctacaggttgtacttaggacccgtgttagccacttagactacagctgtgcactgtgtccccctcatccccaccccgacctccagctgagaaataattatcacagagtccatgcactgaaatggaggtgtttaatcacaagaacacctccgcagtgcctgtgtgatcggccgtccctatgtgagctgctgatctcagagacagcattaggatggcgaccactgccccagacggcccagtgctctacccctagcgtgatctgaactgctgaagtcagagaagtccacgttggataaacaaagccagcccagtagtaacctggctgtcacagtgaccgtgtgtccgtcttactgaacctgggtttacgtgactaggatgctgacacaagtgagtttgcgcatggcttgctgttctcttcaaccctctccagcctgaataggaatgttaaacccactcaggaattctcgttggtctaaaggactgtgttcattggtctttgacactccgtcaaccaacttagcggggttgacctgagccttcggacacgatgtgcctgtgggtgcctgcctctcctcccacgagacagacctgaactgtctcctcagctgctcagctgattgtgagaaatgtattctgtgacaaaggcaggccacatttcagcgtcttttctgaagtggcatgcttaattccgcaggggcagtggggggatatttagaagcagtcggtgggagaggatgaactgctgagtttgaagtagtgaaaggggaaatcagtcataaaattcatgtttgagaattacaccagtgaagccgttgactgcctgggtcagagccgaagggccatgtttagtggctgggagccactcgcccccagcactggctttctgcatgctgcacgcctcttatgtcaagtctttgcctccatttttgtaggacctcttctttttcattttttttagttttatttgttcccctttttattttatttatttttcatttgtttaaatgtatggggtacaagtgcacatttgtaacatgcatagattgcatagggatcaagtcagggcttttaggggatccctcacccacataaacatacatttcaccaattgagtaatttcttacataggacctttctactgtcaacagtaattgtgggaattgtttctacagtgatttaagccttgaaagaagtaacttcctcctagtaaaattgtaaaatcaaatggtaagatgacgtggtctctaaggaggagtgtctacagctttaattactacactgctaatggtgagagggttgtacattttatctggtaagagaaagtctgcctctcccatgggcggatgatatgacttttattgaatggaaaaccggatggagattatttttcatcttgctaatgtagttttaaattatgtattccatgttcacattgtaattgtagcattttcttgcatgacactttcagcaaagtttggtagctgtttcccatgcttggcattacctctaaaggtgaagtaacataagaattgtataggaataccatgagagcataacgtgagcattatcagctaggtgagtgcggaagatcacactgtttaattgctggattgccagcttctgacccttctctgggagtgcggctgcctctgtacctgcttcatgacagtacaagcgtgaaggccacaggagaaaaagaacaggaccacacagcccagaccagccttggaaggcatgacattgcgtacagagtgtatcggttgcttctgatttccgtgatttgaaccactcttttattatggacttcaaagggaaagtaagcataagtttaacttctgtgctttggtttttcagataaaccttatctgatgggacaaaaattctaaaactatggcagctatcaaaattgtcacagctttataacagcaaaccaagaggaagagtggtgtaaaaatagactcagtctgagttttggtttggtttcgttttatctgggggagaaggaggttgccctagtaaaatttctacttgcaaagtcttccacgtgccattttttctgttaatatgttctcagtgagtggtctaaactaaatgtattgtgttctattaatcactgtttacagaaatttgccatttaggaatgtatattgtgcagtctaatgtgtgcatttcccagttttcacaaggggttttctcatgtgcatgtaataagcagttccacactgggttttcttgattatagagtctgtgtaacgctgtgacagcctggggtggcacctcgccacaatcttcagagttgcacattactgtgtaacattagaaactgctgctactctgagctcaagtgagtcaggggtgcaccccaagagctggatcactgtagggccagtgggttaccaggttgtcctcctacagaaaggggagatggggggaaaacagaccaccctgctgcagttttagcctgcatttccatgagttatggaaggattggaagaaaagctgactgtcagagttttgctctaatacagcttttttgtgggtttttgtgtgttttctttttttctgagacagggtccggctccgtctcatccaggctggagtacagtggctggtgccatctcagctcactgccgtctccccctcccaggctcaggtgatccacctcagctttccaagtagccgggactgcaggcgtgcaccaccacgcctcactaatttttgtattttttgtagggatggggtttcaccatctctacaaaagatggggttttgcccaggctagtcttgaactcctgagctcaagcaatcttccagcatcagcctcccaaagtgcctgtaataggcatgagccaccatgtccagcctctaatacggtttttaagtattctcggatgctcaaaactgatcgcaaaaccggatttcaaaattactatatagtttttgttactgtatttataaaacttagcacattgtggcttttaggttgctgttatggtgaggtcagcttcctgtcttggattttgagtagcttttgccctcctctagaacatggtgtgttcagttagatgctctcccttgatcctttgctcttcagcatgtcctaaacgtctctgttagacagaaccatcagttccacagtttggccccccttgagctccgtgttctctaccaccccacttggtgcccataaggaaagagacacataaaagcccctccttgctgtcagggggctcatgggctgtcattcctcaatgtacttggtgtggacccctgaaatgccaaacacatggaaaattctagcaccctagttagaggaacactgcatgacaagttcttgtttctcctggcagctttgtaagtacccaggcattcccttgcagagatgggtgtggtccctcagtgattgtcctgggagccattcagaaccatagctatgggtgatccttggcagcacctggttaacctgatgggaaagggtccggaaccgggcaggccatccaggccgtgtagatgatcagagggtgcgagcacaggatttaggcattggtgtttcatagatggataggtggtatgtccttgggccctagtttgagaaacactgatctgggctgaagctggaggtttgttttagaaatttgcttaaggaagtatctaatttcactgtagtttgctcagcctttagctttgcagattaagctagctacttattgaaaatacctcctcagaaccctctcctcctgccccccacaggcaacctatatccttggctctccaagcttccagggtctgttttttaagcataaatgcttctacttttaaatagtacttacaagatcatacgtcacctctgagcttacgtctctctttccccattttctcccctccatcctgcagaaatggaactttaaattctgatccaggagaaccagtagcccacaggcagtcctttgacctcctgacctgctatgcatcctctgccctgcagcttctcacatccccaggtggaaatgctgtgccccttcatccataccgtggcacttcctcactggaggtcacctctcctgtgcatggtcacattctgcctgtctgttgagaggctccgttcttcgctgcgttctgcttacctggttaagccacaaaaggttctatgcttagactagacgtgggatttaaaagtttccatgttcgtgtacaggagtgtacaaaatatgcatgagcaagtggtcacagtcatagacacaccgtgccttggggggccccaggtcataagatggtgttctctgtatttcacctgacgcctttggttttgttgctctgtgagaatgagggcagtcttttaaaggaactcatccagaaagaaaggagaagcaagtgtgttggagagaagatacatttatcatgtcattactaagccctgtattaaacttattgtaaacactagggtaattactgactccctccatgtgaggaatcagggaagggctgctgtgtccaggctttccggcgtccgtaagtgctacctccagctattcagtagctccagccgaaagccatgccctcccctttcctgcatccttattatcagctctgctgctcaccattgccaccaccttgtccaagcaattgacatcagtctttattgcctttttccaatccatttctcacacaccaggaggattttttatagatgtaagtcatatattactgccctgcttaagggtgtgtcttcgctttctggtgtacttgagataaaattcatacttttttttgtttgtttttgagacggagtctccctctgttgcccaagctggagtgcagtagcaccatctcagcttgctacaagctccgcctcccgtcttcatgccattctcctgcctcagcctcccgatttagctgggactacaggctcccaccaccacgcctggctatttttttttttttatttttagtagagatggggtttcaccgtgttagccaggatgatctcgatctcctgatcttgtgatctgccttctcggcctcccaaagtgctgggattacaggcatgagccaccgcacctggccaaatttcatacttcttactgtggcctacaggaccctttggggctggcctttcattgcttactgggcttccaatatgctaggctccctccactttctggaattggccaatttctttcctcctgttttgcacatgtattcatatatatacatatacacacataccttttttttttttaatctggttgacctcttatccttctggcctcagcacagacggcacttcctgggagaagactccccgattttccccctccatctaaaacatagcgctcagccacagttctagttgcatgcttaatgtgttggtttctttacctaagctaagctgcgggaagttaggcagcacatatgtttatttactcagtctcacggcattagcacctggaacaacaccaggcagtgctcacttgctcaggtttgttaaacagtgactctgatttttgtgtctttgtcttgttgccagattaagttcttgtctgtggttttatggccagaagaggcacacataaatgaatgagtactctgcctttaactcccttcatactttctgctcttttccttctgtccaatttattaagcacactgcatactatgtgccatgtcatgaggttcactgggtgacccccatgggaccatgtgactgatttgtcctctgaaagccagtgcttgctgggctggggagaagccagttgcacaaaaggttataacataaggcaacaggtaagtgctctcagctgagcaacttaagagactgtgttcaaaggctcaaggagcgagcatgtctggttgaggtctgcagaaactatgaagagggaaaaggtgtctccgtgggcctggaaggattagtcgggtttttataaagcagcagtgttggaagcgatggtttggatagaaggcatgaagtgggtagtggagtgtttctgatggtttatacacctctagaccttacctgagaaaggatttttttttttttttccccaagacggagtctctctctgtcgcccaggctggagtgcagtggcacgacctcggctcactgcaagctccacctcccaggttcacgccattctcctgcctcagcctcccgagtagctgggactacaggcgcctgccaccacgcccggctaatcttttttttgtattttttagtagagacggggtttcaccgtggtctcgatctcttgacctcgtgatccacccgccttggcctcccaaagtgctgggattacaggcgtgagccactgcgcccagccgaaaaaggatttttaaggcagttgacagtttggaaatacagggatatagtgttctgtttttaaatccaagcgaagatgtcatgacaaactgaaatgaaaacatattaaagccagggttatggttagtccagtccagggtatgcatgccgtggcattggtgactgcaggtgggctgcagatttggctttcagctgtctggtggcatgtgataagagtgtgctgatgagtcagatccacagtgctctcacacatacatgcgcacagtagttgctccgtagaagtataactgtgcacggtaatgagacttgaaaaacagttttgccctaggtcattaggaaagtttttcctggtttagtgaacaaaatgtgtccgcaccactttcttcacaattgatacagtattcatggtactgtttgctaaagggggtccttggtttgtagccagaggcacaaaccacttttggtattggttctagggatagctaaaagcctcagagttcatgtcatagagcatggtgtttctaacccccgccccttagctttaaataaaatattagaaaagaatctataattttcaaaattatttaactttaaataacttcctaggttagttttaaacctttaggggttacaggacatccactttcaaatttcaccttccagtaagtaaaaacatgacttacaaatacagaatccattcatgtcaagtattcatttaactcagcgaaggaatcaaaaagatagtaaagttgagtcaaagaaaatgcaggagaccatgtgtaggcactgaaacaacgctgggatagtttcagagaaagagacaaaaccggttaacggcctgcagggcagccatactaacctttgctgttgtcttttctcctgagcaggtgtcatttcaatctctaagcaatgccattgatttatatcactctcagttttctaaaattgacatccatatggagctgtaaaatactctaaacagcgctaaacagtcaaatgaaggtacatggccataaagaacgagatgatccctggtgggagtggctcccagtgccccagcatgatgttgaaaagatacgtggtcctttcacctgtttccaagttgggaatttttttttttcctgaccattaggaaaaatgttgacgttggttttggtgaatctgatttgacccattcttcctgggagtaataggataacacggccgcttctcatttgtgtagacaaccccagctcatcatcatctgcacgtggcctggagggtcactgttccctgcagtggctccttgggagaggagtagcaccctgttcatcaaaagcaggtagcaaggcgcacttacagttgctgactggcaggggcggaacgccgtagggctttgtagccagggtaagaagtttgggtttttttcagatggtgaagggattgaagtggaaacatgatgtgtgctgattgacatttgacatttgattgtcttctcagtccattttcagatatttgtgagagaatatctgaaactacgtaatttacaaagaaaaggaatttttctttcttgaagtgatagatgctgaggagtccaggatcaaggggccccctctggtggagcctctttgctggtgaggactctgctgagttcccaggcatcacatggcgagggggcagagcctgcttatgtgccagctcagctcactctccccctcttcttatgaagccaccagtcgcactcccgtgataacccattcatgagggcagagcccccatgacccaattgcctcttaaaggcccctcgtctcaatactgccacactgggggttacatttcaggatgtgtcttggaagggataaatgttcaaaccatagcagctgctgactgctctgaggagagtgacttgccggtgaggtggactagcagaagtcatcagagcctttctcagagtccaggccaggctgttaatgctggtggcttgcagatgtagaccagcattactaaactcttaaaagtttgtttccctgggatcaaagctaacttggcagagaccttattgtgtcttcagaattttcttcccagtgctcgaaattcgagccaaggaacgaaaatctcttgaatgagggtaattttattaacactcttccttattatttaattaaaatttttttatttcaggggtggttttaagtgccatcttttaaagcattacatcggtaatttgctaatctgagcttctctcctctccacagcatgaggccctgatacatttagggcctctgttaaaaagcaaaaagtgtgtggcagtggcaatagaatcaccaaagctaaaatcatagagaatggtggctcgtagtgttttaaaactgtttgaaaagtgattataggattggggaaaagttgatacttccatctttaagcagataacagaaagcctggttgcatgactggcaaacaattttagatttaaaaacaacagcccttggctttaaaatacttccaccttcttccggccttccagggaactctctatacttccttactaggagggttatactggacaaaagaggaccgtctagtctagggatcagcacgcttttcctttaaagagccatttagtagatattttacactttgaggccagacggtctctactactacttaactccactattgtagcctgaaagcagccaaagacaacaggtaaacaaatgaacgtggcttacaaaactttattcacaaaaacaggaagcagcccagatttggccaggagcccttgttggcggagcccgggtctagcctgttggccacccaagttcttacctgtctcctcctaaccttctcaccttgggaaacataatttattaccatgtatgcctgagtcatagaggactgactgctctctctatggtttctcctctcctaggagtggactattgttgatttttacttggttcttgctaggctgggataggggctgcagtggagggtgggaacagggtaatctttggttgttctggtcttaggccctgtgtgtctcacctgtgggggtgaagtgtttcatgatttttttcttctgctcaaggagtgaaagagttcttttttttttttttttccacactctccttcctttggcactagtagatcaacagggtttgctgcccttcccccagaggccagagagagggcagggcaggagagtacggctccgtgcttttctcatgggggtggcacgtcctctcctctgtgcctgaaagcctgcttcacctccacactttctcattagcgaactgctacgctgtcgtgccagtccacacgcagcctcttgcaggtctttagaagctcagctgagtttcttactattatctgtctcttgtgttctgccgcagttgagacagtccacatggccccagctttccttgcagcggctcatctttcctcagattgcaggctgtgtggctgccttgcaacctcagccatcctgcaagttcaagaacagttgtaattgatagtttatccagctgtaaccagcgttttagctgtgcacgggcctattcttcattctgagctattaagctggttttcatttgactttggtttgcatagaacacagggtttgcagaatgggtttgtgactggggtgggttgtgacatggtttcttagaacggggcccacacatggcccacgcatagaggtgtttcagtacagcagtaacagcccggcacggtaccacagtgttcacagttgtgggaacagggtgaagagtagactgtcctccagctgggagagtaggcagggatgagtcggtgcaagtggacgagtccaggacagagctggcttctgagcctaggaggtcgggcacgtatccttgcctttattcactgtgccctgcctgtggtttgcatgtgagaacacacatctctgtcttgtgtgctggggctggcccaacctcgtagatcatgtttaactctgtgttgttaggcataaccacagtctactttaatgacagcagatgccccactgtttagtcacactgcaaagagcatcctttcgatcacctcccagtggaaatccatgatgatgaataaattcctagattcggatttgtcaaagatttgttttgttttgtttaatatttttgatacaagttgtcaaaccatcttccaaaacacattttaccactctgctctctagccagtgaacacattttgcttggccctgatattagggttgttttgggtgtttgataaacttatgtgttttgacattagaattgtaaaccaaaaatagcattctaagccctgcagcttggaatgtgaactgcctcttggccaaggggaccctaaagaaacctacataactagttcaggccataatgtgggggatgggggcagacacacctcattatacccttaccgctttggagtttagacacaactgactagcattaacattaaaagagaaatcctaatactgacagaacagactctgtagcaaccagataccaacttccaacctgagtcaggtagagcatcacatgacagataataggtgccctgaaggaagccaaagtattttatcccaaaatataacttgacatattctgcaatgcccctgtaaagctctcttgtgggggaaattttcattctgtagagaatctccttcccttaccaggtcttttccagagaggctgacaccttttcagctctgataagagacagtcaccctatatatgaagcctgctacctggagacttcgtctgtacggcaagaagcttggcttccacacctccatatctaaactcaagcatttctttattctggattcacctcttcagatagggcttactcttgcaaccaattgccagttaggaaatctttggatccacccatgacctggaagcctccccaccccgccaccccatcctgccttcctaggccaaaccaatgtataccttacatgtattgatttatgtctttgcccataacttctgtattcctaaaatgtctaaagccaaactgtaacccagccaccttggcacatgttctcaggatttcctgaggctatgtcagggccatgatccttaacctcggtaaaatacacctctaaatggattgagacttgtctcagatactttctagtctacagaatgattaacttgattgctttaaaccttcaggtttggagtggccatcttttttacaaactgcatacctctagccttctcttaggagatgacgctacatgccaaatgttttaaatttcaaggatagtctttatataaaatctatgtacttgtggataatttcctcaaagaactcatgagatgagaaactctcgactgaagagaactaaaaataaagactgagtgaatgtcacaaccactgagaacaggttttgaaaagttcactgtgaggtaaatgaagaccctgttctcatggtctgaaaattaattgaaaggccaacagaatgacgcctggaagggtgaccagatgtatcgggggggggcgggcagtttctgtcccctggcctgcctccccctctttcagtgatgctgaccattcacctttatctgagtggttcattccagccaagcagctgagcctgtgaggacagaggcatctctccattctctcaacagcctgtttctctctaaaataaaatcacatatttccattttcttatgatgcttcctaattccaaggaggtgtagtgtgtagtgatcccctcatgctgggcaggtaccccggatggaggcctggccacgtgcacggcccactgccacacctccacctctgacaggtgggccctgaggctgatggggagtccagagcaccctgcccaccagagaacttcagctttgatccgttttgtttttgaggttccaagtaagatttttctttaggaaggaaaaaatagctctgtatacaggggcaatgctaggaaaactgttgcttttctgtactttgtggattctactgagtttgtaacctgccctgtcttatcaaatcgtttgctttcatggttattccttccttatggttttggggtggttgagtgtctatgtgtgtgttggcttgttttcttttaaagaacctcatggagaaatttatcttagatcttagaagtaccagattgtcttttgaagtcataggtttgtttttgtcttagaatcttcgttttaatggcgtttccatccttgctttggcctctagaaacaccagaactgagtatgtggcttgcttttaggagctaaccacaagactgactgtttctgtgtggtggttctgccgctagcttcttgttggggtttgttagactttgagtagctttgcctttgtagttttaagggaggtctataatgtatactaatactaatacattgtaaccaagcatagagcctcattatgatagcagttgagacacagttaaaattaatgtaaatgttactcaagtttaaactgtttctctaatctccgatttacagatgaagtggggggcagaagtcagaagttaattgtcctttggtgtagtctgctgttagaatactgagaaattgatagaaatggcagcactgaggaaggattaaaagtatagatggcaagttttcattcttaggctgttgctgttggcattgcagggagaaggttgaagtagacatgatgatgaatatcagcaaacaccttgaacccctccttactctgggtaattacagatgtacttccaaatgaggtgtctgaagttctgccctctgtgaggtgaactaggggtggaaaattagcacttgaacgtcttagcttagaacacattggatgcaataactataggttgtgagctaattttctttgaagtagatgtttgcctgtagctactattcatgtatctacccaagatagtatcttcctttaatatctaggttttgaaattaacggccacacactgttaatgaaatagagaaattagattgtaattgatcagttgtcttatgaaaacaatagttgcaaaagccagttggttctgagagtcaggataaacatgaagaaaagtattgatcattcaatcccatgtcaaagtagaatcatttctgcaggaaatgtagtttttgaagatgtgatcaataataagatcccactgctggagaattataccatgtcgatagctatggttatttttgtattttcatttgtcctttttaattgttgttgttattgttaattctgccttattctctgcactgaaaagaaaggttgggtgatgttctgccccccccccttttttttggcactttgaggtgacattataacataaaggttgttgcttttttctctccaatatttgatgtattttcaaaggctttaaaaaggaaataactaaatttaaagtaccacctgtcttgtttaatttgctttaggaatttatccctatatgcttagttagaatgataggattgatattgcgtagtaatttctgatgtttttgttttagtttgtcaaaagtaaaactaaatagcatgaatttgcgtctgtaattaaagattgaccgcgcttgaataaagttttccattaacttcttcaaataatggagttcacttttaaggatttccctttcctcagtgtttttaactttgattctaaaatgctggttgtagggatcgctttgaaactgctttatctctgtgtatgttttgaagaactgagtaaggatgaacacttcgatttcctttgggttactaaagactttgctgcttttctgatttaggagtccaaatccccttaaggattaatgctctcagaggagctcagcacaactcaaaatgaagattaaaattgacacaggattcttctacacatagtaatctataagtatgggcctttatactacagaaccttcagacgtgggcaaagacacttgactgtctctagttgaaacctgcgctaactgtatagttttgcatagtttatggtgatattgctaattagagtgttttgttccagaagaccggaacaaaacaagttcaagttcttttcgttatcctactgtcagtcattcagcaaaatgagtgtctttaagagtgaggctcctgcacagaaccagaggcacaagcttgatgaggcctggatcctacactgggtacatgtgtggcctgtgtgtatacattaaaactgcaaggctggctggcatacagcagttccaggatataaaaaaaaaaagaagtaagagtttgtgaaggtattgtctctaagctaagatagcctcaaaattggctagagattcttgcacaatttatcattgataatacaggttaaataaccctgtctgaaatgcttgggaccagaagtgtttcagatttcacatttgtcagattttggaatatttgcattatacttaccagttgagcatctcaaatcagaaatccacgatgagcatttccgttgagtgttacattggtgaaaagtttcagcttttggagcattattcaaaaaaattcttcgagttttcaggttagagttactaacctctctccaacatgtaaaggattttacctccttgtatccctgtttctccatcccaggagaactaaagtgaagacatttaacaaggaaatagaagtaatcacagtccatgattttaatcttttccaatagttttattataattactaattaaacacattctagataatttaggaaactattaaatatagcttcaaaaaattaaaatgaccacatgatgcagcggttctatttctaggtatatacccaaagaattgaaagccgggtggtgaagaaatctttgtacccctatgttaacatcatcaatagctaaaaggtggaagcaacccaagtgtctatcatcagctgaataaatagacaaaatgtggcctatccgcagaatggaatatgaatcagccttaaaaagcatggagattctcacacatgctgcaatatggatgaaccttgcggacatggtgctcggtgacataaggccatctaaaaaggataaataactaaacagttccacttacaagaggtacctagagtaaacgagagtggtgctttaccagggcttggggcgtgggagtggaaagttggtatttagttggagtctggggagacgaaaagttctggagatgcatggtggtgatggttgcacaatagcgtgaatgtgcttaatgccatcaaactgcacacttaaaagtggtaaattgtatgctctgtgccttgtgtcacaataaaaaatgctctagattccatttgctaatatgtaggacttgtgaaaaatatgcatatacaatatatattatggcaccactggactataattatttaaagacaaagtccataggtgtccccagtgagacgggactctgctgccaagcctccggcgggtcatgcaaacagtggagggcgccgttcctggaacagcagtgccccagcagctttaagcagtaggagggataaaagcaggagtggttaaagtgaaatggcagagctcattaatcaaattcgttcagttttattgattgattgagatggagtctcgctctgtcgcccaggctggagtgtactggtgtgatctcggctcactgcaacctctgcctcccaggttcaagtgattctcctgcctccgcctctggaggtgggattacagtcacgcgccaccacatgcagctaatttttgcatttttagcagagacgggatttcatcatgttggccagactggtctcagactcctgacctcaagtgatccacccatctcggcctcctaaagtgctgggattagaggcgtcagccactgcacccagccaaatttgttcagttttaaattgcatgtgtgtgtttgtatgtatgtgtggcttctcagtaactgcaccagcatgatacatctgtgtgtgtgtgtgtgtgtatgtgtggcttcttagtaattccatcagcatgatacatccctgagccattcctctggaaaatggtggtcttcaatccagctgtaggcatggcaagaagggaaggtcagtttcagcttcagggtaggtgggtagatagataaataggacagagatgggtgtgttttaagcacagggcaggaagcaccaacataggtgcctagtgcgtcactttccacattttccctccacaggacatggaatactagtgactaagcctcgttttctctctctgcccaagtaactgaagctcaccacatggtggcccagcaccggccttctccccatttgtgaaaaccagtccacttgcccttcccgtaggttgatgccagaagtaacaagaggactctagttcgaagtccttaacatttaataaacaagaagacatattggggagttacaacagctcttgatctttttatgttttattttttctccttaagctggctcggaacacattttctgagccctggaagatctttctcagcccccacttcctaggctcagctttttgttattcctcgtaggtgggtgagctgtagacttccttgtgccctttccaatgcctccacctttgtgtcatatgctttttaacttggtatttaacccttcaaaggctggctgcagtctgtttgtttccatcctggcttttcatggtaaaccttcatcatcccctgagtatgtagtgtatttggccacctccgtttctttgctaatggcatagtacctcgacatgccatatactttttttttttaaccaattacattcaaaaaatacttattgagcaccaactgcatgcaaagcacttgagagtcagttagaatcccaactccataaagtcttcaccagcattccctgggaatattcctaacctccgtggagaggtttcttgtcagtaaccactcatttttccaccacttttcttttgctagttcgtttttcacgtaggtaccgttcctgcctctgtggtggcagctgggtatgacggaggctgcatttgtgcagcctcatgggcctgaatttggtatgagcttagcacccctcacctgctcagtgaccttgggcaggcgaggtggttaggcatcctggacctgaagttttcatcttcaggggattatggcttgggggttgggtgagacacctggtactgcccggccagcagtgatgggtccacagatgctggttgccgacccgttgcctcagtatctgtgtctctgacctcctgtgaccaccttgctctgaaaagccagtatgatcgttcactgggatttcccctcttgcttttggtgaagaataaaacaaagttggaaagagttatcaatgcatgggcaatgaatcctgaggacagatgattaattaatatgtgaacatttttatcttcctgaatgatattgttaaaaaagtataaatacaagcagtacaagaaccagcagttaaagtgtgtctacattggagaccatttcactgtgaatgggtgagcgtgtttccttgggtgcagctttaacgagcagcacggcgtaatccaggtggtgcccaccagtacgtgcttcagagctccctgctggttgccagatcctgagccgcctgcttccccttttatcattgttatttatctgtgttaattacctggacttgaacagtccttcctctgatttatgggaattgttactgctgctgcaatctcagtgttctgatctgaaccatttcctttgagttaccctgaatatcctgttttgggcctcgaatgtgcaacatcagcaatggacaccaaacacaccgacctgcagcgggtgcccagcctcggggtgcgtctgatcacacaccacggggcctgagctccacccagagtcctcgggtgcctgcaagtgtggcccagggagcttttttccccccttttattttttactatttttactcaacacttatgtacatattacaattattatgtacaatataatttgatatatatgtgcaatatgtaatgaccaaatccatcacttcagacatttatcatttctttattttggtaacatttaaaatctgctctatttgaaaatatacaataaattattgctaattttagtcactctgcagtgccatacgacactcagaacttattcctccggtctagctttaattttatatctgttaactgacctttgactcttctccccccacccactacttcccagcctctagtaaccactgttttactccctgtgaggtcaactttttagcttccacatgtgagtgagatcatgcagtatttgtcttaatgtgcctggcttcgttcacttagcatgatgtcctccaggttcacccatgttgacccaaataacaggatttcactctttttttaaggctgaataatactccattgtgtgtatataccaacattttctttatccattcatttgttgatgggcacttaggttggtttcatatcttggctattgtgaatactgctgcaataaacatgggagtgcagatgcctctttgacgtgctgatttcattttctttggataaatatctagtcaagtgattgccggatcatatggtagatttatttttgaagaaacctgcatactcttttccataatgactgtactaatttacattcctactgacagtggataagaaagagttcctcttctaacccggtgaaaccccgtctctactaaaaaatatttaaaaaaaattagccaggcatggtggcgggcgcctgtagtcccagctactcgggaggctgaagcaggagaatggcgtgaacccgggaggcggagcttgcagtgagccgaggtcgcgccactgcactccagcctgggtgacagagtgagactccgtctcaaaaaaaaaaaaaaaaatcaaaaaaaaaaaagagttcccctttctccaaggagcattttttagaagtcccctggcaatcccgttgcagagtcagggtgagaacccctgctgtcatgtggcacattgcacttgccacatctaatacaacattattgtgtgtctctaggttcacaattctgtggtttaatcaggctagtcttatttagtcttaggaaaatataattaattatctagagttgatttaaaggtacattatctcattaattggtacttttatctcaaaatagttatttttctttttaaagtcccctcactgcttttggcacttaattttttggagttgattctctgtgaaaagttagctatgaaacagaatcattttaattgcaggaaccttagcttacgttcttctctctgttgattttcagaatgctccctaagcctgtggagtctcaggtatttaatgttctcatttcgtggtttgccgttcacctgcccttctttatatttctagcattctcaagttatttagcagtttccaggaattatttgtatgtttcatggactaaaatgccttttacacctcctctgttctcaggtttttcttttgcttttaaagtgagtttaaagcattctctgaatgtggtctttggtagtaagcatttccatcctcactccccattgagctcttgctggttggtttttatgacatcttgaagcatatcattaagttggatggttttatttttagggccaggtctaaaacatggctgtgaataaattttttctcgagtcaaccaaaaaatgaacgacttcgatactgagcagttgaaagaaaacttacagtgagttctgctataatgtgatatatgtgatcctaaaaatcgccacactgcaaaatcatgcaataaaagctacagggcttatgggggaaatgagattagaggtacagcccacaaagactttgtcatggacacattaacctaatagaaacagtagcacaatttcaagtgtcaaatagttaagaaaagcaagtactacaataaatacgatacattatcttgaaaaaggacagcagaaatttgcctgtagaagtgggccttggaagggttgcagcatgtggctactgcgaagcaatagaaggactgcaatctgaaaccatgcagaaagttgtaatacctgatgtgggtgggtggctgtttgagtgtgttttgtgtgtgttttgtgtattcctgcctagccagtttcagctgggtgcggttgtgcattcactgactttctccagacaattgtgcataaatgtgtgacattcgcagtatactcagatcgttcctaatgtgtcacttgtttttacaacaaaacatgattgaagtcctgatggtatatcaatgtctttcttagagatggctaagaatgagcacatttagtgaactatatattgaatggtttataccagcttgtatagatttgttatgcgtctgtcctcattacaggagctattcttttttcttttttttttttttttttttgagacagaatctcactctgtcgcccaggctggagtgcagtggcacgatctcggctcactgcaagctccgcctcccaggttcactcatgccattctcctgcctcagcctcccgagtagctgggactacaggcacccgccaccacactcggctaatttttttgtatttttagtagaggcggggtttcaccgtgtcagccaggatggtctcgatctcctgccctcgtgatccgcccacctcggcctcctaaagtgctgggaacagggtgaagagtagactgtcctccagctgggagagtaggcatggatgagtaggtgagagtggacgagtccaggacagagccagcttctgagcctaggaggtcgggcgcatatccttgcttttgttcactgtgccctgcctgtggtttgcatgtgagaacacacatctctgtgaataagaatagcccggcaggagctattcttagactgattctagctcatcgttttcccctgtactagaactatgcgcttcatgtagatttataacatacaactagttaggtagatttcattcattattcttttcaaaaatgtcttagcctatctccctgctaaatcctaaccaccgagttttttattggaagtctactagaattagactagcctttaactcggagacccctatggatagagaactggaagtgaaggagttagagcaaagacacttttacaattatttgtaaaggatttatttaacacattatgaagaaaagaggtattgatgtttaaagcctgcatttacttccatgttcatatgaaacatggttcttcaagaaaatttgcagattatgtaatctgaataaaattataaggttttgtataggtgaataggattacgttcaatatatgtaaataacaatattttgaaatattaaactccataaacggagagctattaattctgtagatgctatagtccttgctttttaacttcagaccaaagacaacagtggtcattaatatccaagatggttaaaaacagtttttgaactctttttgcagttgagacccttctgccttgaaaacattaaaacttgctaactcttgattagacaattctaaactaaaatataatcggagaaataccagttaatctttagctagtgaagaataatatcccagacatttttgtctggattttggatgctgtagtgtagtttcaagtggtttcttgattatgtcaaatatattgtaaaaattcacaaaatagcaagaggataagaattattctatgtctctctcaccaataaagagccaatattaacatttctataatttacattcctaataaactcacatggaaacattgttgatatctgtctgtccacataccccttctgttatctttcatttttatttttttcatgtatgattttggggatgggcagtggaaggacacaagcgtgggaatcagatctgcaggtaccacacacctttcaggtgtgctgcagggatttgaatccgattttatgcttaggagctcagcatgtgtaaggtgtgatgcaaatggcagctgctgtgatgcacttattgacccgtatttttaaaaatcttcagaagcataatagctatataatatcgtgtcaggtgcacgtgtgccataattaatttcactgtttccttactactaggcatgaagtttagggcttttggcaatttttccattttaaaagtaaagctgtttgaataccttttgtgtgtaaaaacatatcctcatgtactttctgttttaggagtaaaattctaaaggtagaattataagggcaggggttgattgccacatcttacaaaattgctttctaggaatgtaccgatttatgtatatgtgcccttcgctagccctaaattgccatattttaaagttttctaatctgaaggtagaaagaacgtcttttttttttaactcagatcaattttttatgttttagtgttttcattccatcattcgaatttactgtacgtgtgtgtgtgtgtgtgtgtgtgtgtgtgtgtcttttgagacggagtctcactctgttgcccaagctggagtgcagtggtgtgatctcagctcactgctgcctcagcctcctgagtagctgggactacaggcatgcgccaccacacccgactaatttttgcatttttagtagaaacagggtttcaccatgttgaccaggctagtctcaaactcctgacctgaagtgatccacctgccttggcctcctacagtggtgggattgattccaggcgtgagccaacacacccaacattgtgtgtgtgtttttacatctgttttatgctttgcagttattagtgttttaatgataatactagcttttcgtctgtgaaattttcaatttttatgtactagaattttttaagctttttcctttcctttttatgtttaagctcttctccgtctagaaactttacatgttctattatgctttttattaaacaagacttttgctatttattgaatgttttataccagcttattgattcatgatgcatgtatcctcatcatagaagctgttcttaaactgattctagctcatcattttcctctagctcatcattttcccctgtgctagaactgtgcttttcgtgtagatttgtaatatacaactagttaggcatatttcactcattattcttttcaaaaaaattttagcttgtcttcctgctaaatcttcaccaccaaggttttaattggaagtctactagaattcaaattgggaaagagaaatcactttacagtgcttggtgttctccagaatggtggcatcccaccacaccttttgtgtgtgtatgtgtgtgtgtgtgaggggggctgtctttttatgtttcttagtacaatttgatgttttctgtttgtttattccattttttttaagttgtttattcctaattttagttcaggattatggatgttttctttttaatgtgtgtttattttctaaatagttcccagaatctagaaatgctgttgtttagtatgtttttgcaattcttccccttgaactaagctatctcacaacatcttaaaatgccctttgacataaaccgtcaaccattagtaaagtaagattgtgcttccatgagtaatgggtaaaattggtacgtggttttgctctgtggcatttgtgtctagtcagggttaagttatctttgcaaaacagattggatgaattttctttcttttctctgtggtcagaggctatttgttactacacagctgttccttaacctgcatagcctataaactgttttaagaggtaatttgttaatgattttattttttctctttccttgcttttttttctgtttctgctacatcaaagatcagtctcgagaatttatatttttccaaagaatagccatttttttaagatactttaatatatttgtatagtatgtacaaagcggtttttattcatttttgttaagttggtatgaaagcaggggagacattgtttcagtgatgaggccaagcagttactactgtctacatttagttaattacacttaatatgcagttggtgcaggttcatttttacccatatatttactggtctgatactctttattcctttgaatgtattcaggcttctgtctggtattattttccttctgcctgaagaacattttttaacattccttacagtgcaggcctgctggtacaaactctctcagcttttatctagaaatgtgtttgtttctcctctgtttttgaaggacatttatgctgcatttgtgctgtgtatataggttggcttttttttttctcttcatacacttcaaaggtgccattccattttcttctgtcttgtatactttctgaatgtaagtattgagttgatctgttattctatctgtaatctttttgttctcatgttatcagcagatgataataggccttagtttggggtttgtgtgtatttatcatagttagtattttttaagcttcttgaatctgtcagcttctggtttttatcaaatatggaaaactttccactattatttctgcaaatgttttacttacacacacacacacacacacacacacacacacatacatacacaccccttctctgagactcaaattacacatatgctagactgcttaatattgtcctacagggcactcaggttcatcgttttttctgtttcttctcctgtctattgctgtgccttcaggttctctgatctttttagtatctaattggttcaacatattcaatgaaatttttattcctagtctttcatttctgcattatgttcatgtttttctttaaatgcttgagcacattgagattataacagttttgaagatgttcttttctcgtaataccatcatctctcatttttagtctttattaactgattttatcttagtcactggtcctattttcccacttttttgcttatctagtaatggttggttgatgaacattgtgatttacattttggggtgctggattttgttgtatgcttttttaaagtgttagatttgttctggcaggaaattgttagttgtatatcagtttgatcctttcacagcttactttgaagctttgttagtgaaattttaagtattctttattctagagctagattagttccactgctgatatgtgcctgatctggggtctctctactgaatgcctcatgtatttgatgaaatctctgctctggctgattaggacttccggccctaggcagacttgagattattcagtttataggtctctggtaattgttctttcctcaaaagttgttcactgcccagccttgtggaatttctccctgtgcatgctcagattggttcagcaaagactcaaagggatcccctaggctctctggaactttttatctatgtagcttcctccttttccatatcatgtctcacaaattacagcctcctgggcctcccccaagtcatctgttctaagacagcatttttgccagctatgtctgggtttcccatccctgcacctgcactgtggcagctgctttcggtggaaaggcgggtggactgttaggctcaccatgtttgtctcctttcactctgggaacattgccctgcacagcctgtggtccagtgcctgcaaacagttgttatgtctattttattcagtttcctagctatcagtggcaggtgaagaagtacagacgctgttctctttaggtgggaagagggtgtcacaagtcattgttagagacttgcagtttttgaagcagtgatatttaacagatttgccatatgtatttgaggatatcctttttgctcttgaacatattaaaagaaaatcaattactgcaagagatactaaaataggtttctttcctagtcgaatgttatgttaataaatcctaggaaagccttggtactctgaatccaaatccgtaaggaactctcagttcacagaggcaacttgtactcccgtgtcaacgatgagagtcatcgttccaggggagtcgcactaatttccacagtttggggtgaggggggcggtttttttctgaatctcagtgtttaccatttgtttagtcattagcagctacttctgctctgaagtgtggagcttaccatccctggcttgggttgaggtaatgagctgtgtgacacttggccagtcacttagctacttgtctctaaattgagggatctggactaaagagacttgaagaccctttccatgagtttactgagtaaacatgtactgagtgttgtatgcactggggatgggtggataagacaggcgaggaccctgctcttacacagcttggtggagtacatcgatgatactgtaaataaaaatacaatgagaaagaaataactttcatgggtgctttgaaggaaataaaccagggtgatatgaagtgctgatggcagggaccagcattaggatgggaggcccaagaaggcttgtctgagatgctgaaatttgagctgccgtccagatgagcagaagaaactggccatttgaattccaggtcataggcgttctaggcagagggaagaacacatgcaaaggtcctgagatgggcacaaccctgggtgacatgagaaccccgggtgatgtgagaacactgtggcatgattgtcttgagtagggggcatatgtgatgatcagggtcctagtcagtgctggcagcctgtgactccaagactcgatcctgctgtgaatacttctctacctaaatagtgcaaagttcagtgtcacatgccctactcagatgagtaacagggagtgccaggaattacattggggtggggtgtggtcgctgaagctccaacaagatcacagagtctgaaatgagcagggacctcactggcacgaggagccaacacagttttaactcaggagtctgaaggccaagttcagtagtcttggtcagcgtgagccaaaatgaatccatttttaaattagcagaaccacggatagttcgtagggactatcgcctcaaagaaaatgctgaagctgtttctgagactcacgtataaaggctgcatgggctccatggcctagaaatgttgcttcggtggaaggaagccaccaggaaaactgctgggagagtttaaggaatgtgtgacctttacgtagagaaaggaaagacccagtgaaagcaagagcattccagaggtggggagagtggacctgaagccagccagctttgccctggtgggaggcaggtttcttagccatttgggctgccttaacaaaataccatcaactgggtggcttgtaaatacacaacagaattattgtgttaattatcctcataattctggagagaaccctaagatcagggtgccagcaggttcagggtctgctgagggctcacttcctggttcacaaatagcacctttctgcagcatcatcacagggcagaagagccagggggtgtcggccctcatttataagggcactcatcccattcatgagggccccacccccatgacctaatcaccccccaaaggccccacctcctcagaccatcaccttgtgggtgaggatttccccacgggaatttgggtgagacacaggcatttgggccatggcaccaggccttccctgtgttgccaggatgctgctttttgtgcttggatatagcagcaattgaaaaatccagctcaggttgaggaactcttaaagacccaggagctctcacttggcattaccagctgctggcatgtgtagtctgaaggaacccccttcttagaatgcccagagtctccacgtctgtctcctgtcccaacatgccagcaccgtgtcacgtagcctctgcctgcatctgcacagcattgtttctggtgtggtctctttttaggcagggaaatcattgctgtcggctgtcacctaagtggcaatgtcatctcacctgcacttttaacaactgctgtgcccacgtgtgtttttattgatcgatttttagttgtctttcattgtgtcctgtggtctggcttccactcttcacgccatagtgaagcattgcccatgcttacgagtggcctctcatttctccctgcgtcgcctcttctgcattctcctccacctctgtaacacctgcccctgcagacacatcctcactgctgtggcctgctctccttcctttgaggaaaccagttattattgccttcctgcttctctgctgcctcctggctctgcctgcgcccctccccagcacttcccagctggcttcagcaggctcactctctgtctcagtcttcccctgggagctcatactgtcagttcagccatttctggcaccaaccccaagtacctctctccaaccctgacttccctcccctgatctagatgtgcactttgggctatgcacatctccacctggatgctcaccctggaggagcaagcatctctccctcgcctcctccctcagcaactccaggctgccctgtggaagcccctcttccgctcccccaggctcacatgtttagagtcatccagcatccatttctctagactcagaaggttcctggccatgtggactctgggtcccagttgaatgggttgaagaatgatggacagagggagaggtgaagacagcaagtgcaggcaggtgaggccgtgatgggactgagactggaggaacagattagagagggttcctgaggggagacgagattgtcaaacgtttttaaacaaagatgggagaaggatctggtagggtagaggatggaggttaaaagaaaaagtctttcctgagtccctcagaaggactcagcaacacctttgctgactggtaacatccgacccagtggtctccagttagaactactccaggctacaagtcctttggaagcttgtagagatttgacagcactgggatgacagaggtcaggattatgtgtcactgtgttgttggtcatatcgacaagtcactgaatagtagtgcgtattgcagtgtgaactggaaaatgaattacagtgcatccctaccttgggcctcgcctgccacgcagccttaggaaagaacaggaagctatgttctgatagaggagccattctaagatattgtggaaggaataaccatgagatgtaacaatgtgtatatcttatatatgtacaagcaagacaacaatgtataagatacagcatcttatactacatctagtgtactgccatctgtgcttttaaaagccagggtggtggagaagtctgtattgatgttttcttgtatatccatggagatactctggaggggcccctgagaacccagcccaagtggctaagagggcagggggatcctgtgtaaacaggatcaggctgtggggggctttcaccttaatatcttttatattcttaggtttttgaaccatatgtatgtattataacctctttaaatttttcaaaaatataattaaaaaaaaacctctagcaattaaaatattatttccaccagttgaatgaaagtcaggttgttttgccagggaggttatttggctcctctgaaatgtccattcatgagttttctggtggctttggcttattctctttcactttggaggaaatatttctgattcataattcttcatgctccgccctcagagaacttctgccattgctaatgctactagtaaagtctgatctagttttcttacatttcattccttttttccccatccactctacattcatcaccacattggatcatatttggacaattcatacagacaggaggataattatttgcattcttaaccaggcacagtggttcatgcctgtacatctcagctgcttgagaggccaaggtaggaggatcacttgaggccaggagtttgagaccagcctgagcaacatagcaagaccccatctcaagaccctggcaaaacacagttgctgctgttgagctgtgacatacgagggaacgttggcaggatgctttatgtggtgggggagaggagagctatcttcagctgcttaacagggctgtttgaaaaaggagtggaactggaacaagtagatggactttctgatagtccctcccagggcagctagaaacaactcctgagtgtcccacaggggtggtggtctgaagtggtggctgccacacagctctatgacccgcagagaaggctggctgcatccacgtgtctatccagtttatcttgcatttggaaaaagaagtttcgactagatggccttgactctaataataagatgttttcttgattattttccttttttctttcggcttctcaaacctggaatagatactctccatgagacccattctgtcttgattctgtcctttaaaaaaatctctaactatgtagcttcctttcaataagtacctctccatctgtattttttaggcaaggtgaaacaaaagagtgactttcttgtcagagcttgaaagagagcaagtggctttaaaagtagactttggctttctaaaggttctaagttttaatattcttatattcgtttaatcctaagtgtgtaatgaacatctttatccaattcaaagatgacacctgggagtgaactggtggtgggacatcacagactactgtgatttcaaactctcggcaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtgagaggcgctcttgggctggcgtgggcttcgcgcttctccctgcctgatttccaggcctgcctggctgaactggctcttcctgtgctctttctaaacctccttttgggccatctcccgatgcccaccagaagggagggagcagaggggaagttgcgggctttgctccatgtcccacctccaatggccgtgaattcaggatgcttggcctgtgctgagtgtccatccccattctcccgggtgtgggtccacccaggcctctgtgcctctgtggttcacctcctgcctggaagctcttcatctggcgggcacggggctccatgaaggcacgtgggaaatgtgtgtgcacgcgctttgctttagctttcatcagatccttaaagggttctttgttcagacagaatttaagtgcccccggggatcccagtcccttcagaatatttatcatctttccagtccccagatactcctcagcggttgtagcagaacacacagcaacagggatttccacacatgctcattgctgatagtgcctagtaagtaagttttccagaactggttgttggaaaggttagaacatgaattttgtgaagtttctagaatcgggagtatttgaacctaacctatatctttccaaaattttaagtcctagtagtttgtgagtagctaggttgagttttgtccagacaagaaaacttaactacagaaagtctgtgtgttcgcccggggtcacataacaaaccagttcaaagttggtccttggtacatttttagactgcagagtcccttcattgattatttttaaatgcttcacagagatcatttaaaatgattttatgccctaaaattaccagtccatgctaatgtgcttggacttaacgcacttacgcaccaaactattttctgtcccaagtgtaatagggtagtttttaaaacaaaacaaaacaaaaaacagtagaactgaatgagtttctttcaactggtttgaatgtgccacctgctgtccaaactggagaaatgcccagtgatataataagcaacttgccttatctaagagccgcaatttgccttatctaagagccgcaatggctgtataaatactaagataacgtagattcccatgtctttttaattatactcgagttatgtagttatattttactccatccccagcatctcaatctctggttacagaaaatgagacatttgcaaattaattaaaatcatggtagatatcagtaactgtatcaggctatgatgcatttttcacagatgcagattctccagtaataaaatgcttttaggcagggtgcggtggctaatgcatgtaatcccagcactttgggaggccaaggcaggaggatcacttgagcccaggagttcaagaccatcctagacaacatagcaaaactccatctctacaaaaaaagttgaaaaatgagccaggcatgatggcacaagcctatagtcccagctacttgggaggctgaggcgggaggattgtttgagcccaggagttcaagaccaccctagacaacatagcaaaactccatctcttacaaaaaggttgaaaaatgagccaggcatgatagcacaagcctgtagtcccagctacttaggaggcggaggcgggaggattgtttgagcccaggagttagagagcacagtgagccttgattaaaccactgcacgccaacctgagcaacagagtgagactctctccaaaaaaaaaaatgctttaagattttaaacccaaaatattctttgccactttaacttctggtgactttcaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcaggtatgtaaaaatgatgttttttaaacattggttgggtgttttgtttttggtaaaccaatcctgatagaatgggcctgaccaagccttgagaataagatacacatcttctcccatggagagacacgagcagcaaaattaattaaatcatctgtctcttctatgggcctgccataaattactacttgccttgggcaaaatcttttctatgggcctgccatgaattactacttgccttgggcagataactgatttcaaggttggtttaaaccctgcaagtgttcggagaatgttctgatgattagagtagatgatcatgggtagccagagttcctattatttgtgccgtgagtatgttctgtcctcaacccctagataaagatctcttccaaatagtaagttaccatttgctcgactctgaagtaaattgtctaggctttatgatgagatagctccgtaacaccacatggagagttttgttttttggttttttttgttgttttttttttttgtttctttaaatacaagtagtgcacattcttgttcagtttcatcctaagttccaactggacagagaaccagatagtaggaaataaaaagcagaagtcctccttgtccctcactcccctcaaggtatccaacattcattggtgtgtcttccccaacctttttctgaacattttgttataattttcagtttaattttttagacttacttttaaactcagaagtaaaaattgtatatacttatagtgtacaacatggtgtattgaaacacgaatacattgtggaatggttaaatcaagctaattagcatatgcattacctcacatacttactattttgtgtgtgtggtgagaacacttaaaatctactctcagcaattttcaagtataaaaatacattaactgtggtcaccatgatgtacaatagatgtcttgatctaagcattttcaaatttttatttcatatatacacacaaatagtatcaatttagttctgttgttgctttgcaacttgcttttttcatgtgacaatatgactttgagatatttctatttccttggttgttggattttcctctgctatatgataacatatatcagcaaaactttctctaaaaccacttaattcgtctaaaatcatatcccctcatttatcatgctaatcactccatgtataattagaagtgtctgatttttcggagatgaattttatttaaaatggatgaaacctagtcatcaacatgaaagttggctatgcttctctactcacctccctaaaatgacatatccccaggtggcccccataaaccctttgtgcttgcctttttaacttacagaggatgaaaaatgaaagaaaacgtagactggcaaaatggcagtaaagtaagttggatcttttccaaaatcccagatttctggagggctgaagttgaactacttttgatagttactaggctccagctgagcactgcccttggtgcactgggctttctagcacctaaacccttctagagcttgcacagcaggattggtgtggtgggtaggggggctcttttttctgttttgttgagtctggggtaggcagggacgtctttctttgactgacacccaagatggctctgatgggcaccaaacagcccatcacaggagtcctggaacccacacctctgggttgaaggggattgccttagcctctcatgacatatttaatcattttcagaattactatattttctcatatgatgtacacatgtatttaggaggttatcccttaatcttttgaatgttaccttttacaggctatcacattatgtgtggtttttttcagaagtggtttgaaattttatagtctgatcttattaagtattgtttctaatctcctaggggatttcatccctgtggtacactaggtgggaccatcttgttcttcagtttaagattaaactgcttgatcagtgtcataaatccttggctgactctcagcgcctctaagacagcttcattattatccattcagggtgaattccatgaacttaacttttatttttaaaatacaaaccaccatgcctcctatggtcactttgcatgttctccataatatcacgctgaatgtacacataatattgtgctttttggtagctctgcggtcataagaaaatcggatgtgtcagccagtgccttctgggtcctggctccgttttcccgtgtaggcttttccctggctccacttgtgagcccgctggtgcctcgccgggtgcagctcactcctccctccagcgttgaattcccttggacagaggctgtgggcttgtggcgctgggatcagtaaaagcagaggaaagctagatccagccaggtttaagtggagatctcctttgttgaacttgatgtcactttaaaagttcactttcatcagctccctgctccgtccactctccctactccacacaaaaagctggattgatattcttgtgaagagccaagtcctgctttaggaaaaccaacttgtttcttctttatgtgactatatttttgtcaatgtgaattttccttaatgtagtctggcaagatcagaaaaataattagttacaccagagtcacttaacctttccttttcttatttgcatttaaattaatttttatgtggataaaagctcttcctgtgtatatttttcatttctctggtgtcttgtctcatgttccttaaaacttggaggcaaaggacttcatcgtagcaagtttccaaaggaaaagcgggaagcaaacaggaagatgaggtttcatattaggtcaccaggtatctagagcagctgactttgtgacgaggattcgtggtttgcagtttgcagggtaattgcaacaaaaatattctgcacctttgtggttagaacaaaattctttcaagttcatggacagcattaggcttttgaagtctgccagaaccagtagctgccactgggttttaaggaccaggagacttctctccccaaaagtgaggtttcttcttcctcccacagagggagaccgggggccctgcccaagcagtgccccaggggcaagaggatttgggagagaacaaagtgagccagtaaacatgccccatgaccctgacctgtaccccattagtccttcaaacgaaggtgccattcaaatgagagagacctcagccatggaaagcagcacactggctgcccaacttcaggtccctgctgcctccttctccccaaacgttcctttgacagtccctacatcttatgtgattttccagctgtttgatatttccagattagtaaatgtcctttaaaggaagagttttgtttaattataaagtctttttagactaattatgtggcaaatatcagcctccttccctgccatacccaacaacagccttgaattcaattccaaagaaacaaatttaacttcagtacattgcatggcaaacatttgagtgttcatacattttgatttcaagtttaaaacacacttggctgaagcccacagaagcaggggctacttgggagaggaccgtcccaggcttgaaggcagcccctgcctcgcctctggttccttgtgccttgatttgcagctcccttggttaagcctttatggtcctgggaagtttctactaggcagagaaagcatttctgtaaaggttttcttttttaaaacaaaacgagtctctgtgtgcaccacatccatttctggcatctcagggctcactattcagaatggccagttcccattccctgaaaagggaaggggctctttgctccagagcatgctggttcattcataccccgtccagaaagagccaccagcttcaggtgaagtcaccattccaggcaaaagtaaaaataaaatttcagttccaaaaaatgccttcagcctatcaaaatctaagtttcgacttaccaatatctattaatattttagaagcagatttttttatacaaatatatgggcatggaggcaaggatatatgaaataattccttttactgtttttctgtagaattaccttcttattaccttgactttgatcatcgcttttatgttaatttattgccccatccgtggtttccagatgtcagcctgggcaacggctataacagtttgccttctgttccataaggcagatgaaattggagctactcagattttggaaacagctgttccttatcattgagagacagttcagcagttttaccttttcatgagtcatcagttactgggcctaggaaatgtatttccatcttgtgtcattgaccccatatcttcaaaagatgacacaactgaaatagcttcatgtagttcttctaggcttatttcaagagtctgcttaaaaggttgtctgacactctgatcattaaaccccagtgtgatctttctaagaatgcctcaggctctctcatttagaaagacttagtgcaactcattcatttgaatgagttaattcttgctcaatgcaaagatcccacaaaccttgggggctaggctgaggtccagccgctaaactctgcaattcctcactctcctgttcatacacacacagacacaaccctcctcacctccctgacctgcccctgccaaaaaatatgagtcatccgtcagtgtctcggggagttgagtggggagctatctcagatgctgagtcatgattttcagagaagatctgaacagattgctgtggttttaaattgctgaattgtagagagcatctagattgttattttcagtattaaagatgggggtcaggtttagaatccagcaagtgaaaagctgtccttactctgcacttctgatctagaactcagcctgcactgaagggactatcttgtgtttcttcttttctccactgtgtgaaatcataacaagaaacaacctctgagcataagatcagcttctagtatttaggggaagaaaatgcacattcctaaagtggtatgacaccaagctaccctacattgaaaagcagcctacttttccagcctgatctaaagcaaatcccaaaatagcatgggcttgatttattaaacctctgtcctgtgcagaggctgccccacgcctgaccccactgtcctccgaactcctgctgcagccgtaccctccagccctcagtggagcaggatgtgggtacaggcctgagccctgtgctgtttgctcttcttgtttgcaggtcgcatgtcttgagccagcctgtgacactcttgtctctgtatcccccagactgttcagtccacttccacataaactcaggaaatagcaattattgccagataatcagtgagctgtctgaaatcatgaaccaaggccagacccagatcccagggtttttgtgaaccctaatccaccaccgtacacttaacaccaggcagtcttagtatgccctgggccagatttcctctgtgacagcttcttgatttgtcttgtgaagcccagaatatgtactgggctcctgtgtcttcgagggaagacaggttggggagcaagatgtgttgtttatagagcccgagagccacctgcaaattccagtgcagctcatggctgcatgttaccctgtggccttcacgtagggcctgtagtgacagccactacatgcgtgggctccaggctgtcaccaaacctttacaacacgtagtaaataagtctagggtccacaactgctggggaaggccttaaacaaatctcaagtcttcaggatttccgtagcatttacatcttggtaaattgaattccataatagacttttcctttgctcaaatatgcaatgttttgagtaattccccatttatttttcattttagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgtgagtacctttttaaaaaaaaaaaaaaaaagtcattctagaaagcttcctgaagaaatctagtttggttattgtttttctaaagctgtacagtgtgtcattctgtggggactttccatcttgtaattcagatttgggttcatagacgttgttgacctttgttgcatcattccctagagaaggacttcattcactgaggagcctaccactttgcataattcacatggatatctactgttagtaaatacccaatcagtaacccaaccaacaatttgcaattgaaaagttcttcacctaataacttaaaaactgcacttttaagagaaggcaattttaagagggagcaaagttacataggattagagggttgtcgtccatataattgtgtgtttttatttctttaactgtttaatccgttcattatagtagtttgtgtttgtattgtagcttgtgatttatcaagcagttattcacatctcattctctagtccttgaaatagggcaggaggtggtgtcacaggtcaggttctccagaagcagacactgagatgagtttggcacgtggagaattagcaggtagtcagtacctgtggaagggatgggaaggaagcaggaccgcacagaggaagaggtcaaagtgatactatgcccatcatccttaggggtgggatgtgcgggaagcgttgcaccctggacgaggtggctccctacagctgagggcatccctaaaggcgccctgtggccgtctgctaacagcagcacccgcagccaggcagccaggcctccccaggagcgatcatggcagcacagttccatgtccaccacagttcaccccagggccattcagatcattgatgcaccttttgggggccagctccttcaggttccaaggggctttctttctgggagaaacttagaggaagaagattaggcagcaataacttgcaggccagaacctgaaatgtttaacctggatgttataatcagtgggtaaaagtgtgatgagaaaaaggatatttggatcctctcattatttgcagtgggaaaaatagtaactttacagtaaagaaacctggcagctaccaccttgccgagtggtcagagttcacagaaataagacaaaagccaacatgaagcactgaggggaacacagccttcgtcgctgcgtgggatttctcctgaaggtgcagcagctcagtctcatcatgaggaacgtcaggcccagactggggggcagtctgcagacacccgcagtgctccaccaaagcgccaaggtcggagaagacgtggaaagactgaggaaccgtctcagactggaggagaccaaggggacacgacagctcagaacatcagggacccaggatgggctcctgggccagagaaaggacaagagtgggaaggctggtgaaattcacatcatgtttgtagttgagtgactagcacattgtcagtggctttggtcatcttaagatgttatgtgacattttttaacctagggagagctgcctgaaggtttatgggaactctgtactacttttatcatcttcctgcatctaaacgtacttgaaaaccagaacgtttaaaataaaggaatacaagagaggaggaggaaggtgactaggccagactgtgtcccccagtgccgcactggtctcagagctgccctgctcctcaccttctcacaccccagggtagttcccctcacccatagctcccacctctgctggcttcagcagccgcccaaatgctaaaacactcacccccaagggatctgtggcctgctcactgtgcccagctcagagttgctgcacttgtccacttaactgctatagttgatcaggagaggaacaagcagcaccggcctgcatcccatttcccaggccacgtgtccttccagatagaggtctttgtactgtatgtgctacaaatcagaaaacgctgctgcccaccatcatggagccacctccaaactggcacctctcaggccgtgccgacgccctaccaggctggcggctgtggcaggtgctatatgtgacttagccacaggactctcgggtcctgtcccctgacatggtctttgctgtgaggctggtgttctggtcacaacgcaccaccctgaggcaccccatgctggtggactagaccttccatagccacagagagtgatgctgcctgaggatctgcaggtgggacaggcagactcagacccagaggatatgcccatgcctgttggagccgtcagcgtgctgcccagcgcccacaggcgggcctccctgggaatggtgtcttgtgggccgatcacattggcatctcctgctggcaggctggacactcagtagcaacagcgactgcatcagcctttggtaagtcagagactgtgctgttgaggcccctctggccagccctgggtggccagcgaccaccagccatctctcaaagctgttcagtgccccctccatggcggatgctctcaggtggacattaatgtgagacagcaacctgcacgcttcccattcctccacccaccacacgcctctgtccaggacacccacccctgctggcagctagtgttattctaaccttgatccacttttttttctacaccagggggtgaccaggtgcatctgcccccagtgggggcattttcctcaccacattctctttgaggcctgctggatgaggctctggtgaagttgctgtcccctttttggcttgcccatccacccagtgagccaacccacccacaggccacactcggtcacagggagtccccccatggctgtaggtatgagctgaggcagggcgcaggtactcaagggtctgggggtgacgcaggggtctaggctgccggcccatgccctctggagcttgccaagcccagctgtgcatctgccgcgggccctgcctgaccttgcgcctgtggggctgatggaactcagctcgtggtggtcactccccacatgtggtcatgtggggtcccgtggtcgggcgctttgcctctcccagtcccagccagcactccaggcatgcccttccctgctgtggatggccccaccggctgtgctgccctcctccctctggcactgaccacaggctccatatgcatcttgtcccacccctccctactcagccctggcctttcagcctcactcagcagggcccccacctccctcgtgcttccagtagccatcccagcagccaggtcagaccatctcctgggaacctagcagggccaaatcagtatcgcaggagagcccccacgtcagtgaatctcctgtccagcttgtggttgggccccaggtcaggcgccctgagaatccaggccctcgtgttttctcacagctcccacctgcacccttggctgggtcgtgcagcccgtttcagggaagaggcgagttacaggcctgacgccaggagaggggatggggcaggttttggggggcagtgttgccttgctgagagatatttgccttatcttctagcaaggggggcttacgtgttctgatagggatgggtgggccatgtccgtaggctcgggatcagaggaagctggacttcaaagttgggggcattcacccagaagcgcctataccaagttctagggtacctccccacccctcacaagctgacagaccctcctccagtggctgattaacctgggtggagcttgtccactcttgctgacaagtccaggggctaaggccaagtctcagccctctctgcctcttgctcccggctgcccctctgcttgcacccatgtccctgcccctcacctgtgagagtgttagcacgtggacggctgcctgtgccaggtactgtggcttctccacctggcctgttggggggtggtccctcattgccagctggggagccgtgcagtttctaaacctctctcttcaccctcggtctgtccactcccctcgtcacaaggtggtttctctggaagctaagatagatttgggaagcagggtctggtagattaggtgccagcgtccatggaagggcagaaaggaagcaggattgggcagagctgactgacagggagctctggaaccacgtggcctcacggcggttcccggtgccccactgcagttggccgtggggttggcggccctgggaagagcggtccatgggggaggccctgagctctctgttgcctgctgacagcacttcccacagcaggcagtttgctggggtggggacgtgggtggcttatccaagtcatttgctttgtcctttacaccgtactgcacgcacctgacaccaccagactcccatggtagagtcattatcagtaaaatcagttcatcgtagtgattactgtaaacgagactgtgtcctgccagttaaccctgtcccggcaggaaagaatcctcatcctctggaacatcccgtgaatctcattttgagttatttatccaaaggaggttgagatctgaggttctgacccctcccactgtatgatctatgtagatgtgtggtgtcggtgcagatgtggggcaaatactaaaccaccttgatgttcagacacattttggccaaagacattttggaagtggagccctggagctgaatgctgctcaggggtagaggtgtcagagttcaccattcccagaaagggccatgaggcttgaagtcatcacaggacgaatgcctgccctctggtcagccgtgtttctccctactctacaagccttggcagatctttactttacgcttcccctggagatgtactggtgcctcttgagctgctgctttcaactgggcagttttcacccccgacctcacccctggggaacaatgtctggagacaacttggttgtcacacatgaggagatggccgttagcagaggctggggtactgctcggcaccctccatagcccacgggacagccctgcttagcaccctgcatgtagcccccacaggacagcccccacaccaaacaacagtccagcccagaatgtccctagtgtccagggggagaaaccctgctctaactcaagagcgaagagcctgcatttcactcggcgtgaattctacactttctgagcagagtatctgacgaagcctctctacagaaagtgaataaacgttgttcagatgacttcgacaactcttgttgaaagtgactatgcagatgatgtaaatgatgtcgttcctttcatgagcctttggtgtacttgagctttcagcagcctgaggcaagactggacaagtgtggttttccccactttgcatgtgcagagctctgccaggaggataagctaaaggaatcacattatcaagataaaaagaatatgcaaatagtgcaggctgtgtggcctctcctttcttacagcaggccctccgctgtaggcgagggctacgtaaatcagccaaggagtctcttccagtttagccttcctggtgcccagtagacattcatggagtgcatggaggatggcacggtctgacgcccacaggctcccacgtggaaatcttgcacctctcaggggcctgctggggtgtgaagctggagaatgcccagcgagtacctgagggccttaccccacgctcacaccttgagagccctctcttggggacttcagagactggcctgagggagcaggtggtaaaacctctgccacagcagtccccataaggctgaagattcctggatcccctctgctcatactgggccagtttcctcgccacccgtcctgctgtactctggccaaactaaaaagacatctctatttaactttcctcggcatttcccatctctctggatggttccaggataactttcttttaatagttggacaactttgaccacatcatggggtgatgtaggttgtctacagggagtccctgtgcactcagccatctcagagcaacgtgctagctggtcaggttcccaccgcctgcatctgtgtgaatcggttatttgggtagaagtttgaaacctctcattttgaaactactgaaaatagtgtgtttatataagaatatgctcacgcaaattgcgtgtatttaatcctataatacatatcttaccaagggagatttgttgttgttgttttcttgggtgactgtcgttcaaaccaactcactggccgtgtttaagtgaaaaagctttaacaacctagcgtgagccctgtcatttttgctcttgagtaaattgagaaatgcccttgcttgtcctgcacatccaaccacctggaatggagaacaccgaaggtagggaaaggatctccagggatgagcaggcctggagccggcggggctgtggaggaagaccggccgcaatgagtgagtgctgagcagagagaagggccgttctcggctggtatcaggcccaagagagtcaacaaaggggggacgaaagggagacagggaagagaacagtggtggggctgtaagttgacctccaggtggcagaaaataaagttggaagaattgactgggacagacagccagggccctgcaggaagggcgggagaggaagcctgcggacacctgccctttgtgattgaaccgcagacaccaggcctggcggggtcgcttgcctccgctgcccaagctaaggctccactaagctggtcctgagaacatacttcatgctcaacttcagggatgtggctgtagtgtcctcactctatgctgagaatgaaagaagcacagtctatgaaaggaaaaccccgacagcacagagcacttcgtgcggcagcagcacaccgggagtcccactccctttcctgctgcgtttggatctgccgtgacaaggactatcagaaccactcacagtaaggtcgggtcgcgtttctaaatccactgtttatggaccgtcttttcactgagaagaagctcgtcagttcaggggtttctagaacttctccagactcttcaaaaactcatgactttctccaagttggtaatcccagcactttgggaggcccaggcgggcggatcacgaggtcaggagatcgagaccatcctggctaacacagtgaaaccccgtctctaccaaaaaatacaaaaaaaaattagccgggcgtggtggcgggcgcctgtagtcccagctactcacgaggctgaggcaggagaatggtgtgagcctgggaggcggagcttgcagtgagccgatattgcaccactgcactccagcctgggcgacagaaggagactccgtctcaaaaaaaaaaaaaaaaacttgcaaaccctcatgaggagcctgtccccagccctgttttccagcctctgcctgcatgggaggggcagtgagtcagccacgtgtttgctttgccgcctctgcctgtgtgctctccaagctgcgggtttcacatgcagtaaacggcatcaagacattgacagaaggtgtatgggcagtcttacactgtctcagcgacttcagggccaaaactgtcttttgtgattttgcctcttttggaagtggaagccacctaccgaaattgtgttttaccagagccccaggagctcatagtcaaggctttgtgacatcagagttgttaggaaggttaaccgggcaagataaacgacagaccaaaaattgtcccctcaggccagtgtggagtttctttatcagacatgtgtgcaccccttcccgccttatctcggcatctgtgagcctgtcatttgaatgatgtaaaatccatacatgttgtactgagaccttaaaagtgatctagttcagtgtcatgtattaaaaaataaagtgatctagaatccaggacaaggttaaaattaatttcatatatacacatatatattcttttaaagaaaacctaatgttagctttctccactgagccgtgtgaggtgactgtagccagcccctcaagcagattacggtcatttttcgccacattcaagccctggatagttctgtcttttcgtatccaagcgatacaaggcagcctccaaggtacgctctagcagaaacggtcgctgccattagaatattttttctgtatattaaaaacaagtcaccattggcctcccagataaagaaaaggtttggtaggaattctgtgcctggttcaaatccttaaaattataaattgcctaactttgcatatgctgattttcccaggattgttttgtgtattaaaagagctcacacgtgggaagggccggcattagggggaggaaggcagatgagaggagaggaagctataccagtaactttttaaacgaatggcaaaaagaccttttctattttagatttctttattgagtccctgtaattctgtagtaggttgtaaaataagacactttttgctttcctttttaagaaaaaaatcatcagcccgatagattactttcccacctgcccaatggactgcaccttgcacagggtctgttcccagcggcccctagaggatgtgccccatttccctgcggggctggtatttgtgaatgtttcccttcggtgtggattttaagggatgggtcttccccgcccgcctcccaccgcaattcatattacatccactcttcttccttgcaggcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtatgtctaattgcttctgttacacgttactttttaaaaaatagaaacttttccctcagagagctcacaaatttgcaattattcctaagtcctttacgtttgtcctcaacagagcaccttcccgtgaagtcctgccagaacctattgccgccactgcccccacgcacgccttgccttccctttgcaaatacccaggaaccacagaaatggacttcagtctgaaatgtcagcaagttagcaaatgtcctatgaaagtcaacaacaactaacatggatataattctttactggttccaaagcctttcagtcacattattagcttctcccctgtttccccacagtgggcctaagttgtttttgggttgttgttgtttgtgagatggagtctcactctgtcgctcaggcttgagtgcagtggtggaatcttggctcactgcaacctcaacctcccgggttcaagtgatgcttgtgcttcagcctcccgagtagctgggactacaggcatgcgccaccatgcctgggttatttttgtattttcagtagacacggagtctcaccacgttggccaggctggtctcgaactcctgacctcaagttgatccacccacctcagcctcccaaagtgctggaattacaggcatgagccactgtgcccggcctcctaagtttttgtttaataaatgtgctaaataggccgggcacagtggctcacgcctataatcccagcactttgggaggccgaggagggcagatcacttgaggtcaggagttggagaccagcctggccaacatggcaaaaccccgtctgtactaaaaatccaaaagttagccaggcttggtggtgcacgcctgtaatcccaactactcgagaggctgaggtgagagaatcgcttgaacccgggaggcggagattgcagtgagcggagatcccgccactgctgtccagcctgggcaacaaagcaagaccctgtgtcaaaaaaaaaaccacaaataatttttttttaaaatatgcttgtaacaaaattgcatttggcaaattataggatgtgaaatgtataatattaactgacacgactcccatcccaggcagacaagcaaccctcattatgaaaattacattttgtttagaaaaattccctcaacaggcatccccagagctttctgggcatcagcagagcagacgtccagttcgggggtccacgccagtatgcggcagtggcgcggggccgaggctgctcacaggctgggtgccgacagcccagctctcctttgaaataagccgttttgaagttaagaatgcacccagtgccaagtgtgaaatgtgctttatacatatgttaggcccgacatattgtgagaaaatgtctggtaacctttttaacaggtgattgctggaatttgatgattgcctccgtaaatgtggaggcacaggggacccgtgtctgcccgcatgcaccctgctaactggctgcttgttttccggtgcaggtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacac

SEQ ID NO: 36335 - DNA, 15865 bp, Homo sapiens
atttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccagtgagtgttggctgcggccaagcgcgggtctcaggaggccagagagcggcgcgggagcgtgtgcggtccgctgcggcgcccgggccggggtggaggcgggaatggggcgctccggaggccgagcggcggcctgtcagcaccggagccccccccgtcggagcggggtgcatttgcgcagtgccccgcagtttacatagtgcctgaggtttattgtcgcagacattactgaggccggtcgcctcattctacagagtggaaacaggtctggacagagagagctggtgcaagggaagcagccttaatgtaggagtcagaaaactcgaggtcttgtccagggtccgcctcccattggctttatgaattggctcaaggctctgggcctcggtttccccatctgcaaaatcgagagcattgcagtggatgttttgcgaggcctcgctcggatagtcggagcttttgcaatttgcaaaggtcacatgatgagttagaggtagaggcaaggctggcagccaggtatctggctcccagccttacactgtatgactaataaaaacagcgcacatttataagcccttattggtttacaacgcgcttccaagtctatgatctcattttatcctcacaagaattccctaaaggagaaataaagatcctggttttgcagatgaggatgcaaggcgcaggaagagcggggcttatctaaggatgcgtagctagtcagtggcagagctgggtgacgtagttaggtgacacggatcttggaccctgaatccatgcttttttcataccttccactatctttccctttgatattttatcatgacgtacagacattttcctttcccttttcgttgtttcatcagattactcgtttcccctcccttttgctattcacttccttctcttctcagaacctgtacattgatccaaagagggggaagaaggaagggaaatgatggaaaaggaatccctcactttgaagaaattacagctcgcaaagtaccttcacatttattgtttccttccaatcttcgggaagctctcttttacgttccccagcaccatccttcctggcatggttcactcatttgttagatgtttaccgagtgccctgggggcatctgcattgtactggaagtgagagaccagctgtaatccttatcctcaaggggtgcacagtctacgcaggcaagagtgtaaatgatacctctattgcgggttgttgtgaagatgaattactgtactgtatgcctagaattgtgcttggcacatagaaatgtgccatgcaaatgtgccatgtaaatatttttaaatatttttattgtagcgattgccactttgctccttggaatcttccaggtgataagtgtctgtacgctaatcagttgactggtagctggtagactcaatagcttcaggatggggactggtcacctaggaagactaaagggtattagaaggttgggattttcagtcctaccccccatttacctggggaaatgagaggaactgaagtcgtcactagtgaccagtgatttattgaatcatgcctttgtaatgaagttttcataaaaatacaaaaggacaggattcaaagagcttctgtatagcagaacatgtgggggttcctggagggtggggtgcccagggaaggcatgggaagctctgtacttctcccatacctcatcctatgctcctcttcatctgtatcctttgtaatatcctttacaataaactggtaaacataagtgtttcccacaattgtttgagtcactgttgcaaattaattgaacccaaaaaggaggtcatgggaaccctgatttacagctggtagatcagaagaacaggtcaaacaacctggggcttgcgattggcatctgaaggggcggggagtctggtgggactgagacctcaacctgtatgatctgacactatctccaggtacctggtgtcagaattgaattggaggacacccagatggtcacatctgaggtcacagaagtattttgttttgtcagagaataggagaaactgagtttgttattcctgtattctcagactttataatttctttgataatctgtctggagctatagactaagatggatggcagggatttgaatggcttcatgtgtatctccatgtcatggagtaaactgtattcatagagtacacaatcattgttcagatatgaggtggtgataatggactgctattctctaggtgcttggcacatagtagttgttaataattatttgttgactatatgattgtcagatagtcaggagactatctcctcagtcaggagactaaaggaaaaggtagttccatagctggaaagcattctggggccagtacagaactggcttagggtcaaatgtcttgctttctgctagttgagtgtgaggatgcctagtcttgttggggctaatagcagatgaggaatcctctaggcccaagattgccttcactccaagctcactaccagccttttctctacagtctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaaggtgcctattggctgccttagtctagggccatcttagctcagagcctgagaggatgggaggtggtgccagtgcactggaggaagagatggtgggctgtttatggctaaaaggaaaagatgtgatggcgggggaggcccctgggttatgttcttcatacctgctttccctttcggcagttgctcacccaatccggcccaagcctccctcagccaccagcatcccggccattctgaaagctttgcaggatgagtgggtgagttcctgcaagagaatcagcatcttccccacttgaagagaatgcattgctgggttaggacttgggggtaggaaggatggagcattatttagagggtaaactttgtgacatcagggatttgttttattcttcgttgtatccccagcactgagagcagcacctggtacatagtaggtgctctagagttatgaattgaatgattgaatacatcctgcaggactgtctggcacagtgcctgacacaacgagggcgatcaataaatagcagcagcagcagtgttgttattctcttttagagaggggacggcatgacagctgggatttgccagtaagttagggaaggtggggatgggaaagagctggctcccactcctgtctgtgtgcccagtggttcgcttggggtaggagctcaagagtgtctgccggcacattcgtgtttgctcggatattgtttgggtcactgatactggtctaggctctgggataggaggcagcatcccctccccaagggctgactccactgggtactccctgcaccccccacctcaccttacaatgatatttgcttctcccaggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaaggtgcagcctctcccctgccatcccccaccctgggctggttctgcattgtaatatcccatttctaacatcgtcttttctctcagctctggctaccctgaaaccacaggctggcctcattgtgccccaggctgtgccaagttcccaaccaagtgttgtggtaagtgtcccccttcccttaccagcagcccatttgtgtacagtggcccacagaactgtccttatgcaggtgtctttggtgctctgtgcctctcaccctcacctttcttctcttcagggtgcgggtgagccaatggatttgggtgagctggtgggaatgaccccagagattattcagaaggtaagtcctgctctcacctggtgggagtgctgatgggcccttacttttcaccatctgtctggagtccatcgtgactaaaatcactgtgcttttgggagttgagtggtgcagagcatggaccctgggaccagattgcctgggtttgtattttgatgccactacttgtaagctttatgaccttggcttacttagccaacccttacgtgtctcatttccctagcttctaaactgagaatatgatcatatccactgtataggcaggctgtgggaatttaaaagatttcattactgataagtgcaccttttagctcttattgttattgagattctttgcagatagtaaactacttttatatattttcttgttttttttctatgagggcaataggataggaattataatccttattttgcagatgaaagacacatctgagaggcagagctgggcttcctgattgcaagtccagtgggattctcatttgcagggcttcttagtgtctttctgagcagttcaaattgtcagcatgtgtctgagcccttggcttagtggcgtgtagacctatgggagctctacagtcctagcttctattcttgctctgctgtttatcacctctgcgaccttgggcaattgacttcacttctctgaggctcagtttcctcagctgtaaaataaggtcatcaacacccccctcataaagctgggatggaagtaagaagagagaatgcctttaagcctgtaacgtagaagttggcagatagcaagttcttggtgctgcttttgaaagcacaggtgtgaccagcatctaatgtacttttctccttgcaagatgatttgtctcacattgagcctgttcttccccagcttcaagacaaagccactgtgctaaccacggagcgcaagaaggtgagttctctttctgaagcctggagaaagagctggcctggtgggaggcggttgactccttaggagagagagggcggctgaatcttggattcattgctgctcttctttgggggcttttcattttctcagagagggaagactgtgcctgaggagctggtgaagccagaagagctcagcaaataccggcaggtggcatcccacgtggtgagtgtctgggtctccactgtcttggagacagccctcccgttttgtttctggggtgggcgggccagcatggggagtgctgagtgcagagctgtcccaggttcctggcgctgttcctggtgctgtttctcgcctgggctgctgagttgtcagggctcctctttctgcccagctgtgggtttcctagtgatgcagtgagggagttaccgtaccaggcagatagccaagaggtatggataaggaatagaagtaactcttgctcccctgagaacatgggtgactggagatggcagtaggggaggtctgtggctttgtggcctgctgtgatttggccgtgacagggtttggtgtgtctctctgcaaaggggttgcacagtgccagcattcctgggatcctggccctggacctctgcccgtccgacaccaacaagatcctcactggtgagagtctgggcctagcccggcaggccaaagtggggaggggcagcagggaaggcgcatgctccttgtcctcttcatgggcatgggaacaaaagcatttccttgagcaaaagggcctgggtgggcctgactcattgtttggtctttttgggtcttctccaggtggggcggataaaaatgtcgttgtgtttgacaaaagttctgaacaaatcctggctaccctcaaaggccataccaagaaggtcaccagcgtggtgtttcacccttcccaggtaaggggttctcctcgccacccttggttcttctttccttggctgttgtttgtccctcaccccgctgctgtctctgtgaagtggggctgggaaagagctctgactctgactcctgagtgggcacttggaggggctcactttggagttgtggagattgcccttcactctgcgtgagaccttctaaagcagtgatcttccagccagggagagaacggaaatgtgtagtttgacaagcatattcattgaaatatttcatattagggaaagaaaaaatcttatagtgttcctaatataaactacagaaaacaaagctcaacacaatctcaactcacacttacgaggaggacagatatatctgctttcccatgatcctccaagatgggtaaaaatcatgttgactgttgaaagtggtgtaggttgtaaacagaacctctggtttacagggtaaaggtaactcatgggaccagattaatgatattatgggattcgaattttaagcctaagacagtttgggtttggggctgcaggacatggttggtttagtgcttcgcagtcaagatttcccttggaccttagggaaatgagaaatataagaataacatggtgaatttttcatgactaaatttgttcaaattgagagcactgttttcttgcttatggggtattaatagttaggtctcatgaaattgtattgataaaaaaagatggtagttatttttaccttatggcttttaatatcctaactaaacaaaaaattggtgagtgacgcgaaattctctccctgccccaaatcttttggaaaattaacttaccctggaaatccataaaagtggaatgcactgaaatacagccatgcagccccttccagtcccagtactgctcagacctgtgccatacagtacagtagcagttagctgcatgtggctatttaaatttcaatgaaatagaataaaaaattcagtccctcaattgtactagctacatttttcctttggtcctggaaatgggaaaattgctctctgttgcagttagcctttttaccactagatggcgaggacgcctccacaagccctgatgctgtatgagttagcactttaatagcgtttaccattggctgtcttgggcaccattgggtggataggtggttccagggagggcagagctgaaaggagaagcaattgttggcagttgtgggcatccccagccccgttttataagattgttttggtctgtatctcttttctgactctgatattctgtctttgttttccttgtaggacctggtgttttctgcttcccccgatgccactatcaggatttggtcggtccccaatgcctcttgtgtacaggtggttcgggcccatgagagtgctgtgacaggcctcagccttcatgccactggcgactatctcctgagctcctccgatgatcaggtgcggtcccagccagtgccctggagaggcctgctggtccccaagcttgaacatcctgggtggcaggaacatcttcccaccccagctggttccccagaacctcaaaggagaatgtttgccagggtttgccaaaccaggggctctgtcttgctgaagggccaccagaacctgggacccactttctcactgactccattgtctctttttttttccccagtactgggctttctctgacatccagacagggcgtgtgctcaccaaggtgacagatgagacctccggctgctgtaagttgcctcataggcactcagcttttttgtttgctgtttattatttatttttacattttatttagtcatttgtttatttgttctaaagatatatttaccatgagcacctgtctagtgcgggctttgtgctgggttcactgaggaatgtgaagaacaaggaacctacctttgctgctcttagtctctctccctggtgggctctgaccacaggtctctcttccctcctccacagctctcacctgtgcacagttccaccctgacggactcatctttggaacaggaaccatggactctcagatcaagatctgggacttgaaggtaggacatggtaggcctccatctgaggcccagggccagagggagtgtttgtgacaatgcagtgctaattaggtgcttgtggcacctggccctgaaggtggagagacactggctgtgcgtgtgtgatatgatggtgtggtctggggggtcccgctggctgtccttcctggaaggacgtgagggacatctcaggtaggagtttggtgagccccattttcttcctctcatgatctgtgggtgacgtattttactacccaccgccactgtaggaacgtactaatgtggccaacttccctggccactcgggccccatcactagcatcgccttctctgagaatggttactacctggctacagcggctgatgactcctctgtcaagctctgggatctgcgcaagcttaagaactttaagactttgcagctggataacaactttgaggtgtgcccttccccctccgcccagctttccattgtgtctccttgtttgtcaattatttattgaattaatctaattgcttctgcttatccgcaactgccccatagtttctgttccccttgtgtgaccttctctctttctatttctggcaggtaaagtcactgatctttgaccagagtggtacctacctggctcttgggggcacggatgtccagatctacatctgcaaacaatggacggagattcttcactttacaggtagaggctggtcctgggctcctgggatctctctaggtgcccaggcccggagggaagcctcactgggttaggaatttctagggcttgcatgaatttacctaagcagctttctgttaccacctgaggcagagctttatgactaaggaagcaactgagtcagactgcatggcagtagatgctagtgcttgttctgccacttccatgccctgtggcattgggcaggttactaaagggagagaaaagtccctctgaagttttgataactgaatctaaaataaatgaacattagacagtgacaggaggagagccattttaattacgtgcatatgcacgggaggcccacattatattagatctgcagaagggtcagatgattgaagcttatacagtttatatatcacttaataatggggatatgttctgagaaatgtcttgttaggtgatatcgtcatgtgcgaccattgtagagtgaacttacatatatctaaatggtgtagcctactacacgccaagactattgctataaccttagtatagtctattattgctcctaggctacaaaccggtacagcatattaaatgtagtgaatacaattataacacaatggtaagtatttgtgtatctaaacaagtgtaaacatagaaaaggttcagtaaaaataaggtataagagatttttttaaaatggtacactggtatagtgcttgccatgaaaggagcttgcaggactggaagttgctttcagtgagtgagttgtgagtgaatgtgaaggcctaggacattactgtacgctgctgtagactttataaacacagtacacttaggttttactaaattcataaaaaactttttcttcagtaataagccttagctgacttttactttataaacttaaaaaaatggattcttttgtaataacatttaacttaaaactaaaacacattgtacagctgtacaaaaatattgtctctctttacatccttgttctataagcttttttctaatttttttatttttattttttactttttaaacttttcttgttaaaaactaagacacaagcacacattaccctaggcctacacaggatcaggatcaccaactgtattagtccgttctcacactgctatgaagaactgcctgggtaattgataagggaaagaggtttaattgactcacagtgactcgggaggcctcaggaaacttacagtcatagcagcagggaaagcaaacatgtctttctttacatggcaacaggagagacaaatgctgagcaaaggggctaaagcccctcataaaaccatcagatctcgtgagaactcactatcatgagaacagcatgggggtaaccacccccatgattcagttacttcccactggctccctcccacaacacgtggggattatgggcactacaattcaagatgagatttgggtggcggcacaaagcctaaccatagcaccaacatcactgtcttctacctccacatcttttcccaccggaaggtcttcgggggcaccaacatgcataaacctgtcatctcctatgatgataatgccttcttctcggatacctcctgaaagggcctgcttggtgctgttttacagttaacttttttttataagtgggaagagtatatttaataccaaaaaaagtatagtataggcataccttgtcttattgcacttagctttattgtattttatggatactttgctttttataaattgaaggtttttggcaaccttgccccaagcaagtctgtcagtaccatttttccaacaacatgtgttcactttgtgtctgtgtgtcaaattttggtaattcttacagtatttcaaacttcttcatgatttattgtgtccgttagtgatctttgatgttgctattgtaattgttgggcgggggggcaccatgaaatgtgcccataaaagttactgaatttatttgataaatgaaatgctgtgtgtgttctgaccactccacccaccagccgttccccatctctctccctctcagacttccctatttccttagacacaacaatattgaaactaggccagttaataaccgtattatggcctctcggtgtccaagtgaaagaaagtgtcccatgtctgttacttaaaatccaaagctagaaatgattgagcttagtgaagaaggcatgtgaaaagccaaataggccaaaagctaggcctcaacaccaaatattagtcaagttatgaaagcaaaggaaaattcttgaaggaaattaaaagtgctactccagtgaacgcacaaatgataagaaagcagaacatccttattgctgatatggagaaagtttcagtggtctggatagaatatcaaaccagccacaacattcttttaagccaaaccataatccagaccaagatcctaactcttgaattctgtgaaggctgagacaggtgaggaagctacaaaagaaaagtttgaagctagcagaggttggttcatgaggtttaaggaaagaagccatctccataacagaaaagtacaaggtgaagcagcagatgctgttgtagaagctgcagcaagttatccggaagacctagctaagatcattgacggtgggtacactcaacaacagattttcaatgtagacggaatagccttctattggaagaaagtgacatctggaacttgcacagctagagagaagtcaatgcctggtttccaagatgcaaagatcagagtgattcccttgttagggactaatgcagctggtgattttacattgaagccaaagctcatttagcattctgaaaattgtagggcccttaagaaggtggggctaaatctactctgcctgtgctctgtaaatagaacaacaaagtctggatgacaacacatctgtttacagcatggtttactgaatattttttaagccccccattaagaggtactgttcagaaaaatagattcctttcaaaatattacagtgcacctcattaccctaaagctcagatggagatgtttcatgcctgcaacatccaatcttcggcttatggatcaaggagtaattttgactttcaagtcttattacttaagaaatacattttataaagctatagctgccctggatagtggttcctttgatggatctggacaaagtaaattgaaaacctggaaaggattcaccattctacacgcccttaagaacatttgtgattcatgggaggaggttaaactatgaacataaagaggagtttggaagaaattgattccaacccttcagccctcatggatgactttgagggattgaggacttccatggagggagtaactgcagatgtggaggaaatggtaagagaattagaatccaaaggggagtctaaagatgggactgaattgctgcaatctcatgttaaaactttaatggatgaggagctcttagggatgaccaaagaaagtggtttcttgatggaatcttctactggtgaagatgccgtgaacattgttgaaatgataatgaaggatttagaatattacataaacttaattgataaagcaggtgcagaatttgagaggattgattccagttctgaaagttctactgtgggtaaaatgctatcaaacagcatccatcacagagaaatcttttgtcaaaggaagaatcaaatgatgtggcaaacttctttgttgtcttattttaagaaattgtcacagccacttcagccttcagcaaacaccacccttgtcagttagcagccatcgacatcaaggcaagaccctgctggtgggtcttggaaaaagatgacaactcactgaagtgtctgatggttgttagcatgttttagcaataaagtatttttgattaaggtatgtacattgtttactagacataatgttattacacacttaatagactacagtatagtgtaaacataacatttttttttgagatggagtcttgctctgtcgcctaggctggagtgcagtggcacgatcttggctcaatgcaacctccacctcccaggttctagcacaggtgggcaccatcacacccggctaatttttgtatttttagtagagacggggtttccccatgttggccaggctggtcttgaattcctgaactcaagcgatccacctgcctcggcctcccaaagtgctgggattacaggcatgaaccaccatgcctggccaacataacttttatatgtagtgagaaaccaaaaaaatttgtgtgccttgccttattgcaatatttgctttattggtagcctggagctgaaccagcgatgtccctgagatatgtctgtacataaaccagtaacgtactgtacctaattatgttatactttttttttttttgagattgagtcttgctctgtcacccaggctggagtgcaatggcatggtcttggctcactgcaacctccgcctcctgggttcaagtgattctcctgcctcagcctcccgagtagctgggacttcaggcgtgtgccaccacatctggctaatttttttttttttgtacttgtatttgtagtagagatgaggtttcactatgttggccaggctgatctcaaactcctgacctcgtgatctgcccacctcggcctcccaaagtgctgggattacaggcgtgagccaccgcgcctagctatattatacttttatacaactggcagtgtagtagatttgtttatacctgtatccccacaaacgtgaataatgcattgcattgtgacatgatgatggttatgacatcacttggtgataggaatttttcagctccactgtaatcttatgggaccagtgtttgtgtggtccgtcgctgacatgtcattatgtgacacatgactctatggcatcctgaactgcagaagggagtaggggcctaaggcttctagggggtggtggtgacacaagttatgtggggggatggggaggaagtgcactacagagtctctcaggtaataaaagttgtctcagagcagaccttagataaataatgcatgacagtctgtgacaaagactggcatctagtcttctctcttgtgagaccagttcattttccctggttgagattcccaggaaggggattcatgatgttcctttcagatgacctgcccttagagaaagaggggcaagagacaggagggcaggacatggtcagagagaccttggttcaaagccctcagcgtgccaaaccaccatactttggggtattgttttctgagatccaatattacttaacctctcagaaaagtgggaatggtaactatagactcagtggggttgttgaggtttagatgaaaatacatacaggtgctccttgatatacgatggagccacatcctgataagtgcatcataagctgaaaatattgcaagttgaaccatggtaaatcggggaccgtctgtgaatacataggtcagaacggtgtctggcacgtagtcaggatttgcagttgttctcactcagcattgggtcttagtctgtggtgggatagagcagtgaataaaacagacccgatttgggcactgatgtaatttatagtcaggttagtaaggcagatgtagattaatttcacatgtacacatttaattgcaattataagtgctagagaagaaaagcatgagatgctgagagaatgggtaacagggtttctaacctaacagttatgtggccctgggtacgtgactttccctttcagatcttgaactccttcatctagaaaatgggaatattggcacagctttgcagggtgtgacagctggtgttgtggagatggcatgctaatatgctggtaacagggtgcctgatgctcacttaagatgctacatgaatgggagctactgctgtgtgtgttgatgaaattctcgtcctcattagcaggttgtgagcaggatacaagatatttcttcttgccccgtattctcctgagccctgctcagtgtgtttgtataacaaaggtgtccatcctaacaatatggctcaccggttttcaccctgtactgtacctggtgttttgatttagaaccgagttaggtagctgaaaatacagcgtgagctttttaatggggagttggttgactccaggtgtgatcctaaatctagaaggaatttggccagatgttcatgaatttctggagtcccatgaggaatgttgcccagcctcatctgcctcttatctggtcctgctctgtgttaggggcctgagtgccctggggttggaacactatgagctagaaaatgctgatggactgttccacttacgagcaagtagtgagcactaggcataaacaagctgagctctgaggtttttcaactaaacctagccgaactgcagttgcccagaaagctcaggtgagaagggggggctggcattgctttattcattcatcccaccagtgaaaaatgccaggcactgagggaggcactgggggtagtgtgcaggtcagcctagggaaaacaaacaggagcctgcggtgtgataaatactaattagagaaggcctggttgtttgggaatctgttattagggatcagtgttcagactaaaggaggaaaagccttctcacagttgcctcttatctttctcctcagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttgggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataaccataaccac

SEQ ID NO: 36336 - DNA, 65131 bp, Homo sapiens
ggaggcgaactgtgggccccggccccattcattgccgtggccggcgggcactggggccccgtgttttcagagtcatggaggcgctaattcctgtcataaacaagctccaggacgtcttcaacacggtgggcgccgacatcatccagctgcctcaaatcgtcgtagtgggaacgcaggtgagagcagcaggcggcgttcgctcgggccagaccccggccgcaggcctggtcggtgctgcggcagtgcccactcccgcgccagcgcccactcccgcgccagcctttggggcctgtgggaggagggccttgctgggggccccagggctctccgggctctgccgcacccgccctcccggggcagcgttgcatcaaggcggagaatccggggcccggccaggggcggagccggcgcggcgggcctggctagcccggcgggtcccggggacaggagagggaaggatggggccggcgggcggaactggagtccgctgggaccgggcgcggcctcgtccgcgtgccgctgcctccaagggcacctgggggacgcgcggggcactcgggtctcgctgggctcggtgggctggctgttcccatcactgttggctttcgtgagacgggtgttttatttccctccttgccttgcccagggactgcggagttagttttggaatcgctctgttgaggctgagagacgctacggtgcgtgagcgccagtgttttcctgcagtataattccaccaggtttcgagaacgccgaagcagcattttaaaaaaagaaaaacaaaacgtgtatctagagttctgcgggtgttgggaaggaatatccgatttttctgcgtaggctgtgctttttgtcttccacagttttgtgatcgtgacctaaattgggcatcagtttctctggtcttctcatagctaactcatttttttttgaatgcagaaatgttggcaaaataactgttatttctagagtgacagaggagaagtataattttccttttctctgctacttcgattagagttcagagaaacggattttagaaattagtatattgatattaagtgctttcatttcttaatagtatcttttctattgagaaggagcggtttccccatcattttccaggaggtacatagtatagggtataagtgctatcagaaggaacttactgttcaaagtattagtggctatccaaacactggaaactatagacaccctgtactcgtttgtttgtttgtttgtttttttggcttttaaatagttgaagcaatagaaattgttttagaaacacatttccttggtctgcgataggattgggaaagattctgctcaatcttgcctacgtattctagtatttgtaacaatatttgtaatgtttggagactcagaagcatcaaacaaattacgaggattattttttattgaacataattttgttcagtctgggacatatagtaagtgctctgtaaatattttgagtaaatattgctcactctaaccacaatgttttaaaacactgggacttttatcatcaaaactaacctgtttttgtaaaaagttagagataatataaattaagtctttgatagtaagtgattcagaagtgtcttctagctgcacactagaaactttccacatacttttaaaagagagtctcagtgctttttaagcatgaggaagtaaaagaattagggatatagtgtgtcagcataaatagtttaaaatcaataagttgtttttttctttttacacaaaatagagtttattttggtcagtaaacctgttggcaaaatacagagtggcaggagagaaaagtaaagatcccatccttctgaaagccattaacatgtgcaaaaaccatcctagtactgacagttatatgctatatttgcatgttggtgtttgaaatttctcaagaggtcagtttttctacttgatttaatgagggttatttccatctaagttcttattagctgataatcagtcttttactcaagtacagaagaaatacagaatagaaattatccgaggtaggcagatcacttgattccaggagttcaagaccagcctgggcaacgtggggaaactccatctttacgaaaaatacgaaaattagctgggcatggtggtgcgaacctgtagtcccagctactctgcaggctgaggtgggaggatcacctgagcctgggaggttgaggctgtggtgcgtgcaggagtgcatgtcactgcaccccagcagaaagagagagaatagaaactattttctccccacaccgccccccccgcccctattttctccccacaccgcccccccgcccccgccttttttgtagtgtgttggggaaacaagaatctcttcttggtttgaatactagtataccattactttgtgatgtctgccatttttactctttggtgttgtgtaacatatatgtatacctcacatttatatttaatgaagtaattgtagtgagtgagttccagacatataagtgttctgtacttagttctgcctagtatacctatcggcagtaattgtgtcttcagaatacaggtataaattagccaggtgctatggtgtgtagtgtgtgccggtagtcccagctacttgggaagattgcctgagtccaggagtttgaggctgcagtgagctatgattctgcgatggcactccagcctgggcgacagagtgagaccctgattcttccaaaaaaaaattaaaaaacaacttcaagtgtagtctctatcctacatattatccataccttaaatggcttcagtttctatcttgttgaactttttggaacagtgattctcagacttgagtgtgtattaagaatcactttggttttttttttttgagaccgagtttcgctcttgttgcccaggctagagtgcagtgccatgatcttggttcactgcaacctctgcctcccggcttcaagtgattctcctgcctcagcctcccacatagctgggattacaggcatgcaccaccacgcccggctaattttgtatttttagtagagacagagtttctccatgttggtcaggctggtatccaactcccgacctcaggtgatccacccgtctcggcctcccaaagtgctgggattacaggtgtgaaccaccccgcctggcctaagaatcactttgaaactaagtttcctggatcctgtctccagagattttgattttataagcctgggttgggtgagggaccataggtgattctgatacagatggttcctagatcctaatttgaaaaacatattagtgaatcattggattttaaaatgcatgatactggaaaaagcaggaaaattaggggaggttgaatctatggcatactaccatccagtaccatgctgactttggtggcattcttgctttaatatatcacttcccaggcaaccattgctgacccctaaatgttttaaactttggttttatgaaatgcccaagtaacactcatttgggggctagggacttggaggagtggaggtgagggaatcctgtttacagctatcagtcattcacatgttttatgtgttagctaaataaattgcttttattttttctagtagagaccatctgtgtgaaatgaacagacacagtggggagagagagaaggctgatgatacttttagaccatggtgtaactttgcaagtagaggagataagacttaaaacaacttttgtgactcaacttgggaaatttaatcctatttcttaaattaagaattggaaaggggagccctccaggtatgtaatctaaactaccacccaatataggtatccgaatacagatgacattaacctgagactctggcttagtgttcctagtaatgtactttacacttttccttttatttcagtgatttcagcattctatcttcagtaattcagacaaatgtaaaaggaaaaacaatttggattttttatttttatttttttagggtctggctctttcacccaggctggagtgcagtggcataatccatagctcactgtaacctcaaattcctgggctcaagcagtcctcttgcctcagcctcctgagtagctgggactacaggcacgcatctggctaatttttttttttaaatttaaaatcgctgccttactatgttgccaaggctggtctcaaactcctgggctcaaatgatcctcttgccttggcctcccaaagtgctaggagtataggtgtgagccactgcacctagcctaaaaataatttggattttattttattttattatttatttttttagagatggagtcttgctctgttgtccaggctggagtgcagtggtgcgatctcaactcactgcaacctccgcttcccgagttcaagtgattctcctgcctcagcctcctgagtagctgggattacaggtgcatgccaccacgcccagctaatttttgtatttttagtagagatggggtttcactgtgttggtcaggctggtctcgaactcctgacctcatgatccacttgccttggcctcccaaagtgctggaattacagacatgagccactgtgctcggcctaatttttgtatttttagtagagacagcattttacaacgttggccagactggtctcaaactcctgacctcaaatgatctgcctgcctcagcctcctgctgggataacaggtatgagccaccatgcccggccagtaatttggattttaatttctaatttgcaaatcaacttttaaaaatttaacattaaaaatactgaaatattcatgtaacacaaaattcacccttataaagtatacacaactcagcagcgtttagtatgttcacaaagttgtaccaccatagtgtaattccaaaatattttcattacctgaaaaagaaaactcctgcccataagcagtcacccccgttttgtcctcccccagcttctgacaggttttgattttataagccccacgtgggtgagggtccatcggtgactctgatacagatggttcctagatcctaatttgaaaaatatattagtgaatcattggattttaaaatgcatgatactggaaaaagcaggtatcactggcaaccactaatctactttttgtctgtatggatttgcctatttgggatatttcacattagtggaatcctataatatgtgatttgatcttttgtgccaggcatctgttgctcaacataattctttttttttttcttttttgagacagagttttgctctgttgctcaggctggagtgcaatggcacaatctcagctcactgcaacccttcaccttccgggttcaggtgattcttctgcctcagcccggattacaggcgcgtgctaccgcacccagctaatttttttgtatttttagtagagacgaggttttgccatgttggccaggctggtctcgaactcctgacctcaagtgatctgcctgcctcagcttcccaaagtgctgggattataggcatgagccactcaacataatgttttttaggttcatccattatgtagcatggcagaataataaatattacattgtatagatacagcacagtttattcatcaattgatgaatttttgggttgtttctattttttggctattatgaataaataatgctctgcgaacattcgtttacaagtttttgtgtgaatgtgtattttttttttttttttgagatggagtctcgctctgtcacacaggctggaatgcagtggcgtgatcttggctcaccgcaagctccgcctcccgggtttacgccgttctcctgcctcagcctcccgagtagctgggactgcaggtgcccgctaccacgcccagctaattttttgtttttagtagagacagggtttcaccgtgttagccaggatggtctcgatctcctcacctcgtgatccacccgcctcggcctcccaaagtgctgggattacaggcgtgagccaccgcgcccggtcagtgaatgtgtatttttgattctcttgggtatatatctaagcgtagacttgctgattcatatgataattcttacgtttaactttctgaaaaactaccaaagtgttttccatagtggctgcacctttttttttttttttttttgagacagggtctcactttctcgcccagactggagtgctgtggcgctatcttggcttaccgcaacctctgcctcccaggctcaaggcgttctcctgcttcagcatcctgagtagctgggattacaggtgcccgccactactgcccggctactttttgtatttttagtagaggcgagggtttccttatattggtcaggctggtctcgaactcctgacctcaaatgatccacccacctcggcctcccaaagtgctgggattacaggcgtgagctgctgcgcccagccgtggctgcaccatttcacatcccctccagggttcaggtttctgcacatccttatcaacacttgttgttatcttttttttttaagcgctaaatcattctggaattctttatttgaaaaacagcactttttgacacctatgccatttccttctcttatggacaacttttttcatagtttgatgtccctctctcttttttttctccatgagcactgctgtctacattttagcatttattgactataatttaattcctgcttatgcattgttttcttgtgttcttagataaatttatgtttttctctttttttgtatagattatgagctgctgcttttttttaacttaacaaaattgaggtgaaatttgcagaacataaaattagccttttttttttttttttttttttgagatggagttttgctcttgttgcccaggctggagtgcaatggcgcgatctcggctcacagcaacctccacctcccgggttcaagtgattctcctgcctcagcctctcaagtagctgggattacaagcatgtgccatgcctggctaattttgtatttttagtagagacagggtttctccatgttggtcaggctagtctcaaactcatgacctcaggtgatccgtccacctcgacctcccaaagtgctgggattacaggtgtgagccactgtgcccagccaaaattagcccttttataaaatgtataattcagtgtcatttagtgcattcataatgacatctctgtctaggtccaaaacaatttcatcacgaaagaaaactactattgagctgtcactccctcttctttcttttccatttaatggctgagtaatattctgttatatgtataaaccacattggtttattcaatcacctattgatgagcaattgggttgtttctgccttttagctgttgtgaatagtgctgctgtgaatattggtgtacaagtatttgagtacctgttatcagttattttggtatatacctaggagtaaaattactgggttctatggtaattttgtttaactttttgagcaaccacttttccacagcagctacaccattttaaaattcccaccagcaatgtttgaagggtgcagtttttctgtatctttgtcaacatttgttattatctgtttttgattatagtcatcctaatgggtgtgaagttttgttttgcatttccctaatgactaatggtgttgaacatcttttcatgtgtttgttggggttgtcttattgttgaggttgtaagagttcttttttttctttttttttttttttttttgagatggagtctcgctctgttgcccaggtggccaggctggtcttgaactcctgacctcaggtgatccgcctgccttggcctcccaaagtgctggcattataggcatgagccaccacacccggccttgtctttttgcttccttgttagtgtccttcaatacacaaaaggttttacttttggttaaggctaatttatctttttttttccttttattgctttatggtgtcatatctaaggcattgacaaatccaaagccgtgaagatttttttttattttttaatgttttttcccctaattattttatagttttggcttgtatatttaggcttttgatccattttgagtacatcttggtatggtatgaggtaggggttcatttcattttttttgcacgtgcttctccagttgacctagtaccatttgttggagagactgttctttccccattgaatagtcttggcattgttgaaaatcagttgagcaaagattttgttgttgttgttgagacagggtctcactctgtcacccaggctggagtgcaatgatgcagtcttgggtcactacagcctccacctcctgagttcaagcgattcttctgcctcatcctcccaagtagctgagactacagtcacctgccatcacgccgggctattttttttggtatttttttttagtagatacggggttttgccatgttggccaggctggtcttgaactcctgacctcaggtgatccatccacctcggcctcccaaagtgctgggaatacaggcatgagccaccatgcctggccagccaaagatttattatatgggtttatttctggattctcagttctattctgctttgattactgtagctttggagtatatttaaaatttgagaagtgtaactttaccagcattgtttttctttttcaaaattgttttggttgtttggggtcccttgtcattcaatatgaattttattttatattattttattttgagaggtagtcttactctgtcgcccaggctggagtgcagtggcgtgatctcgtttcacttgcagcctctgcctcctgggttcaagcgatccaaccacctcaggctgcaagtagctgagattacaggtgcccaccaccatgcctggctaatatttgtttttttagtagagatggggtttcaccacgttggcaagattgatctcaaactcctaacctcaggtgatctgcccaccttggcctcccaaaatgctgggattacaggcgtgagccactgtgtgggccccgtatgaattttagatttggcttctccatttctgtaaacaagacagttgggattttgatggggattgtgttgcctctataggttgcttcaggttttattggcatcttaaccattttaagttagaatttttgatggggaggttttttcttttagcactttatcttactgcctctggctcctatggtttcttttctcttttctttctttgaaaacaagtttattaaagtaaaggaataaaagaatggctactccataggcagagctgctgtggcccctatggtttctgatgagaagtctgttgtatctgttgttagtcttactgaggatcccttgttcatgactcttagcttctctcttgctgcttttagcatttgtctttgtctttcaacagtttgattataatttatctcaatgtgtgtatttctttgtgtttatcctgctttgagttcatcgagcttcttggatgtgtagattcatatcactttttcatgcttttatggaagaagtggggattttcacagacgataattctgccttatcagatatctgaatctctctcttagtgatctagaaagcactggacctatagttttataaccaagaaaaaattccttcctaaggactgttaggtctgcagtattttagaaagtttggattttgggtattaagttcatataagaacactcttttaagccaagtgtggtggcctgtgcctgtagtcccttttacttgggagacctggtggcaaggctgcttgagcccaggaggttgagggctgtagttcactgtgattgtgctgtgaatagctgctgcactccagcctaagcaacatagtgagacctggtctcttaagaacaaaaaacaccccacatattaactacaaattatgaagtggtttaaacttcatatttatattttgtcattaggtagagggtttgagctatatggtagaaacattgtagtttagctattttattttattttatttttgaggcagagtttcgctctcgttgcccaggctggattgcaatggcgtgatcctggctgactgcaacttctgcctcctgagttcaagtgattctactgtctcagcttcccgagtagctgggattacaggcatgcgccaccacgcctggctaattttgtatttttagtagagacaaggtttctccatgttagtcagtctggtctcaacctcaggtgatctgcccgcctcaccctcccaaagtgctgggattacaggcatgagccactgggcccggcgtagtttagctgttttaaataccataagattaacatttctaaggacactcttagaaatattttatttaaataagtgaagcaaatatataaggaaaccttctgtaaatctaaaattatttcaaaataaaaagtaaaatattgagacatatatgtttactatattaatatcaaaataaagaattgagaggtctgccttacacaatgaaaaattaaaacttagaagttgaataagggatcagctttggttaatgtggtatgaatgaacattattaactcctcaaccccaactgatgctgattattagggaagagctgaaaatacaacaaaaccttttccatgaaaggccacatttcaaaatataaattcaaaacactaaaaatcccaatacagtgcagtttggaagaaactaaaactaaaagatgacactgagaccaggcacacaaatctttagctcgtaaatataatacaggttattgaatcagctttgggagtttgtggagaaaaaaatctgaaggccttgtagtgccagtggagcccgattttcagaacaagctagctgtgatttttgccactttagaactcttgtagctactcgactttctgggaagaacccagacatgggatgtttaaatcaccaggtgggggaaaaagcactgatagaaccaattgttgaagaagccagtaccatttatagtagtgaatctagatgagaggtaaaacattgggagcccacagatgtgtttcatttagtctgtgtgtgttgacacatacagtattaaaaataaatgaattagttgccaatgtttaaaaattggtagatttagttgaaaggcccagatttctggttttgccttaaaaaaatcagaaaatctgataacccttaacccatattcccagtggatttgaataatgcctgctttaggtgggtcagttaatatctagttagccacagctcctattgctcccagttgccttccctggttgccagttatcatcatatatgtgctgtctttctttatagtgtaaaataagcaatgaaatatttcctacttctacatctgcatcaaaagtgggaaagttgaagactactgggttataattcatccctgttacttgttacctaattatatctgggcaagttacataatttttctaaaactcagctaactcatatataaagtgagaattaaatagtaaccatctcatagagttgttagacttaaatgaggtaaatcacttggaatggtagtagcaatgtagtatgttcgattaatgttagccattactactgattaaaatggctgtacattttaagaaaaatgagcattttggggcagatgtatagaaatgttcttattttcatgtacaaaatgtcagaatacaatctgatggcattaaaaaaatcactttactgaagtatggttgacattctgatgtcattttgaccaaagtctggattgattttattcattgcatgtgtgcgcagttgagtttgtaacttctgtattagtttgctagggctgccataacaaaatgtcacagactgggtagcttaaaaagcagaagtttattttctcacagttctggaggctagaagtccaagatcaaagtgtcagcaggtttggtttcttttgaggcctttttccttggctcgtagatggctgccttcttgctgtgtccgtggtgtctctgtgtctaaatttcctcttcttgtaagaatgtcagtcagtttggattatgggcccagcaccccagtagccttgttttttttagatggagtctcgctctgtcgccaggctggagtgcagaggcgcgatctcggctcactgtaacctctgcctccctggttcaagcgattctcctgcctcagcctcccaagtagctgggactataggcacgtgccaccacacccagctaatttttgtatttttagtagagacggggttgggttttcaccatgttggccaggatggtctcaatctcttgacctcgtgatccacccgccttggcctcctgaagtgctgggattacaggtatgagccaccgtgcccggctggacttgttttaacttaatcgcctctttaaaggccctgtctgcaaatatagtcacattccgaggtactgggggttagggcttcaacatataaattttgggaagacacaattaagtctgttacaacctgtcctaaaaaggcagatcaaaaacatatgttacggaatttattagagataagagattgaaggtgagtgctaagagagccaaaagcctgatcatagatgattgattaagagcacttggagcagatgaggagagaaacgataatcctaacagataaaagacaaaagttccccagagctgaagtacgacatcttcaggtctcaattgctgcacataaatattgagagaagagacataccctggttaaatttctgaaattaaaagaatactacaagcttctaaattgaaataggagggaggaaaaaaaaaagctttcttaaacgggaaagagaatcagactggcattagattccaatctgtcacagtaaatgttactgcatggagaaatgtttaatagagttcttagggaaattgtgattataaaattctgtattcattcatactataaccattttctctttttttctttttgggtggtgatatatattttaattatttaaaattttgctcattccattctatagaataagatttacatttaagcaaaattaattaaaatctaagcagagagatcaagttaagcacaggctccaggaagtcctgctgggatctcaggaatagcgacaacatgttaaaagttttagtttgaatgtctggaatttgtttgtttgtttgtttgttttggtgcattctagagtctccaagagtcagtcaccatgagtacccgtgaggtagatgatacttattttaacagcacctaaactggggtttaggagctatattttccaagaagtgactcagtctaattctgaaatgacaaaagcagttcatatcattttattcacacttgaactccactggagtcagggatgaaatgtcatcttctattccaagaatgaagtcttcagataatgtccaggtgcttcagaactaactagtcatcataagaacacagagtccataatttctccaatgtatagttttttgtggtttctagaagcatcaaatgaatcacagtgctaccaaactccacacagaactagtcacagtgtccttcctatccatcttaacattaggctcatttttacatttcaggtatttgtacattttcatagtataatagggatatatcaggtggaagttccactcactatcagtcacaaagtagctgtaatctgtatatatgtttttacacagtcatgtgaaatttatttatatacacacatataatcccagtttgttcacttatactgctatataatggtccattataggaatatatcctgttgaaatttgtgtgttccccagtgtttgctatagctgtttttgtaaacagtggtactgcggatattcatataaatgtctcatgtttgagaatttctctaacgaatcaaggagtggaattgccagactgtagggtatatttattggatattgctattgcttctcaggatggctgtaatttacattcccatcaacagagtgaagtttatttatatctgtactttctatagtcacattttaaatttatggtacctcattgtggtttctattgcatcctcctgattactagtgagtgtgagcatcttatcatgtttcttggctctttgaggttttgttttgtgagtttttgttgatatctctgcacattattttgttaggtatttttaagaatttgatttgtgggagttatttatacattttggttaccagttacttatggatcacaaatgttttccctgaattttttctgtgaggaaaagaagttttaattttattgtggttgaattatcttttcttctgtggttttgtacattttgtatattgtttaagaagtcattctcctttattttgttttttaacagctttactgagatacactctataccataacatacccatttacaatgtgtaattcagtgttttttttagcatatttatagagtcgcacaaccatcaccttaaacttttcttttttcttttctttttaagacagggtctcactctcttgcccaggctggagtgcagtggcatgaccatggctcactgcagcctcaatcccctgggctcaagtgatccatctgtctaagcctcccgagcagctggtactacaggcatgtgcaaccttgcctggctaatttttttattttttgtaaagatgaggtttcaccatgttgcccaggatggtcttgaactccttggcctcaagtgatctgcctaccttggcctcccacattgctggggttacaggcatgtgccacctcgcctggcctttccatcacctttaaactaattttagaatataccatcattctagaaagaaacctggtatccattagtagtcactccccattcttcttcactctgtccctaaacagccacataatctactttctagctatagatttgcctattttggacatttctctttttttgagatggagtctcgccctgttgcccaggctggagtgcagtggcacagtcttggctcactacaacctccgcctcctgggttcaagcagttctgctgcctcagcctatcctgagtagctgggactacaggtgcgtgccaccttgcccgtgtaatttttgtatttttagttgagatggggtttcaccatgttggccaggttggtctcgaactcctgaccttgtgatccgcctgccttggcctcccaaagtgctgggattacaggcgtgagccaccgcgcccggccatattttggacatttcatataaacagggtcaaataatatgtggtcttttgtgactgactaactttaacttagcagaataatgtttttagattcatccatgttggagcgtgcatcggtaccttattcctttttatgactgaagtataaaataacttttataagactaaacattagtcttgatacctctagtggattaaatatccatattagggatcctgggaagatgacagcagtggtagaatagtttcctaaatatctatatgactttcccctaaaacagaacaaataggataggaaaaccaaaaacacatagaaaatgtgtacaagaaaattagttgactatgtttctctacaaacgctcaaataccagcagattgggaacaaaccattgttatccatactggaagaagcagaaggaagcagtggaacttctgatggagcggagaattgtaaataacccaaaggcaatcactggaaagctttttaaagggccgattttagaataccagctgaaatgggaatttgggaagggtattgcacacatcgataatgggtgagtgaaagggatcagttgtaaagtctgaagggactagcgctccttcatgaaactttaaaaactaaccaaagctcccttccaggcccactcctcacaagaagaaggaaccgaggatacaattgagtatcctctgaagaatacagaccaaggaaagagaaggtccagataaaagcaggggaggtaaacagggccaagatacctcagaaagcaagaaactatatttttgaatactatatgaaaacaacaagagggatttttagagtataaaggcagagtagctattcagagccaagcctctttcaaaagtcaacagtatgaaatgattgttgtcaaatgtcatgcaaatttttgaagaaaaacaagaccccttagacaaggaaatgaaagcacaccagaaagacatacttagaaaacaaacaaaaactgtgagatattaagacaaaaggcaagacagaagacactacaatgataagacatttcaaaaattaatttgcataagaaaaattaaaaaattaagtgatagtgaagtattataaataaaagaaaatggctggacatggtggctcacacctgtaatcccagcactttaggaggctgaggcaggaggattcgcttgagtccaggaatttgagaccagcctgggcaacatggggaaaccctgtctctacaaaaaatagaaaaattagctggatgtgatggtgtatgcgtgtagtcccagctactcgggagggtgaggtgggaggatcacctgagcctgggaaggttgaggctgcagtggactgtgctggtgccaccgcacaccagcctgggcaacagagtgagaccttgtcttggataaattaagtgaatgaatgaatgaaatgaaacaaaatttattttagaaatgaagacaaattagaaggaacacaagagcaagtaaacgtaacagataataccttatgagggaaagaagctgaaaaggagaaagacattaaaaataaagagatgtaaaaagaattttgtagaaattgacacgttggaaacaagtaaagaaaatccaacatatgtatattaggtgtccccaaagaagaaaactatagcaagggaacagaatgggtactaaaaattacaatacaagacaattttaatgaaataaaagtagatggggaactaaattttggaagagtacagcacatacctaagaaagtgacacggtagaccaatactgagacatagtctagaaaaattattggactttaaaggaaaaataaaaatcctcagacatacaggcagaagtcacaaagtctcttacctttataagtaaaggaaaatcagggccaggtgtggtagctcatacctgtagtcccaacacttttgggaggccaaggtgggggtatcgcttgagcccaggagtttgagaccagcctgggcaatatagtgagaccctgtctacacacacacacaaacacacacacacacacacacacacacacacacaatatagtgagaccctgtctacacacgcatgcatgcacacgctgggtgtggtggtgtgagcttgtagtccaagttacttggaaggctgagaggagaatctattgagcccaggaattggaggctgcagtgagctgtgattgcaccactgcactccagcctgggcaacagagctagacagtgtctctaaaaaaaaaaaagaaaaataatcagattactgtcttttttttttaaagacaggtttgttattgttgtccaatggcgtgcaatggcgtgatctcggctcactgcaacctccgcctcccgggttcaagtgattatcctacctcagcctcctgagtagctgggattgcaggcatctgccaccacgcccggctaatttttgtatttttagtagagatggggtttcaccatgttggccaggctggtctcaaactcccgacctcaagtgatctgcccacctcggcctcccaaagtgctgggattacaggcgtgagccaccacaaccgggctggtgtacactttcttatcttaaatatggaatttcattgtctcctttctcctatgacagtagggaggccaaggtgggcggatcactttgaggtcaggagtttgagaccagcctggccaacacggtgaaaccccgtctctactaaaaatacaaaaattagccaggtgtggtggcatgtacctgtaatcccagctacttgggaggctgaggcaagagagtcgcttgaaccagtgagatggaggctgcagtgagccacgattatgccattgcactccagcctaggtgatagagcgagactctctaaaaaaatataaaaaataaaagtcacaaacaatatgctagaatttgaagaatatttttcccattagcccttcctggggaatctactagagaatgggtgtcagaatcagaatgactagagacacattaaagactggtgatttgtattacacgtaactaagaccaaatgagggtttgaaagaagatatgatctgtaaaggggtgggaaggagaatggagggattatatgcaaaacatttaaaaaactactttcagtaataatgttcgtggtggtagtattggtgttattattttgagaatctgtgtgtaacatgaaataaaaagcaaacaagtaattgtgttattctaattctgtcacaaactgtcattgagaaccacagctcttggtgtggaagaaagaagatagagatgactgattagaggaatgtatgtttatgttaggggtgggtgagggttgcaagtgttggtagctgaaatagagaaaaaagctaatgtttcaactcaaggagcttttttaaagaacagataaaccctcctttcaccaggagaaaaaaaaatcccaggaagaagaaattagcaatattaaaaaaaatcaattacaaagcaaaatcagcaaaatatttggccaataaaatcaatttaatagtcatttggaaagtctcataaaaaaagaacgtaaaatattagaaataagaaaaatgaacattctaagaatattatgagtagttatgcctataaatttgaaaatcagagaatttgattttttttttttatggacacattttgtcagacatataaagaactggaaatgtctatatgttgttaaaattatttcagagtacagtatcagagtacaggaatgaaatgatggaaagcaccctgttttacttaatgagaggggctaccctggatatcacaactgcagtttcgcagacatgtcttatattcctcaatttaactctccagatccattcagcatttgtgttttccatcataggggacctttctggacaacatgaatgagcccctatgtcgtctgtcttctgatttggatgtggaaatgaggagccctggcagggaattggaggaaagaggagaaaaaaagtcccggtcttgattcccccatctcatacattctgtatgtaggagccttgggctggctggctgtgtcactcttagtcctcctggtccttccttttaggcttcggggtgatgagagctgttctcttgttactagcctgggttactgcattatcccttgtgatttcctataagcctcacccacagctttgtaaatagtccttatgtaaataaaccctctttaaattaatctaatttgagtgggccatctgcttcctgcagaccctgtctgacataactgatgaaattaggacttttgcatttgtagaaaataaatttttaaagtacaagttttgactaagaaaaaaatagagtacagaatatactgtatagaaaaataagtttattgcaaacttaagaaaaatggcaaatttagaaatttttaaaatgtataatagaggtttatatagtacttgattatttatcgcattagctgttagtattgatatttttgattatttagtaattggatattggtattgtatgtatgttaaatttcctgaatgtaagtggtgtggtggctggctcctggaatcctagctactcgggaggcagaggtggcctgagggtctcttgaggccagaagttagaggctgcagtgagctatgatcacgccattgcactccagcctgaatggtagaatgagaccccatctcttaaaaaaaaaaaaaatcctgaatgtgatcattgtattgtggttctatagaagaacggccttgttcttaggagatgcatgccacaatgtttagagtggagtatcatgatttctgtaactaactctcaaatgggacagcaaaaggaaaaaagtctttgtgtgtacatgtaaggagagagagacataaagtaaatgtgtcaaaatgttaataagtggtgaattatgttaagatatatgagtattcactgttaccgttcttgcaactttttttgtggcattgaaaatttcaaaataaaaagttggaaaatatttaaaacaacaaaaattgaaatacttattatggataaagaactttattataaactaataagaaatatataaaaggctagcatttgaataagcagatcactaaaggagaaatacagaaagccattaaagaaaaggatgcttgaccttaataataaaggaatgtaaatttaaatgagctgtcggtatccatctatcaaagtagcaaagattcaaaaaacaatgctttgggaggctgaggcgggcggatcacttgaggtcaggagtttgaaaccagcctggcgcacatggtgaaaccctgtctctactaaaaatacaaaaccgctgggcgtggtgtcacacgcctgtaatctcagctacttgggaggctgaggcaggagaactgcttgaacctgggaggtagaggttgcagagagccaagatggtgccactgcactccagcagcctgggcgacagagcaagactccatctcaaaaaaaaaaaaaaaaaaaaaaagcaatgatgtttaatactgatggagctgtagcaaattgaacaaactggtaactcttggaagtatagcttgattccctcttctttgcagtctggcagtatctatgaatgcttaaaatctgtatgctcattaataacggcaatttaacttaaatgaactaaatctagtgaggtaataagataagtgagtaaggttatatgtataagcacattcattgcagcattgttaaaaacagcaaaaaccaaaaaccatctaaatgcttatcagttcgggtttggttttatacatagtagaatactgttttagctatttcttttttttgagaaggagtcttgctctatgcccaggctggagtgtagtggtgtgacctcggcttactgcaacctccacctcccgggttcaagcaattctcctgcctcagcctcctgagtagctgggattacaggcgcgtgccaccacacccagctaatttttgtatttttagtagagacagggttttgccatgttggccaggctggtctcgaactcctgacctcagatgatctgcccgcctcagcctcccaaagtgctgggattaacacagaagtagttaatgtattgatatggaacaatatccctgattattacattaaaaataaaagcaggttaggccaggagcagtggttcatgcctgtaatcccagcacttgggagactgaggtgggaggattgcttgagcccaggagtttgagacaagcctaggcaacatggcaaagccccacctttacaaaatacaaaaattagccaggtatagtagcgcgtgcctgtagtctcagctactgggaaggctgatgtgggaggatcaccggatcctggggaggtcaaggctgcaataagctgtgatcacaccactgcactctagcctgggtaatagagtgacacactgtaataataataataaaaatagaaggttagagaaaaagatatgcattactgtcccatttacagtaaaacaactacatattataggcatgattttatatataccaatattgtgtaggttttgaaacctggttggtggagtatcaaaacaggtgggataattatgggaaaacagggctgttattttctggttttggcttaaaaacaaatagatcatgtaataggaaataaaattatctttcatttaaaaagtctgtggccgggcatggtggcttacacctgtaatcccagcactgggaggctgaggcaggtggatcacctgaggtcgggagttcgagaccagcctaatcaacatggagaaaccccgtctctactaaaaatacaaaaaattagccaggcgtggtggcacacgcctgtaatcccagctacttgggaggttgaggcaggagaatcgcttgaacccgggaggcggaggttgcagtgagccgagatcgtgccattgcactccagcctagccaacaagagcgaaactccgtctcaaaaaaaaaaaaaaatagtctctgcactaatttttcctttaaaataattctgtatgctggtttgttaatatagtttattgaattaacaaaaaatgtgttaagaaactcattttgctcttgtatatattctgttttcagagcagcggaaagagctcagtgctagaaagcctggtggggagggacctgcttcccagaggtactggaattgtcacccggagacctctcattctgcaactggtccatgtttcacaagaagataaacggaaaacaacaggagaagaaaatggtaaatttcagatttgagataattattttacagctcttcatttttgatctattcttaaaaagatatgaattgattagataattagaaattagtgactgtagcatagttagaagtcctgtgagaagtagtatgcatctttcttaatgtaaaaaaaagagtagtttttgttttgttttgtttttgagacggaggtcttactctgtcgcccaggctggagtgcagtggtatgatcttggctcactgcaacctccacctactgggttcaagcaattctcctgcctcagcctgccaagtagctgggattacaggcgccccccaccatgcccagctaatttttgtatttttagaagagacagggtttcactttgttggccaggctggtctcgaactcctgacctcaagccatccgcccgccttggcctcccaaagtgctgatcacaaggcgggtggatcacgaggtcagaagttcgagaccagcctggccaatatggtgaaaccccgtctctgctaaaaatacaaaaattagccagatttggtggcacttgcctgtagtcccagctactcaggaggctgaggcagaagaatcacttgaacccaggaggcagaggttgcagtgagctgagatcacgccactgcactccagcctaggcgacagagtgagactccgtctcaaaaaaaaaaaaaaaaaaaaagaagaaaataggcattgtcctttataaccgttcttttttgattaaattgaaaatatattagggaatgctgtgtctatcagcagattttaagttgcttaccaaatatgtatcctatgttaattatacttatattaatgaggtttgaaatgttgaatgagagtaacgtatttaatcttcctatttagttcagtatttggctcagactttcttatttatagaactctgtaacatagctctaattattaaattacttttgcagcagagtaccatatctgtttcttatctgcagagatctgttttcaatgcagttttattctacttcttattctgatttaagatgggatgatagttttgacaaaattgaacttattttaatttctgtgtctgattttttcatttactgtaggagctgttggtggtgatgacttgaattttttttttaatggggaaaaaaaacctcatgagcatctgctatgactctagaatgttagtcactgaagcaaattagtgtagttgtagatgttgcaagtaatatttttagatagactgccagtggctatgtgggagccttttaattacattaggtagcttctgggtatgttattcatcactttgcatttctctaatacttattgaagttctgaaccttgaatttaatcatgttggattaatctggggttcaccttcaaatatatagaataacacttataaaatttcatccccactgatttcatcaaatttaccaaacatctgaaactaagaccttaagacactatatgatattaggtctttctctctctctcttttttttttttttaactttccattttcttctgtcaccttgagagggcccatgatatcctgtctctcagaaactatttgaattgtgggcagtgtttccttagataaaattgtgcttgttagaaaagggtgtacatttcagctatcgtagtgtcagctctttggtatctctttgtttttatgtccactatgttttgttgatgtctcctcttagtggttggtcagtaaatctgcctacctactgtttttttccaagcttagtgctgattttgtatatatatttgcttaaaatgacaactcaactaccccaaacacaatatagattatataaatttgagtactagatttcacgtgttttattctagcatagacagttcgttagtttttcatcaaagcttctttatccttagaataaacaattctagcatatcataaatcattctaacccagagaaaattagaaaccatgaagcagataaacaatatagttagctagaagagtgtgaactacctgacagcctgataataagagaggagaaagggaagaaacataaactttcaaaaaaaaaaaaaaaaaagaaatcagttactaacattttgtgtagggattttatttagccagtgaaggcttagttacatgacaaagacctaggttaccaatagtagattcagagtagtacattctaagatgacatggagaagtataatccatcttagatgtagcttcatcaaaactggctaaagtaaaatattttagtgtttaatatgtataattcaatcatcaggacatttatttagcataggattcttcattctgtcaactgtgggataactgaggtgtcagtatgtagatttatggtcatctcagcttgccccctacttctgcccatgtaaaagaattttctgttaaatttttattaaaaacaatactaaactatgttttagagtagagtggtggttcagtttgaacagaactccacggttatctttcatatatttgtaagaaataaatcaagctttcctcagctttcctttgagacaaaatccaaaagtagcatgctgattaaaggccaaaattgtgctatatatgatacttctgaacagtgtcagtagaaatttgaaaaaaaatgtgaaaaaaaaatttattttggggagaaaagttgttgaactaaagcaaaagttttttgttttctttttaaaaaatgcaaacataggccgggcgcggtggctcacgcctgtaatcctagcactttgggaggccgaggcgggtggatcacctgaggtcaggagttcgagaccagcctggccaacgtggtgaaaccccatctctactaaaaatacaaaaataagctaggtgtggtggcgggtgcctgtaatcccagctaatcgggaggctgaggcaggagaatcgcttgaacccgggaggcggaggttgtagtgagccgagatcgagccattgcactccagcctgggcaacagagcaagactccgtcttaaaaaaaaaaaaaaaatgcaaacatacatgtttcgtagaataatgcttaaaatcttggtataatttgaaattttacccccatttcattaagtaacctatttgtaaaagcaatcagttgccccccaaaaagcagtaaaattacacattagaattaaaggaaaaagataggattaatttttctgcatagggtgctgtgatacacgtagtagtctccctttggactgagtccacgaaggtcaagagttaactttctgcagtgttctattaaatccaatgtatgtttcaaataaaatacccttatatagtccagtcttagctaatggggcaaatacttgcatatacttaccaacttttaaggttttgaaagatgtatttagtatattttgtagatttttaaaaatcaggcaatttatcttttcctgtagtaggttatcagatatctcaggcaaagtttttttttttttttttttttttaaggcagagtcttgctctgttgcccaggctggtgtgcagtggcacaatgatctcagctcactgaaacctcctgggttcaagcaattctcctgcctcagcctcctgagtagctgggattacaggcgtgtgccactacgcccagctaatttttgtatttttagtagagacggggttttgccatgttggccaggctggtcttgaactcctgacctcaggtgatccgtctgcctcggcttctcaaagtgctgagattagaagtgtgagccccacacttggcccaaatttttgaatagtgaattaattgtgcttcatttgtgtcagaattagaaataatggtcacataacttttttattaattttaaaaatttaatttttattttttagactagtcaagtgcagtagtaaggcgggaaagagtagaacaaggagttccatctgtaactgactgaacagtcaattgagataactaccttcagacaagccagatataactaattatattggaaaggttgtttcctaaaaatgttaaaaataagttatggcaagcaatatgctttgtttctatgacttaaaaatattatatacatccctctaattctagttgtattttgcactgcgcagtgggattcttaatttttcttcttagccactaactttactttcgtcagtaaattttgaataattgaatgctatgtgcatttgaaatgtgatcaggtttctgcacatttgaatttttaataaggtttaaaattttagggataagcactaaacttattctgtgctgtttctctttaactacagaccctgctacatggaaaaactcaagacacctttctaaaggtttcctttatccatttgcttttgaccctttttttctcttatgcctgcatgtgtgcttatgtactattacaggctgtgtgtatttttttttcttccatttttatttgcccatccacattgattgcaggttttagtggttcttgttattttttttggcattgcatcaaaatgcaagcttttttggtggtgaatgtaatttattttatttttatttttgaagacatgcttgtgaagccaagcctttttaaatataataagataaattagaaacagctctttggtatgtagtacttgcattttgtgagttctgttcacctagattactccagtcctccaatgagacttcttggaagaaggtactaagctacaagtaggtgagcattttatctgcaaaaaggatccggttttatttacctttattccaccaaaggaccgactcactcttctgtttgtctgaatatcttatgatcatttttatttagacctcaggaggctgatatgcattattcaatacacttattaagatattttaaccttctctaaatttgacaaaagcaaaacagctgtgtttggaggagataaagttagattatctttccacaattaaacagttctagtttttctgggaaaaacagactatatcttgctctccaagttttagactacttcacacagtgcaacagtgaatctattttccttctttcagcaagtacaagaggaacagacctatgactggaaactaatggagagtggcaactccttacgctgcatataccagggttcttgtttttccttttcttccattttatttctttcctgcctccagttccaagggaaaacagtcttgaccctgggggaaaatcaccttgaaagtgtgtgtaaattacaaagcagctagctctataataatgagagagctctttaaaggaacagcaagttgtggctctacaggtaaccaacaggaaaccaaatttttaaaaagaactgaagaattagctgtttcattgacacattgtaaaatttttccttgagtcatatgtgtacatctgttacatatgttttttgcactactcagtgggattcttaatttttcttcttagctactaactttattttcgtcagaaaactgcttttatatgtaagattttcaaaactaaagaatattccttttactgtaatataactacacaaaaaaatatgaagagaaataaacaattttatttgcaaaatctagatttcaactagtgggaagacctgtgagcagctctgcctgaagttggtcatgtttttgaaatacaccatacaatttttaaaatataatttagcagaaaatacaattttagaaaaatataatttagcagaccttaaaatacttgttaacttgtacttaatggcaaaattaaatacaagttaagaagtgttttattatgttgcctttttgaattcctaaagataaaaagtagtttccatagtttccaataaatgagtttttcttttttccaggggtggaagcagaagaatggggtaaatttcttcacaccaaaaataaggtaatcacacatgcatataatgaagaaataatgttgaaaaaaatatattgtatgaatacttgataatttagtttctaatcattggcaattacgttattttaaagtaactataactattccttataaaataaatcttagtaacatttctaaccacaattgtttattggaaaacacttgaaattgaggccgattttctctgtgatttggtgattcttaattgttgtgggatcaggaagctttgaaaagttcgtaatggccaggcatagtggctaatgcaagtaatcccagtacttagggaggctaaagtgggtgggtcacttgagcccaggagttcgagtccagcctaggcaatatagggggaccctgtctctataaaaactaaaaaaaattagccccgcgtggtggcatgcacctgtagtcctagctacttggaaggctgagtcgggaggatggcttgaggatgtgaggttgaggctgcagtgagccgtgattgtgccactgtactccagtctgggtgacagagtcagaccctctctcaaagaaaaaaaaaaagccaaacagaaaaaaactcataaaaaaactataaatccttagctcagaaaatatgtatacattagaattttatttattttctgaagcaaatacatagacatccttgaagtatatggactccccctccagcttaagaacttttgatcttattttgaatattatgcttttttatttcaaaaatttttagctttacacggattttgatgaaattcgacaagaaattgaaaatgaaacagaaagaatttcaggaaataataaggtaggcatctttttagagctagaaggcataagcatcagtaaatatataattgaggtattctgtacataatatgtgaagggcattgtaaattcctactcttgatcttagccaaaaggccgagaagcgatggacattgtaaattcataatggactttgaaacaaatggagtattttcacagatatatagaactttgcttaaaatcccttttctttcttaaagctttcatataaatcaaatattttatttagatgtttattgttgttcctgtcatgtacatgccacattattatataattctacttagtattgctacaataagttatctttttctgatggattgattgtactctaactcaggaagcattgtttcacttatatatatatcttttgaggagttcttttcttacctgtgtatggctagatttgcttatgaaagcaaaaagagacaaattgggaatttttttttcttttttttagtgaaaatgaaaataatacattagcaactggttttcttattttctgagattgtgagaatgtgaagtaagttatgtatctaagatactgttaatcttgacactaggtactatcactgccttgcctgaatcctgctgtcttctgtcttctttattcctattatttttctctttatatttcaagagatatatattatctcttgagatttttatttcccttcctttttgttcttagctccattcttatattatccagaggcacatttaatcccacaagtgggccctagcctagtactaatattcaacaaatattgaatccttgtatctgccagttactatgctaaaagattatttcctgacagaaaggcatttttagagtcatgttaacctttatgactgttcaggatatttgttgctgttacagtgactgactgagctttgttcattgttgaactctaggctggttacctttgagctactgctactgttgccatactttcctgaatttctagtaaccatgttgtatagaacgggttgaaaaagtggccagaaactagattagcttatcgtcattcctctaattatatcagggatatttttggcttttggaatgttattgatcataacatcagtctgaattctctctcctacagtccccatttacttactgaactcagcaattggtggtaattttacacagtaccagaatttagagtgttgtgatgattcagaaatgtttttagttacactaaactgaatgtcattgaagattgagtctatacctacaagatgtttaatttatgttgaggatataatttacttacctagcagcttttcatccacagtgtctaaaagatgaaaagtcccccaaccccaaatctatgaaacatctcttctttcccaaatcacgtatgtaatgaagtaaatgatattttgatcttatataatttttatgtcaaaatatgtaaatgactgcatatgcctaacatatagccctgaaggatttaaaatgtctgtgagtttggagttgcaaaggtactgggcagagctttgtattggactgataggggaatgccatggcaataaagatcctgagaaatatacaacctaagtaggtatgccagatagtgacatttgttggctttggaacactggagtatttataatggaaaaatagcacagagtaatctaaaatagcaaatataattgtatagggaatgtggagtaaaggatattaaaaacttgctgggaaattagaattttcagtgggctaatgagggaaaacataaggtagttaaacaggtgatgagaggatatattaaaggctaaagaagggcatgtacaaagacagggtataaacatctcataagtgtctttttacatgtagttgattcaatcctaatacttgtagagggccagtggtgaagaggagggagcctacgcagtattcttagtctgcaggagagaaaatacacgttacctctcactatccaaattcttactagagattaaagagttagataaacttcttgagaaatctcttactgtacacattcttgccacttgatattcaaagatcaggaaccaggctgatttggacaacttgttatctacgccttactctctgaactcggaacctcataaatttggatagtgaggaatacattattcttttattcagcactaaatctattaaacatatttaaggaatggcatatgccagcctgggcaacattgtaatacccggtctctacaaaatataaacaagaaattatctggacatggtggtgcacaccttgtagtcccagctactcaggaggctaaggcaagagattgcttgagcccaggattttgaggctgcagtgagccatgattgcaccactgcactccagcctgtgtgacagagtgagaccttgtctcaaaaaaaaaaaaaaaagaaagcaaaggaaaaatttatgtttataatcaagagaaaagaatgtaaaataatacatggtatataatacatgtacatataacatgatacagggatagaagtaggattataacctgttaatatggctggctacctgacttcccatgtgtttcatcaggttttgattgttaaaaaaaagttttaggaatcatgatttaattcatttttaaaagcattaatgtctatgtacttgaaatgaagtttattacttcatagttcattgaaattttaatatattttaaaatttatttttagggagtaagccctgaaccaattcatcttaagattttttcacccaacgttgtcaatttgacacttgtggatttgccaggaatgaccaaggtaaggaaggaatagttgtagatttggtcaggttgttttcacttcgttgacatcccatatgagaataatcagcttctttttgcaatcactttgatctgttagcagcatttgataacgttgagccctcctttctccttgaaacactttctttacttggcttccaggataccacactctacaggtttatctccagtctcactggccactccttttcagtctcttttgctgtttcttctcatctccccaatgtctaaacagtaagtgccccagagctcagtttatggaactctcgttttctctaggtacactttccctttgatgatttcatcagattttatggctttaactacgtaaggctctgtatattgacggcattcaaatatctccagacttgtatatctagttgctattcgacatatacacttaaatgtctaatagacatttcaaactctaataccgaattcctgacctgttcctcaactagatttggtatttctatagtcttcccccatcgcaataaatggcaactcatgccatttattggcaactcataaaaaagctgagttgatttttaattgttagttccttggccatctctgtttggtgcagtggcttatcctgtaatcccagcactttgggagatcaaggtgggaggaattctttgagaccaggagtttgagaccagcctgggcaacatagggagaccacgtctctacaaaaaatacaaaaattagtcgggcatggtggtgcacacatgtagtcccagctgaggcaagaggattgcttgagcctaggaatttgaggctacggtgagctatgattgcatcactgcactccaacctggccaacagagtgagaccctgtctctaaataaataaataaatggcaactccattctaccaattgcttagccagagtttgtagtcatccttgacactaatttatcccacattccacttcctgccagcaaatcctcttggctcttcctacctttacagtatatccagaactcaatcgtgttttataaattcatatttactgtcctgatctagccactatcatgctacctggattactgcacaataatcaataataggtcgtccttgtgatctcatcttagtagacagtgatacgattaaagtgaaaattcgattgtgtcatttcttggctcaaaacttctccagttccttgtcattccttgacttaaaacctctcccatttcactaaaagcccaagttattacagaggtctaaaatatctacttgttacgtccctattcttctcctaactcctgttgcttcagcctcctgcccttattgttcactctctttggaatttcttcccccagatgtctgtatgttattgctcccttattggcttaatttctgctcattctcttaagtgtcagttgtctcagtgaagtttccctgattactctatttaaaaacataatccaatttaaaacattaaaatcataatcctaatggccaggtgcagagtggcttatgcttgtagttctagcactttgggaggctgaggcaggaggatcatttgagcccaggagtttgaagatacagtgagctatgatcgcaccactgcactccagcctatgtgatagagtgagaccctgtctcaaaaaaaaaaaaaaaaaaaaaaaaaaaaagaaaaaaatcatctctaatcattccctagcctgctgttctgccttattttcccacagcccttaccaccatctgtatactatatatatgtttttgtttattatatgcgtgttattactaaaacataagttctacgaaggcagaaagtttggtctttttaaaattcactactgtaacataatctgacatgacctgaaatcacgttcagaaaagtgcctaaaatagagtaggctgccagtaaacacttggtaattgaatgaatgagtgaatgaatttgtatctagccaatcaacattgaccagttcttaacatgggactgtattaaatcaacttttgatatttgcaagagttacactttgagacttgacacattaccagattcataaataccattgtagtatattagtaatgtctttatttttattttaactatttttaaatggatatacctatattctatcgattaaatgtgggtaaaaaagctgagttgatttttaattattagttccttgctcatctctgtttggtttaggtgcctgtaggtgatcaacctaaggatattgagcttcaaatcagagagctcattcttcggttcatcagtaatcctaattccattatcctcgctgtcactgctgctaatacagatatggcaacatcagaggcacttaaaatttcaagagaggtagatccagatggtaaggacagatgttaatttaatgagatgcttattttacaatggtaaatctacccttgagaaaggaatttttctctttaaaaacagtatctctggttttgaatacaaatttaaaagataatgctttcctatttttgtttataaaaatagaaattctgatggaaaataaggttattaagttgctatacagactaggcgaaaatattttacaactttatttgtaatggttacctaataatttaaaaataatacggtggctttgcaaaaaggatttcttgttttgtgacctaggtatttgaatagttgacttttaagaataaataacatagccaggtgtggtcacatgtgcctgccgtcccagctactcagaaggctgagatgggagcattgcgtgaggccaggagttcaaagtcagcccgggcaacatagactctgtctgttaaaaaaaaccaaaacacagtaggtaatcattgtagattattatggtacagtagagaattatggtatctacattctgcagaggtagataatatttagacatgctcaaggcacaggggatttttagaaatgaaggtaaaatcctttcatgaagcattttagccccaaggattagttcatactgtgggtcactgatgcttgactaatgatgtagtgcacatctcatagtatatataaaatgctagcttgtaagagagtggttactattgttgctaacaaatgtatgcatggcctcatatagaaaccatttttttcaccttactattcagagggtctgaaggttgtgtcatgtttttctttccctgctttgaagaataatttcaaataaaaatttgataggaaatagtgctaagactgccaatctgccaataaaaattcccataagcagggtcactttaacaattttttttttttttttttttgagatggagtcttgctctatctcccaggctggagtgcagtggcgcgatctcggttcactgcaagctctgcctcccgggttcacgccattctcctgcctcagcctcctgagtagctgggactacaggcgcctgccaccacgcctggctaattttttgtatttttagtagagacggggtttcaccgtgttagccaggatggtctcgatctcctgacctcgtgatccgcccgcctcggcctcccagagtgctgggattacaggtgtgagccaccgtgcttggccccaatattttatatttcaagtttttaagaaactcttttttaccacttgagtaaataatgttcatttcagttaaattaaaagataaactatatcaaagagtttatttacattttatttttattatttaaagtagactgggctcagtggctcatgcccgtaataccaagcactttgggaggccaaggtgggtggatcacttgagctcaggagttcgagaccagcctgggcagcaaagtgagagccccatctctattaaaaaaaaaaaaccacaaaaaacaattagctgggtatggtggcactgggctgtggtcctagctacttgggatgctgaggtgggaggatggcttgagcccgggaggcagaggttgcagtgagccgagatcatgccattgcactcttgcctgggctcagagccagaccttcgtaaaaaacaaacaaaaacctgttaagcattttatatgtataaactctattttaaactgacccttgagccatagatattgtcatatttttaatctaatcttttttttttttttttggatgtagggtctcactctgttgcccaggcctggagtgcagtggcacaatcatgcctcactgcaaacttgcagtcctgggctcaagtgatcttcccacctcagtctcccaaagtgttgggattgcaagagtgagccactgcacctggtttgattactaatcataatctagtaatacatcataaggaaataatccagcccagtattatttatagtataaaaaattagaaacaacttaatatggccagcagttggaaagattaagtaaattataataataaaatatgaaataattaaaaaggatgattttgtagatttgtagcagtacagaaaaatgcttgtaggctgggcatggtggctcacacttgtaatcccagcactttgggaggctgaggtgagcggatcgcttgagaccagaagttccagagcagcctgaccaacatggtgaaaccccatctctctaaaaatacaaaaattagccaggcatggtggtgcatgcctgtagtcccagctactggggaggctgagacatgagaatcacttgaactgtggaggcgaaggttacaatgagccgagattgtgccactgcatttcagcctggacaacagagtaggacagtctcaaaaaaaaagaaaaatgcttgtaactgaaaaataccataggtaaaattgtacactatgcagagcagttggaactctcacacgttgctggtgggagtggtgtagtcattttgggaaacagtctggcagtttcttataaagttaaattagcagtcccgttcctaggtgtttaaccatgttaagtgagaaccagtgttcatataaaaaactatatgcaaatgtctacagcagctttattcataattttcaaaaactagaaacaactcacatattcctcagatggggagtgaaactaaagtatggtacattccatacaatgggacactactctgcaataaaaaggaatggactattaatatacaagaacacggatgaatctcaaatgcattatgctaaatgaaagaagccagactcaaaaggttatgtactatctgatttcgtttatataacactctagaaaaggcaaaactaggaatggaaaactggtttgattggttagcataagaaaatttggtgggggggggtggcaatgtcttgagttggttgtgacatatctcttggcatttgtcaaaactcttagaactgtacaccaaaaaagagtaaatatttttattttttgtttattgagacagggtctcattctgttgcccagggtggagtgcagtggtgcaatcacggctcactgcagccttgacctgggctcaggtgattctcccacctcagcctcacctgtagctaggactaccacaccctgctacgttttctattttttgtagagacagagtttcaccactttgcccagactggtctcgaactcctgggctcaagcaatctgtctgccttggccttccaaagtgttaggattacaggcatgggccatatcacctggatgtaaattttatacagatttttgaaatgcttacaaaatagccctaagagtcaacaaaaaattacatgtgaaaaaaatctattttatatatatactatatatagagtatatatacactatatatagtatatatatatatatatatatagtaactgaaaataccataggtatttcactacccatctgagaaatatgtgagttgtttctagtttttgaaaattatgaataaagctgctgtagatatttgcatatagttttttatatgaacactggttctcacttaacatggttaaacacctaggaatgggactgctaatttaactttataagaaactgccagactgtttcccaaaatgactacaccactcccaccagcaacgtgtgagagttccaactgctctgcatagtgtacaattttacctatggtatttttcagttacaaatatatatacataggtatatatatatattttatatatatattttatatatttatatatattttatatatatacctatgtatatatatttgtaactgaaatatatatactataaaatatatatagtatatactatatatatttatatatactataaaatatatagtatatattatatatattttatatatagtatatatagtatatatatactatatattatatatacactatatattttatatatactatatattatatatacactatatattttatatatactatatattatatatagtatatataatatatatactatatataatatatagtatatataatatataatatatattttaaatatatactatatatattttaaatatatactatatatattttaaatatatagtatatatattatatatatatagtatatatatatattttagacggagtcctgctctgcatagtgtacaattttacctatggcatttttcagttacaaatatatatacctaggtagatatatatataaaaaatacatatacctaggtagatatatatataaaaaatacatatacctaggtagatatatatataaaaaatacatatacctaggtagatatatatataaaaaatacatatacctaggtagatatatatataaaaaatacatatacctaggtagatatatatataaaaaatatatatacctaggtagatatatatatttgtaactgaaatatatatactataaaatatatatagtatatactatatatattttataaatatactatatatagtatatactatatatatttatatatactatatatagtatatatataaaatatagtatatattttatatatatataaaatatagtatatatagtatatatattatatatagtatatatagtatgtatagtatatataatatatatagtatatatattataaatatatactatacatactatatatactatacatattttatatatatactatacatattttatatatatactatatatattttatatataatatagtatatatattttatatgtatagtatatatatatattttagatggagtcctgctctgtcacccaggccgaagtgcaatggcacgatctcagctcactgcaacctctgcctctcgggttcaagcaattctcctgcttcagcctcccgagcagctgggattacaggcgtctgccactgtgcctggctaatttttgtatttttagtagagatggggttttaccatgttagtcaggctggtctcaaactcctgatctcaggtgatccacccgccttggccttccaaactgctagaattacaggtgtgagccaccgtgcccggcaaaaatgttttaaaaaattatacacaatgtttaacattatttttaaaaaagcactggtaagtaaggcattaccaaaatgatgacagaggtaatactaagtgggattgtagatgagggttttcctttattaacactaaatagttgtatttaatggatcattttctttcttttctttgcccttttttctttttgcatttaccaggtcgcagaaccctagctgtaatcactaaacttgatctcatggatgcgggtactgatgccatggatgtattgatgggaagggttattccagtcaaacttggaataattggagtagttaacaggttagcagttagaatgggataagaattgggataagcattcttagaatgggataagcattctcacttcagagcaagtctgaatttctaaaatctgtttgaaatgtgatgctgtactatattttttctcccttttattatgatcttggtattgctaaagaatccgttgccctaaagggagaaaagagagagaatttttttttttttttgaaatagggtctctctctgttgcctaggctggaatgcagtggcgtgattgtggctcattgtagcatcaacctctgggctcaagtgatcctttcacttcagcctttcaagtagctgagactataggtgtgtatcaccacacctggctaattttaaatttttttgtagtgacaaggtcttgccatgttgcccaggcttgtctcgacttcctgggctcaagcaatcctccaaccttggtttcccaggtgctgggattacaggcatgagccactgtgcctgccccatagacatttttactggaaaatgtttctaaagtaagcaataccacaaaatggaagaaatgttgtaatagccaggctttaagaattcttgcctatcatgttaagctatgtatgaggaggtactgggtaagggaaaaattatctaatgtgcacccaatcgagaaagagtttaaggtggcaggattttaatagattggttttaatccctggcattagtgatgcttctgtgtaattgccaggatgtgacttggagaaattgtattaaaggtatcctaatttataaatagttggtattaaaaactgggaaaaggaaactagtattgagtgtctaattaaaggtgacaagattttaatagattggtttaatccctagcattagtgattctgtgtaattgccaggatgtgacttggagaaattttattaaaggtatcctaattataaatagttggtattaaaaatcgggaaaaggaaattattattgagtgtctaattacgttttagacactctactgtgagcaatttgcaaatggtatctcttggaatcctcacagcatcccctgaggtaggtgttgatgtctattttataatcagaaacctcaggttatacatttaaccaaaagtcacgtgggtagtgaaagagctggattcggatgaatatctcttttagtccaaagccttcatatggtaggaaacactgaaattatcatgaaatctgagttatagtcctagttcttacataaactagatacaacgtaggtttaaatgacacctaatgtctttgggtctcaagcctttagaaaatgaaaatgtttttactgcctgatacataagatccattccagttgtctgcttctattttaatgtccttccattccaaccctactgtcattctcccatccccactgtcattctcccatccccactcccaattccagctgtctcctttttcaggtaaggaggtggcctaacactgttcgttgtttgtagatgattgttcttcaagttaacttaattatttttgggagaaattagttccctgtccatggataaaatatacagttgactaagatactcttatatttttatacctgtctatacctgttacttattgtttttgtctatagttaatggtaataatgaggcctactctatttaggcactagttacttacaattcacttagttcaagtcttggctatgccagttagtgtgtgacctggggtaagttagtttttgtgagcctcagttccttgctatacaatggggtaataatacctgccacataaaattattgtgagaattaaataaaacagtccctgtcaggtattagagaacaatgcctggtgctgtcatcatctaaggtaggaagaggacaacagttaagctgaatagtttcgttattttttcaacctcaggagccagctagatattaacaacaagaagagtgtaactgattcaatccgtgatgagtatgcttttcttcaaaagaaatatccatctctggccaatagaaatggaacaaagtatcttgctaggactctaaacaggtaatttttttaccttttggaaatgagatgtgtttgtttttaccaattggtgtctgagagggttcattttcagttccttacattttcatactgttcctaacagcttcacttatggtttcttatatagtaggttcctgaagagtagatgtctctgtttttattggggtggttgacattacatcatcacgtagtctagaatgaatgtacaagtgattttaaaatgttttaattacgaaaattttgacagttaatttagttttgtggctagaactagagatgacttcatttccactttgcatttcaggaactgattaaaatttgtaattttcacattatctattcttaccttagaatgtgttttatttaccaggaaagggagatggaaaaacaaagaaatagaatgtcttttatttctattcactgtagaaataactatacgttggattctgaatacccactgatgtgtggggactagaagccctttctagatgatttataaatgactgaagtggaagccattttctcttacttttatcttattccctaaagactgatagacttggatcttaataaggttgattttcactttgctgggtaccaattgtaaatgacaagtcaatgaaaccaaaattatataggaagaattgattgggtggcttattttctctgtggtaattgcagtaatatgaaaataatttgcattttttccttgcttttattatttaggaaaaaccaatcaaaattgtttttttccttttcacacacagttaatcagtatagcacagaatgcttttgagagcagatatatggggagttttccccatacatcaagcaaggaattctccaggggattctagctgaatgtcctttaattcaatgctaacactgtttacctggagatagtgtcagcgcccacaggttgagggttcagtcccacaagactgcccccaagtcagatgccagttgtaagcacaggttgtagcctgtgtttctgactgacaggctataagtcagggtacccatgatccccttttcatgtttgatgaatttgttagagtggctcacagaggtcagggaaacactacttagcatatacccacttactgtaaagcatattacaaaggatatagataaatagccagatgaagagatgcacagggctgggcatgtgggaaggaatgtggagcttccgtgccctctctgggcacaccacactccaggaaccttcatgtgttcaactctctgaagactccatgaactgtgtccttttgagtttttatggaagcttcattggccattggtgatcagctcaatgtttggcctctctcctctcttctgaggctgttctggtgaccagctcccatcctgaagctatctagggacccccagccaccagtcatctcattagcatgcagagacactctaaacacccttaatgctcttggagagtccaaggattttaggagctgactgccaggaaatgaagacaaagaccaaatatatatttcacagtatcacatttgccaggacaaattatttgataggttttccccattgtaaaaatttgacttgtttagggctttagaatacacaattttacttttaaatccttcctttctaaccttttttaggttactgatgcatcacatcagagattgtttaccagagttgaaaacaagaataaatgttctagctgctcagtatcagtctcttctaaatagctacggtgaacccgtggatgataaaagtgctactttactccaacttattaccaaatttgccacagaatattgtaacactattgaaggaactgcaaaatatattgaaacttcggagctgtaagtaagaaatttttctgtagatttggttacctagattgctaggtcacttttccttttgtgaagatgacttcagctcagattatctgattaagatttattttctataaaacaaaaatataactttgtagagataataggatgatgtctggttgtgtgaaaatatgctttgtaaatgatataaagcaaagtaaaattgtcacatatttttaaatattttaatattttataagtatttacttatttttataagtatttaataagtattaaatattttaataagtatttaaaaataatttagcttttaaagtgtttgtttctttagtacacacagtataattgctcacaaaaattagaaaatgcagataagtaaaaataaaacataaaaacaaaattacatgttggtgtgcacctgtagtcccagctactcagaaggctgaggtaggagaattccttgagctcaggagttcaagtccagcctgggcaacatattgaaattccatccttttttttttttaattgaatccaaattttattaaggatttcaagttacatacttcagatttctagaatggaatggaataattttggaactggaaaaatggcataaacactgatatcccttgaaacttcaattttataaagaaaattcttctgcaaaccacatccccattatataacaagaccaggtattatcgacaccttcactttggcaataactatttcctaaaagaatgaaaaagattattttgctacctcagttcgttaaaaatgggattctggccaggcacagtggctcatgcctgtaatcccagcactttgggaggctgaggcgggtgaatcacctgacatcagttcaagaccagcctggctaacatggtgaaaccccatctctactaaaaatacaaaaactagccgggcgtggtggtgggcagctgtaatcccagctacttgggaggctgaggcaggagaattgcttgaacccgtgaggcggaggttgtggtgagccgagatggtgccactgcactccagcctgggcaacagagcaagactctgtctcaaaaaaaaaaaaaaaaaaaaacagggattctatctttaaagttcagaaaaagctgcatttagatgaactacggctaccaaaacaaacaaaaaaacagagtgtctaatcaaagcaaaggaaatgattttgaaaatagaacaaagctattataattggttaaggatttccagtagtaagttaaaatctcaggagaggaatggatagcattacaaacaatgtgttcacattccaagacctgaacactaacttctcaaaaaggaagttttcatcacctctaaaaatgaattcaatgtaattttgttaagagcaggaaatctagaccttcctctaatgacaatccaatagtccaccctcgccatcgtcaaaagaaagttgcctcaaaattaacagtaattagcctgaggtattgtaaatgtggcactacagtctgaaatttaatggcatcttttgtcaaaaatagtcttatctctactttaatctcatgactacaatactatgtgctatccctgtagtatttactactatgcagtcatacagaaaaaaattgttggaccttgtgaaatagtgcatccatctacttctataaaaataggagccacattggccaggcgcagtggctcacgcctgtaatcccagcactttgggaggctgaggcaggcagattacgaggtcgagagatcaagaccatcctggccaatatggtgaaaccccatctctactaaaaatacaaaaattagctgggcgtggtggcacgtgcctgtaatcccagctacttaggaggctgaggcaggagaatcgcttgaacccaggtggtggaggttgcagtgagctgagatcgcaccactgcactccagcctgggcaacagagagagactctatctccaaaaaaaaaaaaaaaaaatatatatatatatatatatatatataaattatattaattaaatataaattaaatatttaatatatatataaaaaataataatatatataataatatatatagaagccacacaaagatcactaactgatagtttagtttgataactgttttccagtttagttgtcaaagcatggtgtgaacaaaatgctgagtgtcaacactggcattacaaataggcccaaaatgtgagcttttaatgagaatgagaaacattttatgagatttaactgaatatgccttaacacatccatgaggtagttaagtaaacagtactacacattttaatacatagtaaacagaagcatgggtaagtgacatactcatacttcaagcaataagaattagaagaaaccacacagaagcttggggcattctctctagctctaccccaaagaaaatgaactttaatttttttttttaaagcatcgtatcactgaagattttcttcttcttcttctttttttttacacttgcttattagtatagtatctctttccaaagctggtacccttttcaataatgtggtaaaaactgagtataacccttaattcaagctaggcctctccttctacctgaattggtacaaaattaagacatcttgtaagaactaaaattgtatttgaaatttttattttaggctacaaaaacaagcaaacaaacaacaaataacttgaaaacaggtcttgtcaaatgatgtaagttcatcctttccagggaagcagaaggtagaccctaccacaaagaaaagatgcttagttaatggaggttaaatttaaaagtacagtgaaattcaggctaacttctgaaaaatcctgttttattcacctcactgtggtaccagtaactatactgagtcaggttactttacagttaactatgtcacctataacacaataatccattaacaatctaatacagttattgggtgtggtcatactggaagttcttaaattcttaaccatatagttgtcttgccaatttttttttctttcagatgagtcttgctcagccacccaggttggagtgcagtggcacgatctcagctcactgcaaccaccgtctcccgggttcaagtgattctcccatctcagcctcctgagtagctgggattacaggcacccgccatcatgcctggctaatttttgtgttttagtagagacggggtttcaccatgttggtcaggctggtgttgaactcctgacctcaggtgatctgcctgcctcagcctcccaaagtgctaggattgcaggcgtgagccaccgcgactggcatgccggttttttttttttttttaaacgatggattgtcttagtacaagtccctgcatttctgtaacaaagtaatgaaaggcacagctaatccaagcagacttaaccctattcaacaaacagctgaaaaaatactttggttcttcaaggaaaaaattacgaaaaaaaaaagtgtttcctttaacagttgttaattttcatagctgtactccaagagctatataaatattccagaagaaccaaattatgtagcagcgaatgaacatgtgtgacagaatttgtgcattcaacatacctggcagaaaaactagtgaaaatgctaggtagaacagattggtctttaaaatatcagtttcctgtcctttaaaacaaaaattacccagtctaccaagaaaatacaaaaacataaggcagtaagtaagaattgtgtttaggctaggacagtgcaggttatcctcaaggccacatatatcctgcttcactgctgcttgcactctgctgggttttgatccttcttcgggtcatagtctggatcattttcctcatctcctttgtcctcttcctcatctgcttcttcaccttcttcatcatactcatcatcatcatcttcagtagcttctccagtaaactataacactgatcttgggattgtatgctcacgtaaaaagtgaccaattttgaagtctgcagcaaggatagcttcagcatcatcatccagatctccactctcaggaacttcaggaggggcaagaaaattaaagaaagagtcattggaaactgttttagtcacaatacgaattgtcccatgtccctagtgtttctgctgctgcttaatggttttcaaaatgacattctttccttttttccaatctatctggccccctgtacaacccataatttcttgtccatcaaaggaaaagtgatcagaatcatctggttctggttctaacctcatcctatatgtctttgtcagcacttcatttgtaaaatatttactgggttcaaattgaaattctaagacaaaactcataggcaggccagcatctgagaacttcactttggtatctttcacatgcttcagaataggttcatcatgtttctgaagcatatcactgagcaagtcaacattcttaaaaacaggtaaccaaaattcaggaattcctttggggtcttctttttcttcatcgtttttctcatcttcagtcttggccttttctttcaactcctctgaaatctcatcttcttcatctggtttccattcacattcttcctctgtaggttcataaattgtattagtaatctcagattgcttatcaaatagaggctgatagagaacagcatacttcctttcaagatcgtgaacttcctcatagaatttggcttctatctgtgcacctttaacttgcaggtttttgagagcattcactcctcttttaactaccctagctaggcaggttgtcaatgtctgccatgttgtaagaactccaaatatcagtggctactatgagaagccaggcggctggagctgtgcaggcagtgactcagggcagcagtggtggtggggaggagcaagaggcagcactgcaagcagatggcgctaaaaaaagagaccctatctctgaaaatggaaaaaaaaaccactcttaatttcaccaacctgagataattcctaaaatttggcattgacctaggcatttttgtatgcatctacaacacatagatgcctatactacatgtctttaaaaatcagatgctatacctatcttggaatcatttctcaaatcatgtaacaaataactttctgtctcatacattatcagtctgaagatttgcatagtattttactttttagatataccctcatttgttaggccagtctcctactactggatagtttgttttctgttatatacacatataagctgtgatggactacctgcatctgtctttggggctttgtgtccaagtaaacactgaggataaatttgtagaagtaagtttattagattaaaggatataacatccttagaatctttcattacatattgcatattgttagcatattgtactgttttactaccagcaagaacatccatttctctacaccctcattagaacacctttttattttgaaataattatagactcacaggaagttgcagggtgatgtacagggaggtcccatgcaccctccactgtgtaccctttcccccatctcccccactgttggacatcttgcataactatagtacaataacaaagtgagaaaattggacatgggtacaatccacagagcttgttcagatttatacgtgaatttgtgtgtgtgtgtatgtgtagttctgtatactttagtgtgcccaagatggtcttcatatgagtcaactccgtaaagagagtatttatcagactaattattggttatatgtacggcatattgagaaaaatagattaccacaaatgggcctttgaagagtttagtgggtaaagtaggtcaaggtaatactgggcttgattaggctgcaaaagtataacttttatttaaatacttcttattgttagatataattcatattcagaaaagtacatacagtgtatatgcacactttataaacagttaataaaccaattatctgtgtccacctaatcaagcgtttcagacactgaagagagaccatttacatttatttcagggtttgggagaactccacatttaagaaggcatttgaattgggctctgaatagaatttgagaaggcagtaatgagagggcattttaggcttggcaacagcaaagaataatgcaagaataatgtttttggagaacagcaagtatagtgatgggacataataggagataaggcaggaagggtgtctaggaacaagactgtagatacgaagttttttctgtcttgctctgtcgcccaggctggagtgcagttgcgcgatctcggctcactgcaacctctgcctcccaagttcaagtgattctcctgcctcagcctcccgagtagctgggactacaggcgtgtgccaccacgcccggctaattattttttattttttatttttattagagatgaggtttcactgtgttagccaggatggtctcgatctcatgaacacgtgatccacctgccctggcttcccaaagtgctgggattacaggcatgagccactgtgcccagtccccctttttttgagacagtctcactctattgcccaaactggagtgtagtggcgtgatctcggctcactgcaaactccacctcctgggttcaagtgattctcccgcttcagcctcccgagtagctgggattacaggcgcgcactactatgcccggctaattttttgtatttttagtagagatggagtttcaccatgctggccaggctggtctcaaactcccgaccttgtgatccgcctgcctcggcctcccaaagtgctgggattacaggcatgagccaccgcgcccagccgaaattcttatctattaagcaattactcattcccctctcctccctccagccctggtaacctctaatttaattaattaattactttattactttgagacagagcctcactttattgccgaggctggaatgcagtggcacagtttgggccagtctctgcctcccaggttcaagcaatcatcctgcctcagcctcctgagtagctgggactacaggtgcccaccaccacacctggctaatttttgtatttgtttgcatttttagtagagactgggtttcaccatgttggccaggctagtcttgaactcctgacctcaggtgatctgcccacctcagccttccaaagtgttgggattacaggtgtgagccactgtgcctggccgaatttactttctgtctctgaatttgcctattgtagatatttcatataaattgaatcattcagtatttgtccttttgtgcttggcttacttctgttagcataatattagactagtactttttgcctgagctagtataaaaaagtactcaatagtgattgtaaaaatagagaggaagggatgatttggggaggcattataaaggtatttgtagaattcagatggacttgaatttaaaaaaagataataccagggtttctagttattaaacaagataggaaacataaggtgctcagtaactatatcaagagatttaatttgtctaaggctgggcgtggtggctcatgcctgtaatctcagcactttgggaggccgaggtgggcagatcacgaggtcaagagatcaagaccatcctggccaacgtggtgaaaccccgtctctactaaaaatacaaaaattaggtgggcatggtggcacatgcctgtagtcccagctacttgggaggctgaggcaggagaatcgcttgaacccaggaggcggaggttgcagtaagccaagagcgcaccactgcactccagcctgggcgacacagcgagactccgtctcaaaaagaaacaaaacaacaaaaaaagagagatttaatttgtctaaagcaagagtagggctgggcacgggtggctcacgcctgtgatcccagcactttgggaggtcaaggcgggcggatcacttgaggtcaggagtttgagacaagcctggctaacaagctatacttatttatttacatattgtctatggctgcttatgtgcttaatggtagagttgagtagttgcagcagagactgtatggcctgaaaagcctaaaatactatgtgaccctttatggaaaaagtttgccaacctctacttcagattgtgaatcaatggaaataaatataaggcactgtttcctgtcctcaaggaaaactagggcagagaaaaggtgcttagcaattcttagttaactgttgatttatgtcagaacatttattatatttacatatatataatttaatgattccttttcccctttaaaaaaattagagaaactagttcataatgagctgagttagaacacatggtaatgggaatgaatgaaattgtttatctgaggctttctcagaaaataagatgagcttaaagcttctagaaagacttctaacttgtatcttctttccctttttgcaatgccagaaaccatatacttcattgcctttcagatgcggtggtgctagaatttgttatattttccatgagacttttgggcgaaccttagaatctgttgatccacttggtggccttaacactattgacattttgactgccattagaaatgctactgtgagtatgtttagctttttagactgtaaaaaaaaatgaggttaaagtttttcttacccatatactgtgtctttttaaatttaattatacagtttattttgctctcatatttgaaattaaaaagcatttttcatgaaaagtaccaaaaatgtgactttcttaacccttgggaagaactgaaattacatatataataagagttctaagttttattttctcagggtcctcgtcctgctttatttgtgcctgaggtttcatttgagttactggtgaagcggcaaatcaaacgtctagaagagcccagcctccgctgtgtggaactggttcatgaggaaatgcaaaggatcattcagcactgtagcaattacagtacacaggtaacggagagaaatgtaacaggtttcacatgaactagaaaaggacatgaagtggtggtttcactgggtggaaggaaatgtataagatgggatacaaggtaaaatctgtagttcccttacctgaaagtgatttgaaataggattcttaaatgtagtctccaaattgaattcagtatttctgtgatcattaagtaaaagaaaatgactgttagcctggcatggtggcttctacatgtagtctcagctacttgggaggctaaggtgggaggatggcttagtgagactatgacttaaaaaaaaaacaaaaaacaaacacgtttttctttcatctaccatttgtaggaattgttacgatttcctaaacttcatgatgccatagttgaagtggtgacttgtcttcttcgtaaaaggttgcctgttacaaatgaaatggtgagctactatagcatagatcattgtaattactattagtaaaagtttaaatttttgcttggctgctttttaataagcattatatggttactttagagtgtaggcataatgttttccagtgtattgggaggaaaaacaagttgagtttcagtctcattttaaaggaaaatttttaataattctggtataaagtgcattttttcttcatattttaatcattgttagcctgcaggcatgggttttcttgaaaatagatttatgattgaggggtgtgaatagctttgctgtattatttagtaccactgatcttaagagaaaattagttccatctttagcctcagtaaactgagcatttatagcacactgttactttgaggtacatcggagtaatctggccacttctgcagtttgcttgttatgacctaataactataatatcgtagttgcttgctactattctgtgggttgctgctatccacacaaataaaaatgctgaaattggcagaaatatgggataagcatttaaaattgccctcatgcctctaattgttggctgggttttttgttttttgttttctttctgatcactaaaagtgcatttgggtccttggctcaggatggtgaaccccgtggaggtttactaagagtacaaaaccatccttggaatgtaagtgctgctgcttggttgtttctttagcaaggatagccctcagattctgatgtctaagactgaatttagcccagaatcattggaccttcattttaatagaccctttttacccagttctggactgataagtgctgttctgatacctgagatttgttaggacagcacataataaagggctcaagtttattctctctgtaagactcagtggtgtggtggctcacacctgtaatcccaacactttgggaagtcgaggcgggtggatcacttgaggtcggaagtttgagaccagcctgaccaacatggagaaaccccctctctactaaaaatacaaaattagccgggcgtggtggtgcatgcctgtaatcccagctactggggaggctgaggcaggcaggagaatcacttgaacctgggaggtggaggctgcggtgagccgagatcgcgccattgcactccagcctgggcaatgagagcgaaactccgtctcaaacaaacaaacaaacaaaaagacttagcaattctgtagagggctggataaattaattttaacttttcttttttattttcctcttaggattttgaactacatataatattttaactaggtgctttatagttaaggctaatcagtcactacctcaggtccttagatgtatcctttacccaaataagttaacatctttaacttatgccttgttacgaacttattttcttattgttgaaaatgaactaaaaaagtgacagggaatagtggatgatctgaagttttaatagcaaagttgcataaagtgttggaatttagatttgcattaggtagatgactatttttccctaagagtaaaatacttgtagttactttaatgttatttttccctcttagaaatgcagttttagatgctgaaatgtaaataattttaaagctagagtaaattattgtttggcataagatttatcagttggaatataattatcaagtaatttaggcataagtttcctgtactttttcggtattgtctgtttcataagttttatatataaatttctcaaagtaaaatatggttgatgtatttttgtatatcgcctaacttactttttttctaggtccataacttagtggcaattgaactggcttatatcaacacaaaacatccagactttgctgatgcttgtgggctaatgaacaataatatagaggtaaatataattcttaaatgctttttcacaggtagaaaaatctgttgtaactcagttatatcaaacttatttagcatggagtaactataaaatagacatgtgccacattagtgcctgctgcatgtcaggaaatatgctgaggggattacattgttttcttaattctcaaaaccacctgcaggcattattactttctgcttatgaaattgaaattcagaaagaatctgaaaattcattgatttggtgtgactggctctattttggtaacttatagtttatacaggggaagtgtgtacaacaaagtatttaaaattcttttcatttggctttgaaagctgtgaaggaaacactcaagaattaaccaacttagcataaatttggaaaagcagagtgcttttttcaccactactggggtggctgcatttcatggatcttttctttccttttgattttaatgtaacaaattgaataagatctcagatggagccaaggctggtggacagagcaatttatccagaagccattttttttctctgccgcttttctccaaaaatagtacatttttctgctactccctaattcagtaagacctgagtcccctgctataccaaatttcctcttctgcatatccatggtgagaaaattgtaaacatgcaattcagaagctggaagggatcctgtgttattgacttcaactctggttaaaacagatggggtggccagacgtggtggctcatgcctgtaatcccagcaatttgggaggtcaaggcaggtggatcacctgacatcaggagtttgagaccagcctggccaacatggtgaaaccccgtctctactaaaaatacaaaaaattagccgggcttggtggcaggtgcctgtaatctgagctactagggaggctgaggcaggagaatcaacttgaacccaggaggtggaggttgcagtgagctgagatcgcgccattgcactccagcctgggcaacaagggcgaaactccatcttaaaaaaaaactggggagcttgaggcttacagatagcagttattcctttggtgcttattttgcagggcactattataggaagcaagcaccttcttaacacaggtatagggaactaatttttggttacatagctgggggtgattcctgttatcagaaaaaattccaaaatgcatacatgagtaggcacttcaaaacactcagaaagtaggccagatcacagttatgttaaaaattagcatgtagacacttaaaggatttagttttttttacattgaaactaacatcatgaaaaacttgtgtttgcggtagttctgttacactgacaaggtcatatgtgatatgatttcagattagtatttttctacaaatgaataggtttctggttttaatgactgtgccagagaactttatgtggatattttcatttaatctttaccataccctgagggcagatcatgtcattaacagattaggacactagggcttcaaaatagttggtaagctgtccagttagcaaagcaggtactccacatctgctggggtccaggagcagctcagatcataactggttagtaacagactagggtgagaattctagataccgtggccttttgctttgtatccctgttcaaaatgtacattttatcatgctaattttttattttgaagattgttaatatctatacttttattatctgttattttttattactgaatacccgcccatgaaaaaataaaattgggtcaaatttctgtcaaaaaaaattattacacatgaaacatcactgtgggctgtgtgcggtggctcatgcctgtaatcccagcactttggtaggccgaggcaggctgatcacctgaggtcaggagttcaagtctagcctggccaacgtggcaaaactgtctctactaaaaatagaaaaattagccgggggtggtggatgcctgtaatcccagctagtagggaggctgcagcagggagaatccattgaatccaggaggcggaggttgcagtgagccaagatcacaccactgcactccagcctgggcgacagagcgagactccatttcaacaaaaaacaaaaacaaaatcattgtgaggctttaacttatatttttttgcaagttggactgtgttcatgaaatacttcctacttaggagcaattgtgactttaacctaaatagtttctactttatctgatgctgcctgtgagagatccatcattaattaacatctacagatttctatatcttcataatcttttttttttttttttttttttaagacagagtctcactctgtcgcccaggctggagtgcagtggcatgagctctgctcactgcaacctctgcctcctgggttcaagcagttctcctgccgcagcctcctgagtagctgggattacaggtgtgcggcaccatgcctggctaatttttatatttttagtagagacagggtttcaccattttggccaggctggtcttgaactgccctcaagtgatctgcccaccttggcctcccaaagtgctgggattacaagcatgaggcactgtgcccggccaatattttcataatcttttacctatcttggtgcttggatatagcagatgctcgggacattctaatttgaatttgtcagtttctttagctttgtacaagttactttgataatattagcaaattagaacagtaggcaattgatcagtgtgttaaattagccaggttacagaaaggactagcagttgtcaacactatttcctggaggaagaaatggaacatttttataggataacctcaaccacagatacttcttcaagatacggttttatgaggggagttgtttgagtttaacacaaaggtgttcaggttagagtgacttttaaaggctttgcggagttttctgtgatctctggacttcaaattccacatggttatgttgaaggcttaccacgttccacatttatgtgaggacagtttacatcactgtttcttagtgggaaagggggagaagatggcagtctgttgcccctcatttgagaatccccagtacagggagccactgttactgacagtgtattgtatccttcaggtgtgtgggcagaaaaaaaaaagattaagaagctttgggttaaatgatttcttatttattttaaaatatgataattatggcatgagtcccaacagtgagaggatgtatctgtaagttactccacacttttcaattaacatgaacattttttagtaggcatatatctcaatacttggataatcacttttgttttgcttgtgtttcttaggaacaaaggagaaacaggctagccagagaattaccttcagctgtatcacgagacaaggtaaaaaaatgtttttaatgcatattcccaatacctaaagatagattgatgagctcagaatattactcagtcctaggagtaattttttcttcttttcctccctttaacactccattggaactaactgagtaaaggcatacaagtttaaaatgggttttgagtgatttaaagataatagtattttgaattcactgacataaatgcttaaaagtagatttaagcatttatttaagcatttaagcatcaagctttttaaaaaaattcagtcagtgactttatcaactttgcacatagctgaaatgactcaagattttattataataagagggtttcttggaaaaaacagtatgcacagaacagaggttttaattactagtaataattaaaatagttgtaatactaaagtgtgtataaaaatcttttaccttgaattctttgccagaaaagaatcttattaaataccaaaaataaaaatgaagcttttggatttggatttttcttatgtattcatctgaaggaaacttttaacaaaggtgacaatggtgaaggaaataaggcagaataaacaatctcccatgattattttcatctttcatgttattttacgatttcattacagaagggaaaaattcatttatagaatgttcctgaatgcatttttgcatccttgattttttttcccccctggattttttgcctttagtcttctaaagttccaagtgctttggcacctgcctcccaggagccctcccccgctgcttctgctgaggctgatggcaaggtctgttctgattcttaatctaagcctgcatgccttgttctctggtacaacataatcttctggaaacaatacactgaatagaagaatattaatatgggatactgtgctaaggtcagatcactttagtctaatatatattttaaaattatataacaatgcaatgcatagtttatattgttgacatgcttttgcttgcaatatagaagatgcacacagaaaaagtaatttaaagaggaaattatcctgcactttttgaatttcaacccattggtatttaaattttgcttgttaaattgcatgttttaacatatcttttaacagttaattcaggacagcagaagagaaactaaaaatgtgagtctcttgcttcagaatggaaatgttggtacctttggttctcactgaaacactgtctataccaccattaaagaacctgtttgtgtagtggtatctatctcttgtctgtgttatgttcttaatgttccttttatctaacctgtggaagatggcattaaacgttgttttaattagtaacaataataggctttctcactgttttgttaccttcaagaatagttttaaatttagtattttggtaggaaattcagagatttcctagatttcagagatggaattgtatttttggacatttcctttcctctttaaagatcttgagatctgttcagtactaatagatctaatgcttctttcttatgcttccagttagtttgcacttgttaccctatatatagcttcacatatgcttcagaagcttaagcaaattaaaaaaacaaatggggactgtgagagtttgagactgttttcaattcttgataaccattttagaggaaaattaaataatgtataaattattcagactcatcgctatttcaagattttctgccatttagctcctttccttaattatccagatttaaagttctgaacttcaaataaaggtttataaatgtcttatcttctctcagcccactgtgctcagatattaatcaaaccatctaaatcactgcacaagttttatttcattcatgacgtcacactgaatgtgctctctctccttaagatttcatttggtatgtcattcatgtatagttaacaaacatttaaaaatctaattactcatttttaagttaatgtgtaacataaatatactacttatatttaaatgtagttcaccttaactgacatactaaagacagattttagcaaatattttgattcagaatgatacctcaaactaccatttttctaactgccataatcctctattaaacttatataatccatttttagattgtaagatcttaaagaatacctaaaaaaaaccctcttaaatgttgatgaattgtttttccattataaagtcatttttgacttttagaagtcaagactaatacattttctagaaaacaaggtacaaaagcacttgtgattaatggtagcactagatttctttcagcaaatccttaagagtacagaggttgaggggacttctgttgtttgtcacattccgcatttgaaacaactcacagtgactgtcagcctaagaatagcaaatgtagtcttgctttttgttaaagagttcttacttataccttatggcatttttgttgactattagaaatgtaaattgagaaacatataaactcttaagttcagagacgtaagttcatggaacttttagagtttaacagtgttaatgattacttaagaaattaaactgaatagcagttctttgtgcttttaacgagtagttttgtttttaagggcagcatatacttttcctacaatttagtgtttgaagggtgggagaagaggaacgattttgaaaagttagcgaatgataaagaaaaaaggaattaaatagaacataagttggttgatgccttgcaaacaacttagagcagaacttctttattatttagataggtcagggttccagttatacatgctacctagtgtctccttctgacctcattatctgtctgaataaacttcagatgggtactggatgtatattgactactgtcaaataaaatgaactttgttttagttaaggtcagatatgatgtggttggtatgttttggaacatgttttttcaggttgcatctggaggtggtggggttggagatggtgttcaagaaccaaccacaggcaactggagaggaatgctgaaaacttcaaaagctgaagagttattagcagaagaaaaatcaaaacccattccaattatgccagccagtccacaaaaaggtcatgccgtgaacctgctagatgtggtaagccatgacaatttggtttaggtaataaggtaggtgaccaagttagtaggaaaacgattagacagaaagaactaaaagtctcaaaaacttacataactttcagatgttaaagctgccattttagtgtcacaaaagtaatattttttccccctcatccctatttagccagttcctgttgcacgaaaactatctgctcgggaacagcgagattgtgaggttattgaacgactcattaaatcatattttctcattgtcagaaagaatattcaagacaggttagtattacttaatataaatgacggactttaatacttctggatgattctgtgatctgttttgaaaaatacatgtatttttacaattttaggtttttattctaaatcatcaagtggattttctgatagtccttgggtaacttgtagcaagacccattttgttaacatagaatgactaggacctcatgtatcagctagaaaaagctattaaaaatgagagattcttttgttctatctggctgccacattttgagtcatttaagaaaatctttttcctaaattttaatttagtagtttcattaattattttggctagtaacactgacttgcctttttaatttaacttggttttccaaagtatcaaaacgaatgtcttttactaggaaatatgtgtattttttctcgttcagaatgttttttcatgtgtctagtccctactgcatcttctccttcatgttgcctggtatgtcatttcatgcagtaatagggagaatatacatttagttgtgtgaagtgatctattagaaaatattctgcatccagtttttggtaatctgtcagcagctaagatgaattttactgcacagagtaataaacagtctaatacttcatattgaaataaatgatttttgtctgtagaaccatttatcttttttgcttgtagactttttaaacccgtagcttgtagtagaaataacagttcctagtgttttacactgtgggcctgaagaaaaaaattccatttgtttccttccttgcccccatcctctgcagaaggtgtttttgagatggagtctcgctttgtcgcccaggctggggtgcagtggcgcagtcttggcccacttcaacctctgccttctgggttcaagcgattctcctgcctcagcctcctgagtagctgggataacaggtgtgcaccaccatgcccagctaatttttgtatttttagtagagacgggtttcaccatgttggccaggctggtctcgaactcctgacgtcaggtgatctacctgtcttggcctcccaaagtgctgggattataggcgtgagccactgcacccggctcacttaatgtttttaagcctcatccatactgtagtatgaatcagtatagtcacgcaccacataacattttagtcaacagaccacgtatttgaatgtgttcccgttagattatgataccatgtttttgctgtacatttcctatgtttagatacacaaatactattgtgttacagttccctattcagtacagtaacatgctgtacatgtttgcagcctggagcaataggctatcccatatagcttaggcgtgtcataggctataccatctacgtttgtgtaagtacactctgtgctgtgcatgtaatgaaatcacctaataatgcatttctcaaagcatatccgtgtcattaagtgacatatcttttgtgtgaataatactagattatgtagatatactgtgtttaagcattcatcagctgatgtttggatttttctcacttcttggctattatgaataaatgcttattgaagagttttgaaataaagatgatgaaaagaaggtaaagtatcaagaattgttgcttttgtttttttttttgagacacagtctcactctgttgcccaggctggagtgcagtggcgcgttcttggctcactgcaatctccacctcctgggttcaagtgattctcgtatctcagcctcccgagtagctgggatcacaggcatgtgccaccacactcagctaattttttatttttagtgcagacggtgtttcaccatgttggccaggctgctgtcaaactcctggcctcaagcagtccacccgcgtcagcctcccagagtgctgggattacaggcatgagccactgcgcctggccgagaactgcttttcttaatgtttaattacagttaagcaaaaatctaaagggcgattatgccattaatgaaatatccaaagtagtagtgttcttacttaactttatttcatgaggttagcatctaagcccaaattgttaaaagtagaattttggctaaaattccataatttggttgtgttttgcagtgtgccaaaggcagtaatgcattttttggttaatcatgtgaaagacactcttcagagtgagctagtaggccagctgtataaatcatccttattggatgatcttctgacagaatctgaggacatggcacagcgcaggaaagaagcagctgatatgctaaaggtattgtggaccttttgattttttatacttgggtagtagatagaaacatagaaatagttttaaatgcagtttgattcttggatatgtatagtctttatattctagctaggcttgtttcctgttggtacttgataagaatctttttttttttttttttttttttttgagtgggagtctggctctgtcgcccaggctggagtgcagtggcacaatctcggctcactgcaagcgccgcctcccaggttcacgccattctcctgcctcagcctcccgagtagctgggactacaggcgcccaccaccacacccagctaattttttgtatttttagtagagacggggtttcaccatgttagccaggatagtctctaactcctgacctcatgatccgcccgcctcgacctcccaaagtgctgggattacaggcatgagccactgcgcctggccggtacttgattagattctaattccagagaagatattggttagtataaactggttagttataaacctaccacatatatattggaaaaattaccctgcgtaattcagattaatttcataactttataataagcatttaaaattttttttcctttaatgcaggcattacaaggagccagtcaaattattgctgaaatccgggagactcatctttggtgaagagaactatgtaatactgagactttgttgactcaaaacttgctagttactgcctacctgagtagaatcttatttatgaactcctgtgtattgcaatggtatgaatctgctcatgtggagactggctataaactgaaaagtgtattccaaattgcagaacacatcacacatttaatccaaataataaatggctgtttctaaagtttcccagtatatataaaatacatcaagtctgtcttgtgacagtttcatctgaacttaacttaaaaacaactgttaatgttctagttgtgcaaagcagtttgcctgtggataagatgacctgtgtaataatctttgttagtagtcttaaagctgctgccatagtcctccaagaagaaagcaccaagacaacatttcatatgactataatgcatgtactatataagctgatctggctttgaaagatgtgagttggcaagttcctcacatagagtcattgtattccacctgtccttcaatttagttttttctgagcttctttgcagcctttgatgtgtttttaagaaagctgaatgcacaagaggatctgtgacactgacatggctgtggtgtgcatactgtgtagttacatagcccttccaattctgggtccatttgcactagcaaattaaaatatgctttgattcatacttaaacctgaaagcaggaatgcctacattaattcctacattaaaaacagccatctacccttgattatctagaaagacttggtaatgatggtcagttccttttagatttcagaaaatcaaatgatgacctaaatttcccttaatttgcaaatacagtagtaattaaggtacatctctaaagtggagcacttacaccaggctctaagattcactttgaggtggaacttaaaaccagtgtactgtatgtatgcattggtaatagctacttttgcttcatagcttcataccaacaaaatatatttattagaatagtatgaaagtactggaggagctgaaaga

SEQ ID NO: 36337 - DNA, 3256 bp, Homo sapiens
aacgcaggccgggcgggaagagccaaagcgggcaggcggcggaaatatccgaagcggcggggcgcccgaggccgttgccgacctccgcgctaaagccgctgctgccgcggaagacgatcctccagtacccgcccgccgtcaccgcagctgccgtgtcctcctcccacccctagccgcaccccctcgcggagggatcagctgagcggccaaacggcacggtcgggggagccccgagtccgcagctgcagcggggcctgagaccagagttggcgagggcaaggaaggagcggccccgggcagtgggggcggggccgggcgggcccgagaacagccgaatttggccgagcgctgccgagcgagtccgaggcgctgggccaggccggagccggactacgggagccgaggcgggccgcgcggtgggcgcggagaggagcggagcggcgcggcaggccgggcgggtggcggcagcagcggaggaggccgcagctgcgggtccgaggagcggaggcgacgcgggcggcggcggggggccgggtggccggggtcccgggccccgcggcggcggcagcggcggcggcggcggcaggatgatcaagctgttctcgctgaagcagcagaagaaggaggaggagtcggcgggcggcaccaagggcagcagcaagaaggcgtcggcggcgcagctgcggatccagaagggtagggggtcaggggatggggttggagccggaggtcggaggtcagggcctgaggcagggtgatgtgggagtcaggaaggggtaatgcggttgctgagggtcagaggtgaagggccccgagcgtggggggggtcggaggtcaagtcttgagggttgggatcatgcagtcacggggagggggtcagagataggggcccggtatgtggtggtttaggatattaggaaggcctggtgtctgctactagggactcggaatctcagagtcaggcagtggagtggaggaactgacgactcgagagtctgggggttagacgggaacttgggtttggggtgacaggcggagaagagagggatagtagaggccaggggttggggatatgagtggaagaggatttagtttattatgctggggtctctgggaatctctgagtcaaacgggtgaagtaggttggaggaccagggactcatgggcctgcctgagtcacagcaatttggggtttggggtgacaggtggaggagggaaggttaatgagtaccagggattggagacaggggtgaggggaaatttaggctattgtgctgtgaacctcagagtcagagggggtggggtagggtggcgggggttggggacttgagagtgtgggggtcacatggaaagctgggtctgagagacagagaagaggaaggacagtgaggactgagggttggtgggggtgggcaggatctttgagtttgggtgaacaggtagatactgtagagtggaggtcatggatggggagcctggggtttagggcggtcagaggatgtttgggagtgggggcatttgggagctgtggatacagaaaagttgggggtcaccctgggccaggagttgggacacgcatacacagctgaacatgcatgtttggggtatgctgtgtatccacaagagccaagctggggagcagggagagggctggaggtgtggagcacagcccaggagaggcgcctgggggtccaggaggagacgatgggggctctgctaacaaacacccgccctaagtgtcctgctggctccctctctctctctcttcccctccctctttctgttcccgactctctgctacccaaacccagacataaacgagctgaacctgcccaagacgtgtgatatcagcttctcagatccagacgacctcctcaacttcaagctggtcatctgtcctgatgaggtgagggtgcatatggctgaattcccaggagcaaaccaagggtgtccccactgagaggagggagacatgttctgcccatcgggccccacaggatggaaccctaaaattttcttctcccccttttcctcccagggcttctacaagagtgggaagtttgtgttcagttttaaggtgagtcccaggcgggcagggatggctccctggacagaggaggcagcagctgaggcccttccaggcacctacccatctctcttttcttttcctggagccaggtgggccagggttacccgcatgatccccccaaggtgaagtgtgagacaatggtctatcaccccaacattgacctcgagggcaacgtctgcctcaacatcctcaggtgaggacactggccctctaatgccctcctcagcgctgcctgccaggcctccctcatggtcttgtgggcactacatcagactctgtcccttcccacccctttgttgtctgtggtttcttgatttcccagtcatcttcctcatggcctgaccttggttttctccttggcctgtcctgctccacaccctccctcccagcctctcacatgctcactctcctatgccctggatctgacctgcccaacaccagaggggcctgtggcagtctcccactcaccaagccctgaccctgatgctctctgtccacagagaggactggaagccagtccttacgataaactccataatttatggcctgcagtatctcttcttggtgagtaggaataggtggttgggtctggggagattggccttctgtccctctggcctgttgaccccccctacctgtactggccacaggagcccaaccccgaggacccactgaacaaggaggccgcagaggtcctgcagaacaaccggcggctgtttgagcagaacgtgcagcgctccatgcggggtggctacatcggctccacctactttgagcgctgcctgaaatagggttggcgcatacccacccccgccacggccacaagccctggcatcccctgcaaatatttattgggggccatgggtaggggtttggggggcggccggtgggggaatcccctgccttggccttgcctccccttcctgccacgtgcccctagttatttttttttttttaacaccatgtgattaaggtcggcgctgcctcccccgacccactcagcgatgggaaatgaattggcttgtctagcccccctgctgggtgcttgttcagcccccactctgggctgtggagtgggtgggcaacgggcctgggtagctgggcccaggcaacccacccctccacctctggaggtcccaccaggctattaaaggggaatgttactgc

SEQ ID NO: 36338 - DNA, 46825 bp, Homo sapiens
ggagccctgggcgcgggggcggcgtgtcaggtggttgcggagctggtaaggtgaggggaaggcaaggtcaggggtcacggcattccgctcgctggcagggaggggcgcggggcggctcgagggcctgtgtcgggggtcaggctccggggctaggatgcgacaccggctcgccgtgcggggctgtgaggggaggtgtggccagggagggcctcaggcccagagtccaggactgatggagtcgcgccattcagagaaagacccaaagatgggggcagggagggaacgccggaggtcgcgggggtctcgccccttccccgccgcggcctaggacacatggcccagctcccagctgcaccggatggcgcgcccggcctgtgtcggggtgcgctgacctgcttcgacgcctcgaaagaggccgacgggcacagggcaaggtctttcgtggcctcttcgtcggcgccgcagggggccgggctgctctccggggcctcccgccgccccgcttcaacaaaagactcattataacctaaccgacttcagggagcgccttctgtgtgaatagcctgcatacgcggctcagtaattgtgggtagattggttttaaggctgtttgtgtagctctcagggaccctctggattccaggctccaatgagcagggtttttctacagggggatattgcacatatgtaagtgggctggatggctctcccagctgtgcgtttcatgtgtccccacttttaaagctaccgcttaaatgtgacatctcttgcaaaagcaaaaattatatggaaggagagtttgcaaggggagataggcttctaaaaacttgctggcctcaattttagtgactgttggtgaaaaatggagaagctatgtttacactgacttctggaacccgaagccccaccagttcgcatgatttcttggctttgtaaatctttgagcatgttgtttgcctctttcttcttttgttccacgtacttaaaatggggattgataatatcagtcttacagggttgttggtatgaaattagttaataaacaacaaagtacttagaactcttgatgtggaggagtttttgttgttgttaccttctttccccttaacacttctaaagaattctaaccttattacttattctttgctcagagtctcatgacttatcaccagtgaacccgccggcctatactttccattgacatcattaactttgatctgagggtatagtgtagttatatgtgactagaggatttctgctgcgtgtttgttttattaaatacggttggaaactatcattatactaggtcatttattgtgatacctgtgttgggtaaatgaaacctgaaaccttcggctgtttattttttcattggacagtatttcattgacagtcttgcttggcctactcagtttattttggagccagtactaaaaaggccatgattgcagcatacttggtttctcatgtttccggaatggcagtgggactcgggaggggaatttctgggtagcctggcagcacttcttgttaaggaatggggaagcttcttatgaatctaatcttactctaatgttaggaaatcagcagtggtcccttggattactctacaaagctagtaggcagctttggttcagttatgactcagtgaaggttagagaattatatctacaaagtaggatctttttctttctttctttcgttttttgatacggagtttcgctcttgttgcccaggctggaatgtaatagcgcgatctcggctcactgcaacctctgcctcccgggttcaagcgattctcctgcctcagcctcttgatgcctggcgaattttttttgtatttttagtagtgacggggtttcaccatgttggccaggctggtctggaactcctgacctcaagtgatccacctgtatcggccttccgaagtgctggggtggtgtgagccaccgcgccctgccagatctttcttgtttgactttcattgctaagaatttgggtgagtgttgttgaatcaaagacatctttattctctgcctcctcaccatgcacatacgtacaaatgtctgctgacagatatctgcccttcctatggccttaaaaagccttctcatattctcgtggtgctatctgggatacaccagtggaagactgctttgtcttctaattcttcccttcaaagaagcggctatttatacacatagcattattaggaactagtcagaaaatgagaaactttaagtttatgaaaaaaaacattgcttacttcagctgcatgctggccaaatttagttgaagtgcagttggtataagtttagttgtttagttttggaataagagagttcaagacttcccctcccaccccccacaagacaaggtctggctctgtaacccaggttggagtgcagtggcatgatcacagctcactgcagggttgacctcccaggctcaagtgattctcctgccacagcctccctagtagctgggagtacaagtgcatgccaccacccctaatttttaaaaatttttttgtggagatggagtcttactaggttgcccaggttgtcttgagcccctgggtgccagccaccgtgcccaaccagtttaatacttctttaggatttaaagttggaagttggcctggtaagagtgaaggacaatgtctttgtaatctgtttttccctgagaggcatgggaatgacacctttaaagaactgagtgtgtttgaggcagaaagggaagtctgctgccctaatattgtcattattatcatctctctgaggctctgtagtttgagtaaaacattctgggaaaaaaggtaggggcatttgaatgagcggaatataatgaattagaagatgcagaccatgtctcacttacttgctgccatttattctttatttttatatttttgagacagggtctcgctctcttgcccaggctggagtgcagtggttcagtcttggttcactgcaacctccacattccaggcttaagcgatcctcccactagagcctcctgagttgctgggactacaggcttgcgccaccatgctcagctaatttttaatttttttgtagagttgagttctcactatattgcccaggctggtcttgaactcctaggttcaagcaatcttcctgccttggcctcccaaagtgctgggattacaggcatgagccactgcgcccagccttgccatttattctttttataatttaacaaatatttatggagcaatttacattaattggccccttgagacacaaagaagagccttcaaggcatcatcaggaatattctagatacaataaaatgacatgtatataataaggtatattttaatgaaatcataatggaatataaaacaattggccagcaatgatcaaaatggcctaacttctcttccacttttaatttcaggttaaagtaatttatattttttggcataaggaacaaattagggtttttagtcttgttttggtgcttattgccgataagtcattttgtgtcaggtttgtgtttgttttggtctcatctctactaagctgatagctgttaaaactcctaggaaatgaaagaagaaagctacaagttaattattaaaactttaccaggtttcaaagagcagaaagaggcttgttaaaggctggagaatcttgtagtatatattgtcttaatttttctttgcttttaggaaaagaaacttggaggacaatatttacttaaagttgttaaggtcaatctacatcatttgggagccaatatccatcattaggaaaaatgggttgaatgtaatctaatgaaaattcttcatatttgccagagaaaagctacttaagtgtgaggacaaaacatattttctgaggcaagaagtaggtataggctggtttaataggggatttttttttttttttttttggaaaaaagtaatttttttttttttttaatggagactgggtttcttgctatgttgcccaggctggtctcaagcttttgggctcacgcaatcctcccgcctcagcctcccaaagtgctaagggattacagatgtgagccaccatggccagtctaatagggaattttcttattccaatagaaaggggtctttgaaattgttcacagagcttggcattgtgttccatgatagaggtgtcagatcaggaggccaggtttgtcccccaaaaggaaacacactgctgtaaacttctggttaggaggaagtttagaggaagctcacacagagttgggaagaacaaagacgaagctatagtcactggaagtaagactttagtgaccctgacttgtgagcattcagggagatttggaagctggttaagcctcaagagtgctgatgggagaaggtgaagagttgtatttaatgggtaccagccccttctaattctgatgtctctggttgatgtgtgatatttttgtttaaaagataagtactccttgacagcctggccacatttctcccaactgttatcgtttttgacacccaggcagctggtttcattatcagctgtactcttcctccttacatcttcctcccccctcctcttcttgcttcctaacattttctccactttctctttttcttttttctttatcttaagatggtctcaatgtcaggtttttcattcaactacaaaacacttaaaagtccagctcaggtgagaaacagcaaacttggtgttgagttgaagttgtggttgtctttttttttttttgagacagggtctcactatgtcacccaggctggagagcagtggtgtgatctcagctcaccgcaacctctgcctcccaggctcaagcgattctcctgcctcagcctcccaagtagctgggattacaggcacgtgccactactgcctggctaattattgtatttttagtagagatggggttttgccatgttggcaaggctggtcttgaactcctgacctcaaatgatccacctgcctctgcctcccaaagtgctggcattatgggtgtgagccaccgcgcctggcccgaaattgtggttttgtaagttaaataggatgtctccaattttgagattattactagggcatgcaaagtatggtttggtgtctgtaggggattggttccaggacctcactcacatgcataccaaaatcctgggatgatgcttaagtccctataaaatggtgtagtatttgcatttaacttatgtacatcgtcccatgtacttaaaatcacctctagattagttatatcaattataatccccctctttttcttctagacagggtctcgctttgtcatccagcctggagcgtagtggtgcaatcatggttcgctgcagctttgacttcctgggctcaagggatcctcccaccttagcctcctgagtagttgggactacaggagtgtggccatcacacatggctaattcttaaattttttgtagagacaatgtctcactatgtcgcccaggctggtctcaaatttctgggctgcctcagcctcccaaagtgctgggattacaggtgtgagcaactgcactgggtctataatacttaatacaatgtaattgctatgtaaataattgttctgtattgtttagggaataataccaagaaaaaaatggtgtatatgttcagtacaggcacaagcaaccgttttttcccccaaatctttttgatctgcagttgtttgaaaccacaaatgtggaacccagggttacagaggcctgactgtatctcagtggccattatgccagagagagagagagagactggttcatgttaagcgcattgtataatagcagctctgtttgtactttataaactgagtgtgtttgtgtggcttttggttgaagacattctaatattacccacttgagtagaggggattagagttttgaggcctttttctaaaatgaatacttaccacaggggcttttcactgtttaccatgaagtacacataatcagtcttcaacctgactttttttttctgtgtatcattttatatcaaattcattttaataagaggaaaacaggataaacttactccagtgtaaaaaataatacctcacttgagcccaggagtttgagaccagcctgagtaacatagcaagaccccacctttacaaaaaaaaaaaaaagccagctgtggtggtacgtgcctgtagtctcagctacttgggaacttgggaggctgaggtgggaggatcacttgagcctgggattgtgcaactgcactgtagcctgggaggctagaaatatgtaaataattgttctgtaagaccctgtctcaaaaaataaaataaaaaacaataccagactttataccttcaagaacaatttggaaattcacatgtctattctaagctgtttctttccccacacctcgaatgggagcagattgagttttagaactaattgggctgggcatggtagctcatacctgtaatcccagcactttggaaggctgaggtggatggatcctttgaccccaggagttcaagaccagcctgggcaacatggtgaaaccatgtctctacaacaaatacaaaaattggcagggcatggcacacgcctctagtcccagctacttgggaggctgaggcgggaggatcacttgagcccaggaggttgaagctacagtgagctgagaccacgccactgcactccagcctgggtgacagagcaagacactatctcaaaaaaaaaaaaaaaaaaaaagttggatggatatttttgatagactcagaaaatgctgcttcttcatgacctagaatggaaaaatagagggagagtaataatctcttattttaaaaaagtgattaataaccttcctcattaaaatacatagggttcagaaaataattagctctgtttgagctgctagaatatttcagaaagttttgttgactgtcagtcatccaaatggcaggagcccaccttcatgaagagcacctggtacaacaaggtgttgtgttaataatacagtaatggtttagtagaactgtcaagtactttggccttgaagtagaccattagggaaaagagaattttagaagaatctagaaaccttttcattttctttaggacaaatataatttttttaaaaaatgagaattctttgttattctctaataaacactttgggtgtcgctaagccttgatctgtgcacctagcagtttctcttttgtcactagcatgtctctggcactgaacagtgcctgaggaagaatgaactgaacagtgtcaagaggaagaggtggctttgccatgtagcttgaacgcattcttgctagcatttatttcatcagttacttccatgaagacacctttctggctgcttctatgaaagttttttcctatttaatgttgtctttgattttattgagatgaggaaggtgatgaaaaaaaaggaggaaagaattaagggactgtatttaaaaacattcctctctaaacctacaattaattttagggagaccttttcagctgtaagactagtgaaatggttttgagtacctttattctctataggggaattttatatgaaaacgaattatttcaaacccaaactatttatttatttatttatttgtttatgacagacagggtcttgctctgtagcccaggctggggtgccctgatcacggctcactgcagccacaacctcccaggctcaagcagtctgcccacctcagtctcccaagtagcacgcactaccacacccagctaatttttgtatattttttgtagggatggggttttgccctgttgcccaggctggcattgaactctgctcgccttggccttccaaaatgctaggattacaggcttgagccaccgcactcggcccaaacttttgttttaaccgtagattaaaaaaaaaaaagttgaagttgtatatattaatactcagtatttcaaactttcttaggggcagttttctgttttgtgttttttgttttttttttgagatggggtcttgcttggttgcccaggctggagtgcagtggcatgatctcggctcactgcaacctccacttcccaggttcaagcgtttctcctgcctcagcctcccaatagctgggattacaggcacccacaaccacgcccggctaatttttgtatttttagtagagacggggttttgtcatgttggccaggctggtctcgacctcctgacctcaagtgatccacccaccttggcttcccaaagtgctgggattacaggtgtgaaccaccccacccagccaggggcagtttttaaaacaggtttgggctatccaaattgttcttccagagttcttataaatgctaagagaatatacagaattactgttaattagatgttagaatttattatagctagtatgtgttttggggggtaacttaattttcatataatttcaaacttgcagaaaagttgtaagagtagtaccagggaatggacaattttcaagaaaatgacagtggtaagcagtgggtgccttgagggaacacggagaagccacttaagccaaattagggagtcaggaatgctttcctgagaggggatttttaatattttgcatttaggtggcactaagacaaactagtagtaagttaggctgaaggcaataaatacctgccaattagacagctgtagacttctgattatctattgcagaagctttatcagagagttcaactgaacatccctaaaatgtttgttgagaagctgagtgaatctatatgaccttgacattttttataaggcaaataatacatgtatctggtaaaacttctttttatgtgcaaaaggtatacagtgtatattcagtgagaggttttcccttcacatgacctcatttgggctctcctactccttccttctctcagggatggcctttattaccagtttttggtgtgtcctttggagattgtacgtgtacgtgtgtgttttctcttttttctttttgctacatacatgatagcatgctgctcaacaaattggtcttttgacttgacaacatgtaatattttagagattgtatcctatctatacatgatagatcgtcttatttatagtggttgcatggtattctgtccaatgaatgtgcacagtttattcaaccagtcctctactaatatcaaggttgtttacagtcttttcatactacaaacaatgctgtgggaaatatccttgtacatatttccttgatgagtactttttgctttttttttttaaagaatacatttttaggagtaaaattgctagatcaaagaatatgtagacttttgaaattttagacagaaaataaaattttgttagcatttttatcttgtaaaacagtcttacaacactttttttttgagacagggtcttgctttgtcacccaggctggaatgcagtggcctgatcaacactcactgcagccttgacctcccagactcaggtgatcctcccaccttagcctcccgggactacagacgcccaccaccacacccaactaattttttttttttttttttttttttgagacagagttttgctcttgtcacccaggctggagtgcagtggcgcgatctcggcttattgcaacctccgcctcccaggttcaagcaattctcctgcctcagcctccccagtagctgggattacaggtgttcaccaccacacccggctaactttttttttttttttgagatggagtctccccctgccacccaggctggagtgcaatggtgcgatctcaacccactgcaacctctgcctctcaggttccagtgaatctcctgcctcagcctcctgagtagctgggattacaggcatgcgccactacactggctaattttttgtatcttaagtaaagatggggtctcaccatgttggccaggctggtctcaagctctcgacctcacgatctgcccgcctcagcctcccaaagtgctgggattacaggcgtgagccactgcacctagctttaatttttgtattattagtagagatggggtttcaccatattggccaggctggtctcgaactcctgacctcaggtgatctacctgcctcagcctccgaaagtgctgggattacaggtgtgagccaccgtgtccggcctccacctagctaatttttgtatattttgtagagatggggtttctctatgttgcccaggctggtcttgaactcctgggcttaagcaatctgcctgccttggcctcccgaagtgttaggattacaggcatgagccactacagccagccagtcttacaacttttgttagagaatgggataaaataggctgggcatggtggctcacgcctgtaatcccagcactttgggaggctgaggtgggcagatcacaaggtcaggagatcgagaccatcctggccaacacggtgaaaccccgtctttactaaaaatacaaaaattagccgggcatggtggcatgcgcctgtaatcccagctactagggaggctgaggcaggagaatgggataaaatagtcatattacatttaaccatgagtgccattttttttctgtcaattgctgttcgataggaagaaacttaatgggtttaagagaaggtgacactttatggttaggggtaagctggaatatcaaagcaatgttaatcataattgtgatggttacttatcaaagtattgctgggttgattctagttgtttgtgtcctaactctggatcttttccttaatgtgacgaagtaactgaaacaacctggtgctacagccctggagagcaaaactgtcttaatattaacttactgcttccatatgggtcataaattttcatggagacttgaatgctgtgcataactggcctggccctttctattcctccctagttttttttttttttaactatttaattatttattttttataagatggagtcttgctctgttgcccaggctggagtgcagtggcgcaatctcagctcactgcaacctccacctcccaggtttaagcgattctcccgcctcagcctcctgagtagctgggattacaggcatgcaccatgatgcctggctaattttgtatttttagtagaggcagggtttctccatgttggtcaggcttgtcttgaactcccgacctcaggtgatccgcctgcctcagcctcccaaagtgctgggattacaggtgtgagccactgcgcccggcccctccctagttttattaatttttttttttttaatgagacggagtcttgctctgttgcccaggctggagtgcagtggtgcaatattggctcaccgcaacctccacctcccgggttcaagcgattctcccgctttagcgttccgagtagctgggattacaggcatgcgccaccacgctggctaacttttgtatttttagtagagatggggtttcaccatgttggccaggctggtctcgaactcctgacctcaggtgatctgcctgcctcagcctcccgaagtgatgagattacaggcgtgagccaccacgcctgacctcttttattttattttattttattttgagacagagttttactctgtcgcccaggctggagttcagtggcatgatctcggctcactgcaacctctacctcctgggttcaaacgattctcctgcttctgccaccctagtagttggaattacaggcacctaccaccacgcctggctaatgtttgtatttttagtagagacggggtttcacccatgttggccaggctggtattgaatttctgacctcaggtgatccgcccacttcagcctcccaaagtggtgggattagagacgtgagccaccgcctccggccccaagttttattctgtaggcactgtaatgaaacatgtagtttgttgactaaaagctttgttgaaaaggctggagactggaatctagaatttgttttctttcttgaaataattcattcttgagatttcagatagaagacgaaactttttgtatttgaacggctctgtatgtacttggtataggaatgaacttagaatatcactaataattatttaaaattttatcatgaaatatttctgtctaaaaatatttgcagactacagtcctgggaagatcacgctattaccttaattgtttgcttttaaaatataacttaaaagcctattttggtgcttgcttcggcagcacgtatactaaattggaacaatcaagagaagattagcatggcctctctgcacaaggatgacacgcaaatttgtgaagtgttccatattaaaagaaaaatttttgtccaggggcagtggctcatgcctgtaatcccagcactttgggaggccgtggtgggtggatcacctgaggtcaggagtttcagaccagcctggccaacatggcaaaaccccatctctactaaaaatagaaaaattagctgggtgtggtggcacgtgcctgtaatcccagctactcgggaggctgaggtaggagaatcgcttgaacccgggaggcggaggttgcagtgagccaagatcgcaccactacactccagcctgagtgacggagtgagactccatctcaaaaaaaaataaaaacttttaaggcctgttttgcctattctggataaaaatcttcctcagatgtagacgagacatttctgtgtcttctttttcttcttttttagacaaggcctcgctgtgtcacccaggctggagtgcagtggtgcgatcatggctcaccgcagccttgaccccagggctcaagcagttctcctagttcagtctcccaagtagctggcaccacagacatgcactaccacgcccaggtgattttccagtgccttaaacagtgcccagctgattttccagtgccttaatgatattaatcatcattacaaaagtgatttacagcctggccaacatgatgaaaccctgtctgtactgaaaaaaaaaaatacaaaaattagccgggctcggtggtgggcgcctgtaatcctagctacttcggaggctgaggcaggagaatcacttgaacctaggaagcagaggttgtagcgagctgagatcatgccattgcactccagcctaggtgacaagagtgaaactctgtctcaaaaaaaaaaaaaaaaaagcaatttaattcattcagctcattttgatcagggccacaattggaaacttgagttattatacttgcagtaatattctcagaactgattgacgcataaggaaggactgtttgcctcatatcaaatagcccaagactaattgatgtacttgagttttttgattcctcagtgtgccaagttcctcttttcctggaagagctatgcatagttccagatctgatttgtggtttccaatttattgtgggttaagacaatctgataacattagtttgttacaattatatgtaaaacaaaagtaaaaaggctttgccgggaacgtcggggctgtgctgtgattggaatccaagtgagtactgctactctgagtggtcaaatatttaaatcccatttaggtgaggtgctattgtcattgactgaaagaggggttgaatttagtcagtattattgggggctgttggctgatgtttagtcatctggtggcttaaaacctgacaggagacacatggctagttgtccgttgtaatataatacttggcattggtgactctagagaggaaggattatgttttccaaattagcaggtggtggtatatatgccccagaagacagatgaaacctaaaaagaaaagaaaagctcctttctggtctgaattctgtaattctataagtacagaatatgttggtagatagaaagattacccaaaacctgaaacagcaagtagaagattgttcatgtaggaacaacatataagggacaagggtggaaaaaagactagatttaagcagtaaaagatcattaagcgaggcttcatcacttcttcagtaggacagttattattgggattcaaagaggggcttatcaatgaatactatgttgtccttccccttctaaatttgaaatcaactgagaagtagataagaagattgaaacattttttttttaatagccttattggtaaggctcaatggagaatatgccatagatctgttcccaagtgagcttgctaaaatcctccctcccaattaaacttaacaggatgatggacatctggaacttccaccccacccctgactccacccgccccactgcgggttgcttagtacaggacctgtagacaaaggctggcatcccacacgctatgcttaatcctgctggtgcttcagctctcttggagagcttgggaggggctgggccacgggtgactagtttcttctagttgtcagagggttgaggaatgaggtctagaacattatggctgcagactttactttcttaggaagatttgaggctgccaaatagtggccttccactaccagtatgcttgtatggtgctttttcctaccctttctagaagattgaaccatgagcttaaattacatattttagaccaaagagaattacagatttctgtccttaaaaactcataaaataggctgggcgtggtggctcatgcctgtaatcccagcactttgggaagtggggtgggcggatcatgaggtcaggactttgagaccagcgtggccaacatggtcaaaccgtgtctctactaaaaatacaaaaattagccaggcatggtggcacacgcctgtaatctcagctattctggaggctgaggcaggggaatcgcttgaacccaggaggcagaggttgcagcgagctgagatcgtgccactgcactccagcctggacaacagagtgagactccgtctaaaaaaactaaaaaaaaaacaaaaaaaaacaactcataaaatagggggaaatgtgtctggctttagacacttgggataatttggaggcaaaggcagagaatggatacttgcctagcagcctctgtgtagatgcttattaaaaaagtatttgcctggccaggtgcgttggctcatgcctataatcccagcactatgggaggctgaggcgggcggatcacgaggtcagcagatcgagaccatcctggctaacacggtgaaaccctgtctctactaaaaatacaaaaaattggctgggcgtggtggcgggcacctgtaatcccagctactcgggaggctgaggcaggagaatcacttgaacccaggaggcagaggttgcagtgagctgagattgcaccactgcactccagcctgggcgacagagcaagactccgactcaaagactcaaaaaaaaaaaaaatggtatttgctgtctcactaaaatacctcctgttcaatttgtccaccaccccctgccatccgtgaagggtttcacagtgaaagccagaaagcctgctagacacattctaaaagagctgtaacacttcaatttggttttgaagtcttgccagcaaaatcttgactaagacttttctttttttgttaaatatctgtcagtcatattctgaaaactgtaattattttcaaggttacctaattcagtagaaaaattactcttttcatagtaaggattcagtcatacagagtaacaaactgctggttctgaacttgttagtttgttcttcctaattcttctccctcacttttctcctttccagaatcatattctaagaactcagccactcaggtatccaccatggtgctgggtcctgaacagaagatgtcagatggtaatttaccgctttgtgttattgtctaattttatttgtaattaggtttatgttggtaacagaaatttatcatatttttcctcttgtcatcatctgtcatcatctattctaacaactccattcaaaagtcaccatctggtgacttaggctgtaaatgaaaatggattttttttttttttttgaggtggagtctctgtcacccaggttggagtgcagtggcacaatctcggctcactgcaacctccgcctcatgggttcaagtgatgctcctgcttcagcctcccgagtagctgtgactaaaggcacacgccacaatgcccggctaatttttgtatttttagtagagacagggtttcgccatgttggccaggctgttcgcaaatgcctgacctcaagtgatccgcccgtctcagcctcccaaagtgctgggattacaagcatgagctaccgcgcccatcctgaaaacagaatgttttttttttgtttgtttgtttggttttttttttgaggcggagttttgctctagttgcccaggctagttagtgttcagtggcactgtgtcggctcactgcaacctccgcctccccggttcaatggattctcctgcctcagcatcacgagcacctgggattacaggcacctgccgccacgcccggctaatgtttttgtatttttagtagagatggggttttgctatgttggtcagggtggtcttgaactcctgacctcaggtggtccacccgtctcggcctcccaaaatgctgggattacaggcatgagccactgtgcccggccctgaaaacagatttttaaccagagacctgcttcgtatcttttttacaattctgagttgagccaagattagctgaaatttggtttctggcagtaatgcttgcaagggcaatgttattcccagacccaggataaaaacctctggagtgttttggctactcatgatgcttcctggtgtttcagatgtgtatggagcagtaaaatacagggcgagtaccttacgctctgtatttgattggagcttcttgagtgctttgactattccttcctaaatctgagcttctttggaatttctgttccttttctataaatttcttcattaatttaaagctgcttaattaagatgatatgagtcagctccctatggaaagaaagctcttatttgtttaaattagaggttgtaaggatttattgcaaacacagagattagagctttgtgattcaaaatagccatttgatggctgaagcaaactaggctctgtgtatttctggcagggtatcccttttctcccagaccttctgcttcccaatatttaagattgactgcaaaatgcagaactcagggaaacgctgatatcagtctgagatgagccctgccatcacgagggtgccagtaccccgtgaccggcggcactttactgcaagccttagtcagagtacaaagggttcctgcttggtggttttgctgcagcttcagagtttagcctgaactgtggcaggattttgtaacttgcacattttttgagaagtctgatggaggtataatgtccacggtcgattatttgagtaagtcctaccaaatataggaggtggggaggacatttcgctagacaggcctagttcttttcttttaaaagctaggattttaggttaccaggagctggtctgggaatatgatattttgagcccatatgtcagtgtttttagaggaaaatgaaatggctctaaaaattcccaagtaggagtagaagtgtggaagtaggaaaaccattgtgagttaaaactgatctagagaattgagtgactgggggagggggagggagataacttttttagtgtaggctaaattttttacttcctgaatttttaaccatgtgaatgtattacttattctaaaatgtacattaaaaataaactattcaaaataaattgagctagagtcaggttggtctcttgtgcatttagatattaaactatttaatttcagtatactaaggatgaattgttagtgtattttgttcattttttactaatttattttcaaatctgttaattcagacagtgtttctggagatcatggggagtctgccagtcttggtaacatcaaccctgcctatagtaatccctctctttcacagtcccctggggactcagaggagtacttcgccacttactttaatgagaagatctccattcctgaggaggaggttagtatcaggtccttggaggagaacactattgtctggggaaaacctgtgagtgaaagatctgctggatggctcaagttcagcagcctcaggtttaattttggctggcaatctctgaagactatatctatatatctatatatatatatacacacacacacacacacacacaccccatctatatctatctatctctgtctgtctgtctgtccgtctatctatctatctatctatctatctatctatctatctgtctatctaatcttttttacagacagggtcttgctctgtcatctaggctccagtgcagtggcacaaccatagcccactgtagccttgaattcctggggtcaagtgattctcccacttcagcctccccagtagctgggactatagatggcatgccaccatgccaggctcattatttttatttttatttttagagacagggtctcactatgttgcccaggctggtcttgaactcctggcctcaagctatccttcctcttgtttgttgatgaaaaagagtcaaactctggctgagcccaggctcacacctgtaatcccagcactttgggaggctaaggcaggaggatcacttgagcccaggagtttaagacccgcctggccaatatggcgaaaccctgtctctacaaaaaatacaaaaattagctgggcatggtggtatgcacctgtagtcccagctactcgggaggctgaggtggaaggatcacttgagcctaggaggcagaagttgcagtgagccaagatcatgctatggtactccactctgggtaacagaatgagacctcctctcaaaaacgaaaaccaaaacaaaacaggccaggcgcggtggctcacacctgtaatcccagcactttgggaggccgagatgggcagatcacctgaggttaggagttcaagaccagcttggttaacatggtgaaaccctgtctttactaaagatacaaaagttagctgggcgtagtggtgggtgcctgtaatcccagctactcgggagactgaggcaggagaatcacttgaacctaggaggcagaggctgcagtgagccaagatcgcgccactgcactccggcctgagtgacagagtgagactctgtctcaaaaccaaacaaacaaacaagagtcaaactctgtaaaatgtttaaagaggtttattctgagccaaatatgagtgaccaaggcccgtgacacagccccaggaagtcccgagaacatgtgcccaaggtggttgggttacagcttgattttatacgttttaggggtcagaagttacaggcagacatcagccaatatatttaagatgtacattggttccatcaggaaaggtgggacaacttgaagtggggagggggcacctttcaggtcaaaggtggatttaaagattttctgattggaaattgattgacactgggtgcagtggctcatgcatgtaatcccagcactttgggaggctgaggcgggtggatcgcttgagcccaggagttcgagaccaaccagcttgggcaatgtgacaagaccttgtctccaagtaaaaaaaataaaataaaattagttgggtgtggtggtgcacacctgtggtcccagctactttggaggctgaagtgggaggattgcttaagcccaggagttcaagaccagcctgggcaacatggcaaaaccctgtctctacaaaaataaaaataaataaaaaaagaaattggttgaaagagttattttctaaagacctggtctaaaatgaggggctgtggagtgtctaaaatgaggggttgtgaagaccaaggtttttattatgtaggtgaagcctctaggtaacaagcttcagagaaaatagatgtaaatgtcttttatcagacttaaaaaggtaccggactcctagttaattctctccgggatcaggaaaagacctgaaaagggaaggagattctatatattctaggttttgctcataagagacagctttgcagggtcatttcaaaatatacaaagaaatatatcttggagtaaaatactttgatttctttcagggcctgttatctgtcatgtgatgctatgctagagtcaggttggaatttagcatgttattgctacaaggaatctgttttgtcagttttaagatctctggtttttgtttgtttgtttgtttgtttgtttttgagacggagtttcactcttgtcgcccaggctagagtgcaatggtgcaatcctggctcaccgcaacctcctcctcccgcattcaagtgattctcctgcctcagcctcccgagtagctgggattacaggcatgtgccgttacgcccacctgtttttgtatttttagtagagacagggtttctctactaaagtgttggtcagactggtctcgaactcccaacctcaggtgatctgcccgccttggcctcccaaagtgctgggattacatgcaggaaccactgtgcctggccaagatctctgttttaatgctggtcatttgtgtctgaattccaaagggacgggagtataatgaggtttgtctgacccctccctcccatcatggcctgaactagtttttcaggttttctttggaatgcccttggtcaagaagaggatccgttcagttggttgggggagcttagaattttatttttgtttgctctcctcagtgtcccaagtagttggactataggcacacaccacacagcaccacacctggcttgtttcctttttaaaatggtggctcttgtcctttttgggaagtgtttgggcacagaggtactgatactgttattctggttttagaataagaggctgatggaacctgcaggtaagggaagagctttgacttggacagagaagtggccagcttcttaataaaaagtgggtaagatggaggtgaaacttggacacatgcaatatctgacattgtaaatccttttttcttgtgaggctggattttgttgcttcatatgtgataacagaccaattatatcagtagttcaatggtgatgttcagtttaatctcttttcctctcttgtacagtactcttgttttagctttcgtaaactctgggctttcaccggaccaggttttcttatgagcattgcctacctggatccaggaaatattgaatccgatttgcagtctggagcagtggctggatttaaggtgaacatctagtcctacccctgtccttttaagcacataatacactctcacatccttttctccaccctgcatgttggatagtagcctcaggggctacatgcagatacttcattggcagtggctcttatgtgtaaagtactttccatttggtcttatttttatccacatagtttccttgaacaaaggagaaactacatataggagaaactgaggctcagaaaggtacaaggtgacttagcaggtcatgtgcaaaatctgttatagaactcaagtcatttgattcttgacctgggctcttttctgaatgcagtatttaccactcatgttgccaaacaactaaacaaacaaacagacaaaaactcagttgttcaatgagtgttacaggagattttgttcttcttagttgctctggatccttctgttggccacccttgtggggctgctgctccagcggcttgcagctagactgggagtggttactgggctgcatcttgctgaagtatgtcaccgtcagtatcccaaggtgagcaatgtattgtcctgtttgtctctcacccatgccataggaatctgtgtgtctggcggtatgtgctggcctcattctatagtgagacagtcaaggacttgggggtcagtggccctgaagacagacggtaccaacggaaatactgtagctcctcctgctgccaggccatgttttccccctctttcaaaatctaacttgagactcgcatttcctagaaggttttcttagaaaaactgtgttaccattcactctggcttccagtatctagcaatgcccagcccaaggggaggaggatgctctctctaagcacttttattcatacctccatgttactccatcagtttgcattttatatatgttctttttttgtttgactttgccatcactttgaaaaagtaattttttttctttttagtacaaactatatgtggcaagatctttggatttgctaataattatttttcagtttcccctcccaccgggggctacactgtcctctgcagcttcttctggacattttgggcctttcttaccgttgcctaaggcaagaatgaacactatgtctggaagatatttttaacttagttttgtctcttgttttgtttcttttcctgggtgtgagcaaaaagtatccttatctgcttttcaaaaaaataaaaaaatcttgataatatccccatttactctgatgtgattattacacattttatgcctatatcaaaatatcccatatgccccataatatatacacctactatgtacccataaaatttttaaaaaacaaacaaaaccttggtaatttataatccttctagcttctttttctttctttcttcttattttttgagacggagtctcactctgtcacccatggtggagtgcagtgatgtgatcatggctcactgcagccttgacctcccaggctcaagcgattctcccatctcagcctcccaagtagctgggaccacaggcgagcacgaccacacccagctaattaaaattttttttttttttttttttgtggagatgaggtattgctatgttgtctaggctggtctcaaactcctgggctcaggcagtcctcccaccacagcttctcaaagtgctgggacgacaggcatgagccactgcaccaagcctagcttctctttcttcatacacgttaatagttattttgtaataataattatatatatatatatttgtttgtttgtttgttttgtttttttttttgagacagaatctcactctgttgcccaggctggagttcagagttcagtggtgtgatctcagctcactacagcctctgcttcttgcagtgaggcgattccagggattctcctgcctcagcctcctgactagcttggattacagccacgtgccaccatctggctaatttttgtatttttagtagagatgaggttttaccatgttggtcaggctggtcttgaactcctggccttaggtgatctgccagccttcgcctcccaaagtgctgggattacaggcatgagccaccgtgcccagcctgcttttttgtttgtttgtttgagacggagtttcactctttcacccaggctggagtgcagtggcgtgatctcagctcactgcaacctccgccttcagtttcaagtgattctcctgcctcagcctcccgagtagctgggattacaggtgcctgccaccatgcctggctaatttttgtatttttagtagagacggggtttcaccatgttggccaggctggtctcgaactcctgaccttgtgatctgcccacctcggccttccaaagtgctgggattacagacgtgagccactgcgcctggccttgttttggtatttttgagatggagtctcactctgttgcccagcctggagtacagtggcgtgatctcagctcaccacaacctccgcctcttgggttcaagctattctcctgcctcagcctcctgagtagctgggactacaggcgtgcatcaccacgcctggccaatttttgtatttttagtagagatgaggtttcactatgttggccagactggtctcaaactcctgacctcgtgatctgcccgccttggcctcccaaagtgctgggattacaggcgtgagctactgcgcctggctctgccctttttttttttttttgagaccaagtctcgctttgtcacccaggctcgggtacagtggtgtgatcttggcttactataacctcaacctcccaggttcaagcgattctcctgtctcagcttcccgagtagctgggattacaggtgcgcaccaccacacccagctaatttttgtatttttagtagagacagggtttcaccatgttggccaggctgatctcaaactccagacctcaagtgatccacttgccttagcctctcaaagtgctgggattacagatgtgagatactgtgcctggcctgtttttttgagataggatcttgctctattacccagactagagttcagtggcacaatcatggctcactatacccttgacctcccaggcgcaagcagccttcctacctctgtctcttgaatagttgggaccacaggtgtgcaccatgatacccagctatttttaaaattttttgtagagacagggttttgccatgttgccaaggctgggcttgaactcctgggctcaagtaatcctcccacctctgcctcccaaagttcagggattataggtgtgaactaccatgggtgacctgacaaattttttggatgctagctatctggaggtgtttttttctggcttcagtgagtcagcataactaaatctgattttcagctgtattgtttggccagataagtttctgactttgttatatgccacccagttccaaccatcttcccttgagtccttttgcatacgtgggcattattattacattaaaggtgactccaaccttttctgttgttgtggtggtggtttgttgagacagtcttgctcttgtttgttgcccactctggagtgcagtggcatgatcatagctcactgcagccttgaccactggggcttaggctgtcctcctgcctcagcctcccaagtagttgggactacaggtgtatgccatcatgcctggatacttttgtactttttttttttcctataatttttattttaggtttggagatggatacatgtgaaggttttttctttctttctttctttttttttttttttttgtgaaagcaagtttattaagaacgtaaaggaataaagaaaggctattccgtaggcagagcagtcacatgtgaaggtttgttacatagataaacacgtgtcatgggggtttgttgtacatattattacatcaccccgatattaagcccaatacacaatagttaacttttctgcttctctctctccttccaccctcccccatcaagtagaccccagtgtctgttgtttctgtctgtgtgttcataagttcttatcattttgctcccaatttttatactttttgtagagatggggttttgccatgttgcccaggctggtctcaaactcctgggcttaagggatctacgttggcatcccaaagtgctgagattacaggaatgagccactgtgcctggtccaccccaaccttttttttttttttttgagatggagtctcgctttgttgtccaggctggagtgcagtggcgcaatctcagctcactgcaaccttcgcctcccgggttcaagcaattctcctgcctcagccccctgagtagctgggattacaggcatgtgccaccatgcccagctaatttttgtatttttagtagagacggggtttcgccatgttggccaggctgatcttgaaccctgtcctcaggtgatccacctgcctcagcctcccaaagtgctgggattacaggtgtgagccaccgcgcccagcctgaccccaaccttttcatgtttgttttgtcttcccagctatggtcaggatagatatgttcttctgcaatcatttaatattctttcttgacccatatttggaccgtattagcatccttattctcctctaaactttttaggattgtttttaggaaattaagtggaagttagtaaatggcaattatattcttctcaagtagaaaggaaaaagaaaaaagtaagatcaattactgccttgaccttcgttcacaggttctgccacgtggtagcacacttttccttctccaggtgagagccacagtgcagtgatcggccaagtggaggcacgttctggtatttcttctctagtctggaggcttataaaggactgtttatggtttagtgccaaaatgtgaattccaaattgtggaggaattttttagaaatgattaatcagaaccgtgtctttctactgtttgatgtttaggtcccacgagtcatcctgtggctgatggtggagttggctatcatcggctcagacatgcaagaagtcattggctcagccattgctatcaatcttctgtctgtaggaaggtgaggggttttcctctagaaagtcatcagtgttttgctggatttccaagcagagataaaaacaaaaacccaattcatttttaattttgaagactcaactcaattgttatttcttctgtggaacctttctggaaacaatttcttctcccctggtagatgtagactctacatcttccgtttcccatggtgggttatgcttacctttattagaatgtgtggcgttttgtatcgcaattattgatttgtatgtcattttatcccgctagatactatctttttattttattttatttatttatttttttgagacagagtctttctccgtcacccaggctggagtgcagtggtatgatcttggctcactgcaacctccgcctcccaggttcaagcaattcttgtgcctcagtctcctgagtagctgggattacaggcacctgccaccatgtccagctaatttttgtgtttttagtagagacgggatttcaccatgttggccaggctggtctctaactcctgacctcaggtctaggaatgcccgcctcagcctcccaaagtgctggtattacaggcgtgagccactacacccagcccccactagatactatctatctaatcctataaaattctatctgtctaactccatgagggtaagacccaaacttttcagctttgtatcctaagagtgacatagtagactctcaaagtttaaatgaatgtaattaagttgatgctgttaccctactttacccaaggcctagttttctgccattgtccctcctccctcaagtcctagcttctccaagtgttctttatctggagagctgttgggaagagagtgtttttcaatgtttcctttctttccgtctctctgacttccatatctcatctctgacctagaattcctctgtggggtggcgttctcatcaccattgcagatacttttgtatttctcttcttggacaaatatggtaaggagagcgggaatgggagggtcaaaggagctgctctctgtcatgtggcagatggggaagtctaccttctctgagctcactgctgccttttttcctttaggcttgcggaagctagaagcattttttggctttctcatcactattatggccctcacatttggatatgaggcaagtggtacaggatattcattagcttcttaaaataagtttttgtggtttttttttttagccttttattataaaagacagtaataatgctagtatgattcacttatagtgggtgtatcaacaaaaagccaatttttccctgggccaattttaaaggaatatgatctatagcaaagattagcatgcagaaaggcctgcaggggctcccaggtttaaaatgactagatattttagggctttccagactagattctttggtcccaagttgaccatctgacaacagaacagccatggatagtgttaattaaggagggggttgcagggttattcttgggtgttaacttacaggagttctgcttttgttcatcctggtttatattaattgcagcttgaactttcccaatattaaaacagttaatgaattatatgaaatatactggatatttcctggtttgtgccccaacccagaaactccttagagtcactaatattatttgcagtactagcacctttctttgtacaattcttataaactgatttctgcttactggtctggctgaactttaaaaaatatatgtaatctatgggttgattatgcctcttggcctaaggcttccaagagaaatactgaaccggggaagagtatatatgagagtgtttaaggatgagtctctcattacacacgtactagtggcaaacagcaaatgatttttaaatgaacatgggtgaacagaagtatgctcagtatggataataaaaattgattctatattcttttttaatttttagatttttatttatttatttatttttgagccagagcgttgctctgtcatgtaggctagagtgcagtgggtgtgatcttggctcacttgcagcctccgcctcccaggttcaagtggttcttgtgcctcagcctcccaagtagctgggattattggcgtgtaccaccatgcctggctaactttttgtatttttagtagagatggggtttctctatgttggccaggctggtcttgaactgctgacctcaagtaatctgcccatcttggcctcccaaagtgctaggatttcagctgtgagccactgtgcctggccctggttgtatatttttgagccttgtggaattactaataaccacaagtcccttagcagctttttcttttttcttttctttttttttttttgagatggagtctccctctttcgcccaggctggagtgcagtggtgcgatctctgctcactgcaacttccacccccaggttcaagcgattctcctgcctcagcctcccacgtagctgggattacgggtgcccgccaccgtgcctggttaatttttgtatttttcgtagagacggggtttcactatgtttgccaggctggtcttgaactcctgacctcaggtgatccacccgccttgacctgctaaagtgctaggattacaggcgtgagccaccatgcctggccttttttttttttttttttttttttttgagacagagtctcacactattgcctatgctggagttcagtggcacgatctcagctcacctcctgggctcaagtgatccttccacctcagcctccctagtagctagtactataggtatgcaccaccacaccgaggtaatttttgtagagataaggttttgttgtgttgtcaggctgctcttgaactcctgggctcaagcaatgcgcctgccttggtctcctaaagtgctgggattataggcgtgagccaccgcacccagccctttctttagaaattaattatgtatcatacacatctgtttcatatatctaagatgtgttgtaaactatccggatactcagtcttgaattctctggcccctaatagtaagccccttatgttgcttggtcctatgatgattctgtattcctcattatcttaggtagttgcagaagaaaagattttggccaggtgtggtggcctgtaatcccagcactttgggtggctgaggtgggaagattgcttgttcttgggagattgaggtttcagtgagctgtgatcatgccactgcattccagcctgggtgacagagcaagatcctatctcaaaaaatataaaaataaggaagaaggcattgtaagggataaaggatgctaactgttccctggtactatgttactcccgtttcacgttcctgtaaaggctaatcattgttatgttggtatgtagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaaggtgagcaaggcccttatctccttcacctcctagacagttcatgggatcttttccttcaattgcaagggacacaaagttagtttacaattattaggaccatgaaggagcaaggtattttccaagcctggacatttataaactccatatacttagatgctgtttttatcaccaaattgaccagagattactaactgcataaagcaggtggggctaaagttctttttttttttttttttaaattgagatggagtctcactctattgcccaggctggagtgcagtggcgtgatctctactcactgcaaacctctccctcccgggttcaagtgattctcgtgcctcagcctcttgagtacctgggattataggcgtgcaccaccatgcctggctaatttttctatttttagtagagatgtggtttcaccatgttggccaggctggtctcgaactcctgagctcaagcaatccacccgccttggcctcccaaagtgctgggattacaggcgtgagctactgcacccagctgggactaaagttcttcataaaaggttggaagtgcatcaagtctcttgtgtttaaatttcaaaagctcgagtggccttatggaggtcaggagtaaaggagcccaaacaggcttttactgtcagtattatgtaatagtttgctgggagattttagaaacctttataaataggtatatgcacaccttaggactgaaatcaggtcgtttttataggtcagtggtccttccagccactgagagtaactgagagctcagtagtcatttagtctctgttccctatttggggaatgtacagttcaacgaaagggcatgaagttcttttttctccccccatatgaagttcttaattgctcagtgaactaggatgtaggtgagtgttggatctctcacttttcgtctggtcaacttttgtcccctaaatctctcagctgactccaaactcctgaaatgtcacaaggaaacttgttctaactggtcaaaaagtgactgctgttgttatctttctagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggtgagtaagccagggttatgggtggtagtgaatgtgagggtaaagtgaagactgcaatgggatggggaaggaaaatacctcatcctagtgttaatgttcaggagaaataatctctagcttctcgtctgccccccaaaatcactgtgcaccagtcagagtctacagtatggggctgaccaagcctggaccctctttctcagcttttgtttgggagtagtcaacaaacagaaaacagaaactgtgatgatgacagactttgtcttgtcattttgaattctgtatcaatcttgatttctgattacctatgtagtgttttttttgagacggagtcttgcactgtcatccaagctggagtgcagtggcacagtcttggctcactgcctccacctcctgggttcaagcgattctcctgcctcagcctcctgagtagctgggattacaggtgcctgccaccacacccagctaattttttgtaattttagtagagatggggtttcaccatgttggccaggctggtctcaaactcctgacctcaagtgatccacctgcctcggcctctcaaagtacagggattacaggcgtgagctcctgtgcctggcctgcctgtgtagttttgatcaccatttgtttcccgtctatggaacctctgactcctctgtctgctttgactgaggattctattctgggtgttctctcatgtctgaagccttcttcagagcctctcctcttgtcatcatttaaagtaccccagcgtttgtacattattaccatgcacactgtaactcagtaaagatttttgatgacctgtgggtgtagaaggattatagaggaagatcctagataacattgctgctagtctctgcccacatcacagcatatgtccagtgttttccctccagcctacctcttatagatgattgtgtatgatatgtaggagagctcttatttggtccttgcttctgaaacaaaagttgctgttgaattgctttgggttctaggttgaagtctgtacaaataccagcagtcctcatgctggcctctttcctaaagataactcgacactggctgtggacatctacaaaggggtaagcatgtttggatttgtgatctttgttcctgaatcagtatttttagcatagtatgtggtcttttttgtgacttcacttcagatatgagcatatctcctctggagtgtcatttatttcagagttccagacaccagacaagcattttggattaaatgggaaggaatagaggatcagttgaaaagatatataatacaggccgggtgcggtggttcacgcctgtaatcccagcactttgggaggctgaggcgggtggatcacttgagctcaggagttcaagaccagcctgaccaacatggtgaaaccctgtctctactaaaaacaaaaatacaaaaattagctggatgtggtggtgggcacctgtaatctcagctactcaggaggctgagacacgagaatcgcttgaacctggaaggcagaggttgcagtgagccgagattgggccactgcactccagcctgggcgacagaataagactctgtctttaaaaaaaaaaggaaaaaaaagatgcagtatacaccccagctttttttttttttttttttttttttggagacaaggtcttgctctgttgcccaggctggggtacagtggctcgatcatggctcactgcagcctccacctacctggtccaagtgattttcccatctcagtcttttgggtaatgggactgcaggcaagcaccaccatgcttggctattttttttttctttttgagatggagttttgttcttgttgcccaggctggagtgcactggcgtgatcttggctcactgcaatctctgccttccgggttcaagtgcttctcctgcctcagcctcccaagtagataggattacaggtgtgtaccaccacacctggctaattttgtatttttagtagagatgggggtctctccatgttggtcaggctggtctcgaactcctgacctcaggtgatccacccccccctcggcctcccaaagtgctgggattacaggtgtgagccaccatgcctggccttgtattttttttgtagagtcagggtatttgccatgttgcctaggcttgtctcaaactcctgggctcaagggattctccaaccctggcctcccaaagtgctgggattacaagcgtgagccaccctacccagccccaagaaagtgttcttagtaaagtgtttttactggagtctctcagttcttttatgctggttacattgtgatcctccaacagtagaatatatagtgtgtagcatttcaccaatttatttgatatttccctgtacttctattgccattttccagaatagtgtgtaaaggaatataatttggggaaagtggtgtagacctctttttttttttttttttttttaatatttaagatggaggtttaggagcttggagaagagaaaggactaggcagagaaacgaaggagcatccagtaaagtttagactgaaagcttctggaatgaggtccagacttgagcctagcttctggcacagtgcgcagcacagcacttggtgttggtggtgcatagcaaagaagggagaaatgccacagggaactgctgttttggatattgtctgagcagattattgccacaatcatatccttcctcttggcctctcacagggtgttgtgctgggatgttactttgggcctgctgcactctacatttgggcagtggggatcctggctgcaggacagagctccaccatgacaggaacctattctggccagtttgtcatggaggtacgtgctggtataggatagagggagataacacaacccttttgttacttcttcttcttcttcttttttttttttttttgagatggagtctcactcgtcgcccaagttggagtgtaatggcatgatctcggctcactgcaacctccacctcccgggttcaagtgattctcctgactcagcctcccgagtagctaggattacaggctctggccaccatactcggctaattttttgtatttttagtagagatggcgtttcaccatgttggccaggcaggtcttgaactcctgacctcaagtgatctacccgccttggcctctcaaagtgctgggattacaggcgtgagccactgcgcctggccccttttgtcacttcttaatcccattcttctgaggtctctcctgaacctccccaaaacttttttttgtttcctgttgcagacagtcatctgctcctatgttttcttccagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacaggtgaggaggaagctgaggaaacacatcctagttattcaggtagcattatgtactgcccttgggtaccaagcctagctgagtgctggggggatattgagaggaagacagaggcatggttgtggtctgcagtaaatgtatatgaaatccttggcatctaaaaggattttagaaatggttggttttttaaacctgttgaatgggaactatgaactttacttacatatgggacacaaaattgtagttcattaatgcaagcaaacattaaatgaacatataggacactgtgctaggtcctgtggaggttaagaagacaagtcacatacaaaggtttgtatgctaggttaatgacagctctgcagaattcagcataatgcccaagcatgttgggatgataggaataattatttctcatggagtagttgaggcagcatttatgtttccctttcattaattgtgctgttctctagggtgatacaaggacccatagtaatcccatctgatcttctttcttttccagcttccctttgctctcatacccatcctcacatttacgagcttgcggccagtaatgagtgactttgccaatggactgtgagtgtactcctcttcgttcccaaaggggatgctgatatggggaaagggtatcttcatgcagtaggccagtcagacgtgagacacagagggaagcgatatgctttgagaggtgattgctagctgcttcctctttggcttagagaatggaaactgtgaatatagtaaaggaagagaaagcacgtctttcatatgaaggggagagaaagttcagcttttacagcataactcttcagcttcagccactgaagtttgaggcaccttaattctttgttaaatgatcttaacaaaaaaggcataagttagtaccttttatatatatctttaaaggatatgaggtatctgaagtgacttgttgcatttttgggaacgttaataaaatggctcattgcgtttctaggccttgttgcatctctagggacttaaatattagggattatttgttggtgtcttttcccccctctttctccctgtctaccagtatctaactttgggtgatttaacttagacttatgaagaatcattttttttcaaattaagaacaatttttccattcattttgaactgcctctaattcccatcctgtttccttttctgtctgtggccaagttggattattccatcagtgactgtgctgatttcttttacagaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttggtaagtctagcctggaagagcaggggcataggtatcagggatggttgaggtggggttcactgacattcagaaatgaacagacccaggctgggcacagtggctcatgcctataatcccagtactttgggaggctgaggcgggaggattgcttgaatccaggagttagagaccaatctgggcaacatagtaagactccatctctacaaaaaaagagaaatgaacagacccaaaagagcacataacaatctacctccaggtgatcgagacaatgtatatggaattgtcaaatcagctgtttacaaaataatatttctaaccataaaattcactttggttactaagatttgtcatttttcaatttctgtcacttctgtagtttccattcttagtaattcctaacaagagagtatagtatgtttgaggaactaaaagaagggtagcagtacagagagtggagaacggtacaaaacagaggtggagaatagggcatgcagtgtgatttagagattcggggtgggacacatgtggcacacagccccactcagctccatcacttactagctgtccaaggaaataattaaatagtgatagtctccccttgactctctcattctagagtcattttttaaaaatcatggttataaaactatagctacatgaaaaaggtatgtaaaatttatatttcaattataaaaaattttttaagaagtctagaattatataaaaatggcaatatagttgttgtaggaagctaggattatagatatattcttctctattttccaaatcttctttagcattgcttatattaatgaaaaacagccaaaataacaacagatccatttccctgttctatacaggtttctttgaaaagacacaggggttagggataaggaatagtagaatttataccatttttgctgcagagaatggctacagatggaggctggaaacctgctgttaatctctagaacacttccccacaccagtgtgccacacattagatactttattaagaaaatcacttcagtaaatgttgaaaaattatttcctagatctcttctttttttcttcccaataaactttgtgcacacaaagactgtactgaccctatgatctaggaacttaacttcaaggaaaaccaagtaactgaatgtgtccttgacaggaattgtttttaaaaattcactatagaagttagggggatcctttcagaatgcaaattggatatgaagatgccagtttgtcctcagtcagcctaaggctaatgagcttgttgaagacccattattattattatttttgagacagagtttttctctatcgcccaagctagggtatagtggcatgatcttagctcactgcaacctctgcctcctgggttcaagtgattcgcctgccttagcctcctgagtagttgggactacagccatgtgctaaccatgcctggctaatttttgtatttttagtagagatggggttttgccatgttggccaggctggtctcaaactcttgacctcaggtgatccacctgcctcagcctcctgaagtgttgggattacaggcatgagccaccgtgtctggcttgaagacccattttgagaggagagggctgattctagagtgggttactgttgtttaacttcaaaacaggaacttcatagagcagcttaggagactacaccaattgtattagtctgttagtcattcttatcatggggaggactgaggaaaagtggacttccgagaacttacagttgggtaaaagaaacaaacaacaggctggacgaggtggctcacgcttgtaatttcagtgctttgggaggccgagccaggaggattgcttgaggttaggagtttcagaccagcttgagaaatatagcaagacaccttgtctctacaaaaaaaaataaattagctgggcatggtggtgtgcgtctgtaatcctggcaactcaggaggctgaggagagaggattgcttgagcccaggaattcgaggcttcagtgagctatgattgcaccactatactccagcctgagcaatagagggagaccttgtctctaaaatgtaaaataataataaagattttaaaaaaaaggaaaaccacagacacaaagcagtaagaacagagaaattcaatatttaaaatagtatggacaaactttgttgaggaaggcagctgattttttgaagggggagtggggttgagagaatgacttgtgcaacccttggtggtagaagatgggcacagctggatgttcaaggaagggagcaggtttgcatttgagaagtgctgtgtgagcagtcatggctcttcaaagagcctggtgagtgatgaccatattttgtctttcagggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaatttggtttcctgggtatttttttaaccttgaaataatttattaatagggttacaacaactttgatacaaaaaatactgaaacagcaactaccacctggaatggcacactaagtccacactgttaggattttctccttagaaaggatagagaaataaatggatttagtcctcagaaagcttggattaattgcagataccaggatattaatttccatttacccacttagtcaaatagttttaccatagctaaaggtcacatcattaccatgttgaaacttgggaaaaaaattttattctgcttttctctaagctgactattttctacctgtagcttatttcactgtttcacttttacattctatatgtgctgccaatgaaaaattagtatttgaagagaaaccaaactcatttagcttaaagaccaaggagcattttggcagacctgatataaatggaaatattgacaccatttattaaaaacaaaggcagagctcaggcacagtgaactttactaggcacatgacaggaaaacttgagtcagcacttgatttgtcccaggagtgtcaccagaacttcattttccctttctctgttgcaaggcttccctgtgagtaacacagtggaattcatctaggaagaattttgttctccatgttgtccttcctcatttagtgctctctctttactttggatttaatttcagaactaaaataggattcaaaacaatgtgaggatcctgttttgaaacatttcctttagctctgccctctggaataccttctgctccttcattggtaggaccaatgaatctaaatctgtcagcttctctaagtcccttagcttatgaatttaaaaatggctaactcagtactgtgttctaaggcctggcctgaacagttgtattatctcatttaatccttgtaacaacaagaggatcagcctctatgtagatgagtcaactggaaggccaaaagtaacttgcccacatttacattactaatgaaatgtgcagttggcatttgaactcgcatagcttaactccagaacccatgttttcattcccaaactatcctgtgtaatatatagtatacccttcatgttgggttgtcaccaagctttgttgtttagcagcacaaggaacataacacactgaagcatttgtttcatactctgattagtgctagaatatgcattaggcagaagttgccaactggtagattttggtccctgtgcagaatttttaaaagtaagtttgaatgcttttggcaagtgtagagaatggacagggccctctatggtcctatcccagcaatagccaagagttactagttaataagttcactcatttgcattagctctctgcccccggaagtattttagcctatttccaggccatttagtctcatttctcaatgtctcagaacaatataacaaacatctccaatgaaagtggtctatcaactaagtcatctaagtgacactctgtgggcatcacaggaccaatactgcaacccttgcttactacgtattgaagaagtctaccaccattgctcacttgggaaaggcttcaatgaattgtcaatatatttaattgctgttatttacttaagcctaaattaagcaagctgatgtctgaagagctgtttccatgtcctaaagccagtgtaatacagtgttttcctagcccactagttggaaatagttttatcctgggcatcatttggtctaatctgtcttcacacagtcatcactgcaagcctgtgaggttatacactgcagtttgtaatgtgttaaatatatgtgtcgaagactcacatgagatagtatattggtgtacttggcattttctttttttttttttctgagatggagtcgagctttgtcacccaggctggagtgcagtgctatgatctcggctcactgccacctctgcctcccaggttcaagcaattctcctgcctcagcctcccgagtagctgggattacaggtgcccaccaccatgcctggataattttttttttttaagatggagtctcactctgttgcccaggctggagtgcagtggtgcgatctcagctcactgcaaccttcccttcccaggttcaagcaattctcctgcctctgcctcccaagtaactgggactacaggcacacaccactaaggccagctaatttttgtatttttagagatggggattcaccatgttggccaggctggtctcaaacccctgacctcatgatccacccacctcagcctccctaagtgctgggattacaaacgtgagccactgcacctggctaatttttgtattttcagtaaagccagggttttaccatgttggtcaggctgctctcgaactcctgacctcaagtgatctgcctgcctcggcctctcaaagtgctgggattacaggtgtgagccactgtgcctggctgtacttggcattttcaaatgtagcatttattcacattttacaaatgagtagaataaggctccaaaagtatatgtgacatgctgaaggccatagaaagtggcagagttaagggcttgaacccaactccagtgcctttatattacactaaaatagggatagttgctaccaataaatttatagtctgcattctgcattaacttagaggctgttggtgccaaaggataacaataaaagctctgcgtaataataatagggctaaaatgagactcaaacttgtctcaaggtgtattcgagaagagaaaaagtaaaaagaaataacttcatagccagcctaggaaacatggcaaaaccctgtctacaaaaaaattagctgagtgtggtggcacacgcctatagtcctagctacttgggaggctgagatgggaggatggctgaagcccaggaggtagaggtggcagtgagccaagattgtgtcattggcactccagcgtgagtgacatagtgaggccttgtctctacaaaaaaaataacaacttcacaggtcccaacacaaaccatctagactcagttctttaggagtggagtctggaattgtgggtttttttttttttttttttgacggagtctcgctgtgttgcccaggccggagtgcagtggcatgatctcagctcactgcagcctctgcctcctggattcaagtgtttctcctgcctcagcctcgtgagtagctgggattacaggcatgcgccaccatgccccgctaatttttgtatttttagtcgaggggtttcgccatgttggtcaggctggtcttgaacttctgacctgaggtgatccatgcgcctcggcctcccacagtgctgggattacaggcatgagacaccgtgcccagtcggaattgttttttgtttgtttgctgttttgttttttgagacggagtctgactctgtcgccaggctggagtgcagtggtgcaatctcggctcactgcaatctctgcctcctgggttcaagtgattctcctgcctcagcctcccgattagctgggattacaggtgtgtgccaccacacccagctaattttttttgtatttttagtagagacggagtttcatcatgttggccaggatggtctcgatctcctgacctcatgatccgcccaccttggcctcccaaagtgctgggtttacaggcgtgagccaccgcacccagctgggaattgtgttttaaaagcagcttcggtgattctgatgcaggctgacaaacatttgggacccacaggtcatctttctccctcttggtacatgccatttcatgtttttgttttttaaatgaaaggcttttctctgctccagtgccaaaggataatagggctcaggattgaaaccattgggaatttgatttctaattcacacagtagtaaaatacaaaagcattctgcttgtttgttcttatcctgatttgaagcacccatccttaggcagagtgtgtcacaagaatagtcagagtgctaattttgctaaggacatttggtaccatctcagtccttaactatttcagctcctacctgttattttgcatatcagaagccattcatgtatgtatctgtaagccatttcttttctgaaataaaaatcaatatagcagtacagaaaaaaaggcctaaattgatgtgctaattataggtacttaaaagctgatttcaataaatacgtgaaaatcagtctaaccctcttccatctttttttccttagtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaacaatgctctttttcacaatgaactggtcaaattgactatcttgtaaagtgatactttactatgtcagtgaaatttcagtttgattttagtcaaccagattatatcctttgtatctactgatattaacacatcatattaacacatcatttcttaaaaaaacatttcttctgtttggcaatcataattaactctggttatcagcctattttgtaattattgtctttgtcgtcacttttcttgaattgttttctagtcattaaacagatatgaaggcattgccaaagagctttaatatccagtaacaagatccagaaaccacactttaaccagtgatcagttttccgtgctgcattgtaactcagctcattctggcattcaagttttaggcaaaaaaagaggaaacttctaacatttagcttgtaagtcctgacataagatagtgaagatatttatcttctttctaatatttgtatagtccgccaatgtattttcttcccactattcccattaacataccaaacactgtttctaggtccaaagtctatttctaggagtggccaatatttgtattgttgaatctcctagggaatgctaaatgtttcactttaaaatacctatttataccaagtagcatgagattagtactagagtgagatttggaatattagtccacatatcacaaactgcttgcctacatgtatagattttttttttcacccaccttcctaaccaggaatttgtttccttaaatttgttgttgttgttgttgttgtttgttgttatttttttgagaagagtcttgccctgtcgccaaggtgggaatgcattgacgtgatctcagttcactgtaacctctacctccccggtttaatcgattctcctccttcagcctcctgaatagctgggattacaggcaccacatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttgctctgttgcccaggctggagtgcagtggtgtgatctcagctcactgcaacttctgccacctgggcttaagccatcctcccacttcagcatcccaaatagctgggactgcaggcacacaccaccacacccagctaatttttgtattttttgtagagacgggatttcaccatgttgcccaggctggtgttgaactcatgagctcaagtaatctgctggccttggcctcccaaagtgctgagattataggcgtgagccactgcatccagctcactcctcatttctttctagccccaaaggtgttgagtcagcaaatcctgcagcctttgtgtgactttgagcatcactttcccctttcagcattaaatatatgacctctctgccttattttagaacttactacatttcaataaaactttttaaaaaatccagacattgcctatgttcgtttataatcggcccttaaagaggcagggatttttctaaaatgacactttaaaatttcctcatttctacttcagggcctcttgaaacttcagataatgagagcagccaaccctgcaactcaggctatagagtccttctgatcttaaaactgagactgaattcacatcagttttacgcttttacttgaaaaagagactcttaagtgtttttggtttctttatacaggacaacaa

SEQ ID NO: 36339 - DNA, 46825 bp, Homo sapiens; identical to SEQ ID NO: 36338

SEQ ID NO: 36340 - DNA, 49451 bp, Homo sapiens
gctgggctgggctcggcacggggcggggcggagggtggggagcggaaagcaggacgcacggctcccgcggcccgctggctgcccttcccgccagcgcaggtgtgggacgggcggcggactaggcacagagctgcgggagcaggcacagggagtgtggagcctggcggcgggacggcgggatccggtgggagccggagtcccgccgaggggggctggaggtggaggggcccggcgaggccgcgatgaagccgagcggcgaggaccaggcggcgctggcggccggcccctgggaggagtgcttccaggcggccgtgcagctggcgctgcgggcaggacaggtgagcgccacggctgggctcggaagtccgggcggagcagaagcgcgtgggccttgggagccgcctggagtggcggggtcctggcgcgcagccggcgggcgcccagggtccgcacccgagggcgcggggcgcggagcggtgaaaggagcctttgtgctggtgtcctggacacacctcccgcgcccttctccaactcccggagccctggcggcgagcccctctgctttggagttcagcggctaacgtgacctttgcgtttgagtgagtggtcagaatgtagaaatctctccaggggtagcgtacggggctgttgatttttaaggacctatgaacggattcagctcgcggtaggaagcccggggctaagccccagccgcgtggggatctggctgggctgccgtttgattgtcctggctgcagcatcctcaacccaaacttactctgacccacaccctgaaagtggctcagctccgcgacggccacggactcagagttcaggaggaacttgttacactgcccggaaggatgaaaaccgagccgcagagctaccgaaaaccagcgagcagagtttaaaatggagtgcagttcctctcttctctttttcatttttgtgattgttccttccactttcctcagtacctttagcagtgcctgacacaccgacggtagtggtaggcaagcgagtgttggttctcccaggactgtaagatggcttactccatgtttgtctcttaggatgtgattgtgggccgggcgcagtggctcacgcctgtaatcccagcactttgggaggccgaggcgggtggaccacttgaggtcaggagttcgagaccagcctgaccaacatggtgaaaccccgtctctactgaaaatacaaaattagctgggcatggtggcgcgtgccttagttccagctatttgggaggctgaggcaggagaatcacttgaacctgggaggcgaaggttgcagtgagctgagatcgcgccattgcacaccagcctgggcaacaagaacaaaactccgtctcaaaaaaaaaaaaaaaaagtgattgttttcggggattttagagacaggaggtgtgctgagagcagattggccttttatattcaaacatttgttttcttttttgaggtctgacagtccgaaaatgctctaccagtttccctagatgttgaaatcggactgttatcaatcttaaatttgaagtgagtcgtcataaagtggatagtgctttaccttggtgcaaatcctctaatcctgtttaaaaattaatctgcaatactaagtagactcattttttgttgaagggccttccttccctttgtagtttgaagaacccaagcctcagaccgtaaagaatgaatgaatttaagagtgttgcgaaactccaccctttgacctttccctcctgtaggaaaaggaggaccctaaaccttcctgcaaggcagatgaagcttgtagcttcagtgcaagcgttcttcctggaaagcagagctgctgtgtgcatggaacacgggttctccttccatccttccctgcctcccagctttccttccagagcaagcatcagccagatatttaggaacttttaggttctactgtaaaacttttcttccttgaggcagtgaaaagccagcttaggattcagacattgctgtgtaaaccctggcgagctaagttaggagtttctgtggttttcaaatttagatccttgaagaaacagaagattttaaaattttatgttattatttaacaaatgtgcataaagagcttgcaatagagcaggaacagttctaaggctcctatgacttttaacttaagagatattttatgtttttgcaacttgccagcaacaaaaaaagctttttttaaacgctggagagggttgcaataaagatgctgccattaggagtccggtcaggaagcccgggccgcccggggctccccctcaggcattatgctgatgcttcctgcctgccgggcagtgctgagggaatggcctgaaggtctgctgctgggacaaacagaagccacacgaggtcatcggaacctgtgtaaagagggacagattgtcttctaatgcaatcgggggctgactggagaaaacatatcctttagccagatgacctggttcggggtgtaaaggtcgtgagtggtgatccttttggagttctccttagtgaagagcatgttggcaaagtcgcagggcccccagatgctcacccttcactagcacccagcattctaccactctgttgttcgctgctctcagctgcccctgagatggagtctgtgttctagatgcggaaaggtgagggagccgaaggagagaccttccaagagataaaggtgcactgtcctttctctcttagactggttccgctcaaggtggccctggagaaactgcttccatttcccctctgccccagttctggcaggcttccctgtcccaggctcccaattccctcacctgccccctccatgcttctgtgccactcttccttccgtgaccgtggggatcatccctgccctcctagttccagccacccacactgtgacgggagcctcctccctggctgttgggcttttggggagggagtgaccacagccccaccccaagtacagatgacagtattcactgatgtggatggttgtcatcttttgtgtgatgtgtgaacagaagtattgtagacagctctgcctttcaaatccccccgcggagctgaaccagcttctgttgggccagaaacttagacaatttagggggccctctttaagaaaatacaaactttgccagatgtggtggctgaagcctgtaatcccagcactttgggaggctgaggcttgtggatcacctgaggtcgggaatttgagaccaatatagtgaaaccccatctctactaaaaatacaaaaactgtggccgggcgcggtggctcacgcctgtaatcccagcactttgggaggccgaggtgggcagatcacaaggtcaggagatcaagaccatcctggctaacacggtgaaacctcgtctctactaaaaaatacaaaaaattagccgggcgtggtggcgggcgcctgtagtcccagctactcaggaggctgaggcaggagaatggcgtgaacccgggaggcggagtttgcagtgagtagagatcgtgccactgcactccagcctgagcgacagagcaagactccgtctcaaaaaaaaaaaaaaaaaacaacaaaaatcagtcgagcgtggtggcacacgcctgtaatccctgctactaaggaggctgaggcaggagaatccctagaacctgggatgtggaggatgcagtggtgagcctaggttgcaccactgcactccagcctgggtgataagagcgaaactctgtctcaaaaaaaaaaaaaaaaaaaaaagagaaaatacaaaattacaaattcaaacttagatataaaagttatttagaataagaacaatcacatctataaatttctaaggtgctaagaaatactgcaaatatcacgaaatacacaaaaataacaattctttcactgcttctcatacttccgtaatactttttgccctttttctggtttcatactgtttgcatcttttgaatgataatgattttgtaatactttatatggggagaatagaaagataaattcagcatttcctgttgcttggcttattgaaatttattactgataatttagaaaatttaggcttcaaacttgttactggtaacaattggcttataaatttttaggatgtcatcaaattgagaaccttctatgaatttttttatacattagttgtaagtgagtctgtttttcacagacttgctcctggctctgtgcagttgaaatctggtttatttttgtgatccacacattttcagtgccagtgtctgtgtccacctcatgtgctcctctggtcctgtatgtttttgtcaccatgccaggtgggtcggcgtgatggacaggggagtatgcctggaagccctttctacactggatggctctcagtaacttacagagaaatgtgactgcaaaccctattgaagcaaagttagttcatctactcagcttatctttagcccacactggctgtatccacgccagtgccacctgatgcaaagtctgatggaaggacagtttaagtggaaaggcacaaggttagatctacagtcaaaacagctgacttttgcccattacaaaaggggtttgtgtacggctttgtgaacactttgttagggtcccttgcaggcaagtgggggccttgatgcttaagcgtcattagcttcacaggaaattcatctctgtttacttgtaacaaaatctcaggacaaagcagaaaaagaaaaacccagcactgacctcaggaccgcagacttcccccttctctagttggccttgcacacccttgcaggttatgcttcccgaggcccggccttgcgaagtgagcctgtcgtccccttgtccggccagatctggtcgctctgcttggtgtttgcaaaacacatgttgtattttcttgcctttcttctggcctatggagtatgcaaaccattgcctgtctccagagcccggctcctgagccccttccttcatggaccgcttctcaggtggccttccctgtctttccagtgccccacctggtcctgctgagctggcactcctcatgactttatttatccttgcctggtggtgtgccctccacacagtgggtccttggaatatgaatactcttttgtctacctctggctcttcagggcagaaggcacattggtgggctctggacccgtgtccccacttgtccatctggctttaccaacacagtattgttttgatttgtgattttcctttttgctggttattcacaccgggaatttaatgagtgacgtaacactgaaagcacatgatgaagaacagcagcacctggcccacactcctcaccccttgtcctgtgtccggagtccctgttctcaattttctgagagttacacccatttctaagtaatatgcttctgtcgtgctttcttgagttgttcattgttgacagaattattctgtgttacgccgtgtagtggccctgcccgtgtggttctgtgggtgtccatgtccatgttcggatggccatgcagatgtaactcatggttcagcccggcagtgtattcctttctttctaatgcaacttgtattttcgttaaagaatgttttgttttgttttgctttgcatttgtctagttttctgtatacctattgtgagccatccatcttcccagcaggatttttcatgatctccttggtgtggtcacactccttgggtcgctgctgtggagcagtgcttctccagctttggctgtgttggaagcccaagagggcttattaaggcaaatggggtcccaccgcagggtttctcattcactaggtctggagtgggcaccagaatacgcatttctaacattcccagctgacatagatgctgctagtctggagtggcacaatgggaacttccgctgcatggtattttattatgtgagtacatcactattcattcaactgttttatttattatttatttttattttttgagacgacgtctagctctctcgctcaggctggagtgcagtggcgtgatcttggctcatcaaaacctctgcctcccgagttcaagtgattctcctgcctcagcctcctgaacagctgggtctacaggcatgcgccaccatgcctggctaatttttgtatttttagtagagacggcgtttcaccatattggccaggctgatctagaactcctgacctcaagtggtccacccgccttggcctcccaaagtgctgggattacaggcacgagccactgcgcctggcctcattcaactcttgagcaaactggataatgtccagtttgaagttaatacgggtaacgttgctgtgaactttcttgcacatgtcttttgattatgtgtgcatttctgttggggatttattaatagtaggagtagaatcgctgtgtcattgggaatgtaaattctgccaagtagttctctaaagaggatgtaccaagttacactccaccctgcagtgtgtgagggttcccttttccccacgtcttccacaacatgtggtatggtctgtcttttatattgtagccattctgatgggcttgagttggtattttattgtagttttaatttgcgtttcttagataattaatgaagttaaatgcacatgtttattggcttttttttttttttttttttttgagacacagtcttgctctgtcgcccaggctggagtgcagtggtgcgatctcagctcactgcaacctccgcttcccgggctcaagcaattctcctgcctcagcctcccgagtagctgggattacaggcatgtgccaccacgcctggctaatttttgtatttttagtagagatggggtttcaccatgttggccaggccagtctcaaactcctgacctcatgtgatccacccaccttggcctcccaaagtgctgggattacaggcgtgagccactgtgcccagctgtttattggcttctttgatattatttgcttttaaaatgatggtaataacacattgattataaatttattcatccaacaaagaatcattaacaactcaggaaaggactttagcctttttactctgaatgtgaggggaggtttggggcagagtcttgtgtggggctttataggactctatataggggaccaccctggctgctgcatgaggtcctttgtgggacactagggagaccagaatcaggtatctgataggaagccacgtgagaaatgagggtggatttgactggggtgcatgaagaaggtggtgaagaagatttactttggaggctgagatgacagcctctgagttggatgtggggtgtgagagaaagagaggagccaagggtgacttcaggggtttaggcctgaaaagctggttgaatggatttgccactttccgagatggcaaaactgcaggaggaacaggtttggagctgagagtcgagtgttctcttctgtgcaggttaagctcgaattgccagtagatttcttattttatttttttgagacagggtatcgctttgtttccctggctggagtgcagtggtgcaatcacagcttctacctcctgggctcaagtgattctcccacctcagcctcctgagtagctgggactacaggcatgtgtcaccatgcctggataatatgtattttttaattttttgtacagacggggtttcactaagtggagatgttggatttgcacccaagctgacggcagagatgcagtgtggaagtcatattcctggagatggtatttagggccatgtcccggacaggaggagagcaggcttggccactgatgggctttgccgtcggatgagctcaggtcaggctcccattttcctccttgggagcctcacaaatgccagtttgtggaggtcatttctgaagtggttcatttctccagaaaaggcttccctgctcttcctgcctgggctgagcgcacctgtcgctggaggaagaggaggcaggagggggagaggaggcggtggtgatggcctccagctcctgcctcgcctggtccacacctgcagtgtttgcttagctctgcagggtggggtcagcctacgtgagaaattcgaaaactcaacaacatttcaaacatcagcagagacagaattcctgtgagacagcagctggcaggcacagagtagcagctgtccctttggtggggtgggggtcggtacatggtctccaagggtccgaggcccactgctcctgaccctatctgagaggtccctatcatttcctacccattttgctaacaaaagctgtctcagaagaagggggagggcagaaggcactgcccttgcctctgggcagcctcatcccagcccttggcactccagggtgccagtgaggtcccacctgtgcccccttaaggagaggctggtagatggctcatccccacggggagagtgagtcctggactctgtggccctgagcttgtcacttgctcaccccaatgaagcgctgcccaggggagattactgtctttggagtttggggcaggagggtgggtgaaatcactcagccagaggatggagaggctgctagtgagatacaggccccctcctcgagctttaggggtggaggaaggcaggagctcaaaggcatggggagctgagacattgagaaggagaggggagttccggagtctaggcccctccctctctcctggcctcctcctgggcccagtggagacaggagcctggagcctggtttgcgtcttctctcttctgtgggagtgagggaaggctttggtctctaggctgagccagtctcaggatcctgtgtccgttgtcccagctctgccctagcctgccatgagcgctgcaggaggccttctgcaggctggcgccctgcccctgggctcacctttcatgtgagagatggaggaggtgcagacctggccagtcactgcagtgtgcaggcggactgggaggccatcccagcacctgggatgtggacagcttcctggaagaagtcacagctgagtgtgtctttagaaaaaaagcaggagtcagctaggaaggttaggtgatgggcttggggaggggagagagaagaggaggggtcggggccaatagagaagatgaaagcagaaggggcaaaagagaacatagcaccaaggacctccaagaaatgcactttggctaaagtttgaggtgggagaggtcaggacttgggggccccgtgtggagggcagaattgcaggtgggtgtcctgctcgaactgatggggtgtggcccttgggggctgtgagttggggtggacttgatgagtcgtacattgaaggagacataggaataaaggacttctgggtttctggctcatgcagctggctggctctcattgcttttgagagaaatgtgagctggagagggattaggaagtaatcaattgtgacggctccagccgtggggtcggctctgtttagcgatggtggacttggactgtggtgctgggaaccccttccctataccttacagctgcagggccttgggcaactttctccatttctttttgcctccgtttcctcatctttaacgtggagaataatttttgctgtcctcagagttactgtgtggaataaatgtacatgtgaactgctcagaacagcacggggcagaagaagcgctctgtaagcttgagctcaggccgtggagctgggcagggtgtgaggtggaggccatctccaggaagctcagctgctgaaggcaggtccgagggcttgcaaacacccactttcaaggaatagtgggagggagatgagccgcagaatggtggggagataggaggaaagccacgaggggaggcaggggccacaggccacgggccctggaacacagggaatgcagctgggatgtgggtgacgggtggctgctggcattggtatggaaggtgccagtgccttgtcagggcggagggcgactagagatcaaggtgaggggaaaaatagccacgagactaaaggaggcgttgaggattcgagagcctgaggtgggctggcctgggagccacgtctgcttggaccagctcctcctcttcctcccagggttgaggttgtacagagatttgtgacgcatcaacagctgtgaactgctgaccacatgtgccacatgacaccatgtgataggcgtgttattacctgggtacccgatgaactgttaggttttattgattgtcacacgtatcaggttcttcagagaaacaggaccggcaggaggtgggtgggtccagtctgcagggtgggctggcagctggagacgcggagagacagctgatgttccagtttgaaggccatagggcaggaagagttgttcatgtggacagagtcccaaggccatttgcggagaaccccctcttacttgggggagggtcagccttttcattctgtttgggccctcagctgttggacaaggcctgcccacaggaaggagagggatctactttcctgattaagatgctgatgccctcgcagaaacacccagaacaatttttttttttttttgagatggagccttgctctgtctcccaggatggagtgcagtggcgtaatcttggctcaccgcaacctccacctcctgggctcacgcgtttctcctacctcagccccctgagtagctgggattataggcgtgtgccagcacacccacctaatttttgtatttttagtagagacagggtttccccatgttggccaggctggtctcgaactcctgacttcaggtgatctgcctgcctcggcctcccagtgctgggattacaggcatgagccaccacgcctagcccagaacaatgtctgaccaagtatctgcgctccacgtagctcagtcaagttgacacataaaattaaccatcacaacacattcacttgtgttgcagtaaatctggaagcataaacatggggcgtgtcgtcaggtgcacacctccagtggccacatcttcctgacctgacagagggaaagacacatctcctattgaaactgcactctggcaaggctccggcgtgctgctctgtggatgatgcacagggcctgggttccagagcacatgccagctgccctgcagtgactggcataaaggtcggatggggacaggagcacaagaacaagatggggtgagacaggaaagatagttggacgtctccatgaatatgttagcctaggatgtctctgaagctggttgatggtgacctttccttttagatttgaaattcaggcttcagtgacttcaggcccatattttatatgttatacattaacagaatgctactggaaggagagacccgagccaggggggtctgtgaagtgcatgcttagttagcgagtagctgaaaaacattaattaaaaaccaggatacctaactcattgctggtggagtgagagtgtttaaaatctctaagactgagggaaaatagccgtggtaaaggggttcagcgggaccttacctggcaaccccatgtgctccctcgccctgtggacgtgatcctggctaaagggcagggctgtttgagtctcgcttactgattttagaaatacagcacttttcctcactttttctcttagcataggacaattcgtgaattaaacttttcttaacctagtattttagcatcctatttgcaacgtgtacattgtatgtacggtaggttcttattttttgtaacaatacaaaaattagctgaaaaagtcattagattttctcagatacatgttctcacaactgatactggtgaggttctgtgtgtaaataagtttgtggaccaagaccttttcatacaatacctcatgtgattcctaaaacaacccaatgtgttagatacactgttattacagaagaggaaatgaaggccatgagaacccatatagaatttgaatttagagctgtctgattctggagtgtactttatccctctctactcccactgatgttatgaaactgctgaaaacaagaattacatcctggaagggaatttttcatacccatcttcatgaagagctacaggacaaggcttctgactttttttaggttagcttagtgtcattgtctgttggtgactgaaggaagctagctggcgcagcccccatgtgtgcaaggcccccgagtacacctgatagagccctatctggtgtatatgggtgcatgtcgctggcatcagcaccctgccggggtgagggtagttcctggagctactgggatgaaatgcagagctcccaacctggaggagtgcatggcccagtggaggagacagggcagtgaccaagtacagtggactgtgcagtagctgacccaggaagaggggcctcagccagggcagtgggcggacggccacacgggcgacctcctggagcagctgtgctggagtagatggaggctgagagcacagacaggcagaaggtggccagggatgtcattgcaggcacaagggatcgtgtccaaagacatggaggtacaggagggaggacactcgagggggcttgagcctggcatggggcatgctgccctggctgggtgtgaagggccttgcacacctgatgcaagacagcagcccgattgtgaggccaggtctagtggaagaggctggccacagggtcacctgccctgctggtaggaggtacaggcatgttcgagccccatggccttccttatgacacactcacaaagaaagtcatcagagaaactgcaataataaatattaataaaagcagaaaacagttaatattttaaaagattatgaaggctaggtgtagtggctcacgtcttaatcccagcactttgggaggccgaggcgggaggatcacttgaggcctggagtttgagaccagccttggcaatattgtgagacctcagctctacaaaataaaaataaaaatgatccgggtgtggtggtgcgtgcttgtagttgcagctactggggaggctgaggcgggaggattgcttgagttcaggaggtcaagactacagtgagccaagattgcgctactgcactccatctggggcaacagagagagaccctgtctcaagagaaaaataacaacagagcataacacaacacagcatcctgcctctgaatccactcttcccactctgtaacccatgactcggccctgttttcctggcggacacacccagattgcagcattctccaagctgccccaagggcccccagcacccgcctcctccacacacacagctgtgtatgttttgaatgtggaaaactgagtgtataaataccagtgagcttcgataaggtgacacaaaaggacatattacaaaatcttctagcatttagttaactgtgagctcagtgtgcagcagccaaggactctttatgcattcactcagcaggtgttcctggagacccccatgaggcagcccccatgcagggtgcaccatggcctgttggaggtggacagagacagagagggtagggttccttacccaggctggttgagcagacacatggagtgataagtgctgtgggtgccagttggtggcttgtgtaagtgctgtagtcacagttgggtgagtgcccctctgcccgcagaagctggaggctcctcatgtggaaggtgatgtttgaactgagtcatgaaggaggaggacagtgggctggctgaggcggttccatcaggagactccagggttaatgattccatgtgacagggccatggcattctcagagctcggaggggaggggaggggagctgagaaaggggtcgggaaaggcccgcagctgctgagtggatggtttgtttggtttcttcacagaggccagtaagaggagcaggggaagtctagttagtaagaggtatggggtggggtggtctgctccacaaagtcatccagggatccagctttgtcctccctcattgctccgaggtgtttcttcctgcatgggcagcaccacacctactttgtagcctgtggtgagggggaatgggacacgaggaagtgcaaggcagtatccttttgaggatgtgactcggaagttgcaggtcttgctttcagtcccatcctctggggcagaacttggtgctgaggccacacgtatccgcgtggtgtgcagattgcaaggcagctctgtgcttgctccaacttggaggttctgttcctaaaaggaagaaggggagactggacgtttggggtcaaatggtctctgctacaagggcaaatctggaagctattttatgctcccttcaggggttttgactttatccacatagtgacagggcgccaccaagtgctctgctggggagacgcatggtcaccgtgaccatgttttaggaagtgcgtctggctgtgccgggagagtgggtctgagtgcaggaagcagatctggtctagctccaggaggtgggacttgtggatggaagcactggatcttttcaacagggcaaccagaaaaacagccagacagaaggacctgggtggtcagcactcacacagacactagtgttcccgtttggaaaaatgttacagtctattcaagcagcccaatgtgtgttttattcattctttcaaagaactctgtgtacctgctgtatgtgtatctgctgaatgccagggagcattcctgatgctaggggtacagaagggaagcagaaagagctctgccctcagaagcctctgcctaggagagacaaacagtcaacaacaaaacagacaggaaggacgaagggaagtagaaagagctctgccctctgagctcctgcctgggagagacagtcaaaaacaaaaccgacaggaaggatggtttcagatgggatatggtaagttgtagaaggatcagaaaacaggaagtccttgggggcagaaacagatttggttaggatcagtgagaaaaccccagagcacagcaggagagcaacttggggctgacctgtcggaggtgagctgtgaagggctcgccctgggatttgggatttggagtttcccaagggccctggggtttgggatgtgttctgtgagcagcgggaagccgttggatcattttctgcagtacagtgatgtgatgtaattggtgtctgaaaattccccatccagctgctgcgtagaggctgcaagtgtggacgagtggaataccagccacccttgcaggtagctttatggctgctccccatgtggggatgccacaagcatgaagtaaagccactgtcttctcagatggtggtcctgggttcagaacccaccaccacctgcccaccccgcccgctgaggtggaacatcctggtctcctagtggctctcttcacgtgggagtttgagactctgctctagctccatgctactgaagtgagcacccctgcatcagggtcaccatagagcttaccagaaatgcagctctcagaccccagtcagacctgtgcagcacagtctgcccttccttgatgatcccagaggctctgctgccatatcctctctggggctgtgtcccctggttaggctgcctttctcaccccagctctatgcacacactccccacaaccccacaccacaccaacacacacacacacccagaaatccatacacacccagagatacacacagagacacacataccctgcatcttcccacaccacaccgatacacacacacccagagatagacatacagacacaccctgcatcctctcacaccacagcaacacacacacacacacagagatacacacagagacacacaccctgactccccccataccacatgaacacacacttacaggtacacaacagagacacacacacatcaggaatcaccgtggccatacatgagacaagctttgtgccgaaggcctgtctggccagctcagggttgagggtcctggaccatgggcagatgctacgggagccacatgtgaggagtgtgagattcacagacaaggcctgtggagcttgatttgttgagagtcctgtgtgcaaattggtgatttgagaaaattgacctggtggcaatgagcaggaactaggaaaccctggccagaggcagggcctgggcagtgggagctggaggctgtcataggaatatgaagtcctggagttatggctacccagtggacatggctatgtggacgctgtatgctttttttggtatgacctatcacattctgaattttctataacatatatctgttttttttgcaaccaagattaaaacaaaaactgccttggctcagtacagcgtgggccagctctgggatgtaggcagtgagaagagcaggcagccccgtatggggaggagcacatgggaggctgagtttcgggggctcctgcctgttctgtagaattccccgtgtgcttcttctggcagcacagggcctggcatgagcgggtccttggtgtgtgcttatcagaagacgtgatggatgtcacgtccgggcacctggccaattgatggtccttttgagagaaatacaggattctgggatgtagctagtttaggaagaaggctctgagttcgtttttaggtgccctgactttgtcatcatgatgagggagacaccaagttgttaagacagacagaaatgggcaagagctgggcgcggtggcttacgcctgttatcccagcacttttggaggcagcagtgggaggatcgcttgagcccaggagtttgagatctgcctggctagcatagcaagaccctgtctcttcaaaaaataaaaaatgagctgggtgcagtaccatgtgcctgtagtcctagctattggggaggctgaggtgggaggatcacttgagccctggggttagaggttactgtgagctgtgattgtgacaccacacttcggcctgggtgacagagagacccagtctgtaaaacaaaacaaagcaaaacaaaacaaaacaaaaaggagaagaaaggcctgggctggaccagaactggtccctctggagttgtccagggactgattagccactctttatcccttcctgtttgggttttcctggggttcttgggaccatcccagtccttgctcctatgtatagctgtgatgggtttagaccagtgtgttggcagcttgcacagctgcggagcctgtgtcggagctcagccctgtggatccttgcatgaactctgagacagctgatgctgctccagcccagagcgcagtgagagctggccatggttcctgaaacacagtttagctctcccgggtttctcagtgggaacatttacaatcagattcgagggcatatcccatttcatgggataaagtgaattagggaaaataagcttttactttacactgaaatctcctaaatttgaattcatgggattatacagggcacaggtgtgtaacatgatcttgttttgggccgttcttacagaggaagtttcatgctcttttcaaaacccctgtgtttttcttttactcgaagagaagttgtttcacaggtgcaacaaaataattttgaaataatttcaagtaatggagaaataatttttcttgtaaaagaataatggtggagtcattaaggctcactagaaacccagagagcctaggctgtgatattagctctgaggtcaatgatgcaagaagtcagtgacccacagagccacacctgctgcccccgccgccccccccccccccccccacccaatggcaggctgaatacagaggggactcgaaggagtggataattcctttgcctgggaggaggatgtttgcatgtttaacccaaatcccgtacttttatttcagatcatcagaaaagcccttactgaggaaaaacgtgtctcaacaaaaacatcagctgcagatcttgtgacagaaacagatcaccttgtggaagatttaattatttctgagttgcgagagaggtttccttcacacaggtaggtgtactcctctgggaaacacccccagtaaccctggccacactcatagagaatgcagggtctgccggggtcagggggctctgctgtttgttgatgtggccagacgtgaagccctaagccacgcagcctaacctgcgatttgtcagttacttagtaagcaaactcagccctgttttcattctttttactgtcatcttaacaaccatcacgtcaatgcatcctcttgtgaatattgaagcagctctttttacaacacatgctcaggaaaagctccttgcacccctgtactcaaccatttgttatttctggaaggacccactagaagtgtgacccaccctaagaagcctggagtggtgatgtcccctggtggcctatgcctgttcagctgcctgggcaactttcccaggaggatgggatgccaagtggcactggcagccgcgtggggcccccggcccaccactagtgcttagtgatgcacgccccctcgcccaggccagagggcgcagtgggaatggctgccacagccgggccccagagctgtccctgcaagaggcctgtatgagcacctcttaacctttttggggtcaccctttgagtatttgatgctagctattaatcttttgttcagaaaaattaaaatatttacacagcattttgcatagcattttaagggagccatgaaccccagattgagacatcttctttaactctggggggctctaaggcccctctctcacctctagagttctgcagtataaatgctgaagaccatgcaagggatcttttttcttcgttacatagaatcttttaaagatgttggattcttaaaactggaataccagttattggatttctggctgtagggtattataactgtcaggttccaggtttagatggacttaggtggcagaaatatagatggtactctccctcagtgtccattcagcacatggtaggcttaaaatacttttctttacatttatttttatatattttttaagagatagggtcttgctcagttgcccaggttggagtgcagtggcatgatcatagctcactgcagccttgaactcctgggttccagtgatcctcctgcttcagcctcctgagtagctgggattacaggagccactccacctggctcttttttttttttttttttttctgtgaatgattatataaatgaaagaacaagcgagtgttaaacacttaccttctttttttttcccgtcgtttccttctaacttgttaggttatctcaaggttaccagctctccctctgaatttctgtttgccagtcgctcatgtttgttttgttgacaacctttgagtttaagcttctctaacttcctatttccctactctgcttgaggtcaggatcccaagaattggttacagtagttatagggtgtaaagtgtttgtgattttttttttttttttttgagatggagtcttgctctggcgtccaggctggagtgcagtggcgtgatcttggctcactgcaagctccacctcccgggttcacgccattctcctgcctcagcctcctgagtagctgggactacaggtgcccgccaccacgcccagctaattttttgtatttttagtagagacggagtttcaccttgttagtcaggatggtctcgatctcctgacctcatgatccgcccgcctcggcctcccaaagtgctgggattacaggtgtgatccactacgcccggccccagtgtttgtgatttttaaaaagccttttaaaacctaattttagggtggctcacacctgtaatcccagcactttgggaggctgaggcgggcggatcacgagtgaggagttcaagaccagcctgaacaacatggtgaaacctcgtccctactaagaatgcaaacattagccgggtgtggtggcgtgggcctgtaattccagctactcgggaggctgaggcaggagaattgcttgaacctgggaggcggaggttgcagtgagccgaggtcacaccactgcactccagcctgtgtgacagagcaagactctgtctcgaaaaataaataaataaacctaattttaatcaaagggcaatagcaaaagaatttatcatatggattctttgagaggaagcatgctgcagtaacgagccggctgtttccaggtcctttattaaccatattggcctagaggtttctgcggtgatgatccgtgtggccgtggcatgggagggctggctcatctgcgtggggtctggtaaaggcttggaggagatgcaggatcaggcacagtgaagttattggggctgtgatgtgtttcagtcaggtcacttggacaaactgcactctgagattgcacgcaacccactgttgggttaatgtgtgcagttggttccatttgtaaaaggtaaatttagatactcgctgttgtgtacacaaggtaaaagttaatgtattatggggtgagcacaggtacctccctccacccttgaggccttagggttgccagggaccgccagactccagagttccttgggaaaaccatgatgcagagcaggggattataggtagggtgagacaggcttacctgggagcgtgcccgggctgaacaccagcctccatctctgaaaaggccccctggtagggtcagacccacacacctgtccaggaatcagtgattgaaatctggggttcccaagctctagcccacaagtcagtggactgtggctgcaccacggacagccccagtctgtgtgtcacccccatcttccctagctctgagggtgaatgtgtggacacggtgaaagcagctgttctcttctctgctcagtgtgcctcaaaaattgacatcaaatgcagttgtttttcaacatatttatgtgaagtgagttttttttgccaatgactaagattaaaaagaaagtaaattttggggatttaattgtattttagatcatagaaaagttgataaatttgtgatgagagaaaattgtatacatattgtaaaataggacattgtgatttttttctgctttctaagtatttaaatatatcccttaaacaatatatttaatttgaagttgcctctcatcctcctttaggaaagacttttattctgagcttttctctttccttgattttagtctttcatgaaatgatattaaaaatagacttaataacatttttttaaaaacctgatacaggctccccagttttattattttatttcactcatccatgaaatccaaaggtttgctccttgacctggaagacaggtgtagactgaatcaaagaatgataaggtttaaacttccttctggtggggtgcagtggctcatgtctgtaatactagcacttcaggagcccaaggtcagaggattgcttgagcccaggagtttgagaccagcctgggcaacatggtgaatccccatctctacaaaaaaattaaaaaatcagctgggcatgctggtgcacgcttatgctcccagctacttggaaggctgaggtgagaggctcgcttgagtcctggaggtcgagttgtgatgctgccactgcagtctagcctgggtgacagagcaagaccttgtctcaaaaaaaaaaaaaaaaaatgtagattaaaaggaacccttgcagactgttggtgagaatgtaaattgatgcagccgctatgaaaaaccccactgcactgcagcctgggcaacagagtgagaccctgcctcaaaacaaaaaaataaataggctgggcgcggtggtttacacctgtaatccctgcactttgggaggccgaggcgggtggatcacctgaggtcaggagttcgagaccagcctggccaacatggtgaaacccccatctctactaaaaatacaaaaaattagctgggcatggtagtgcgtgcctgtaatcccagctactcaggaggctgaggcaggagaatcgcttgaacctgggaggtggaggttacagtgagctgagatcacgccactgcactccagcctggggaacaagagcaaaactctgtctcaaaaaataaaaaataaataaataaaattgcttctgtcactggccctagcagctttggcaaatctcaccacttagggcctcgaactcctcacctgtgaatgagggacctgaccatggtcatccctgaagtcccagcatttaactcgtaacatgacaaaaagcaaaccagggctgggcacagaggctcacacctgtaatcccagcactttcagaggccgaggtgggtggatagcttgagatcaggagttcgagaccagcttggccaatatgatgaaaccccgtctctactaaaaataggaaaacaaattagctgggccatggtggcgcatgcctgtagtcccagctacttggaaggttgagacaggagaatcgcttgaacctgggaagtggaggttgcagtgagctgagattgcaccattgcactccagcctgggcatctcagtgagactccatcttaaaaaaaaaaaaaagaaaaggaaaaaaaaaaaaaaaggcagcatggtaaggccgggtttttatagattgggtctttggagtgtgctgttggccttggccacatagctgtctcctgccatgccctggctttgtggggcgcctaaacctgttttcagatgatgattttgagtgagatacaagtgtagctacttggaaaagattcagtagcatccctgagctatagtgatagaaaccccgtccttgtcccttctgtggagcagcctgttggagcttctctgggttggcctaggcccagagatgaggtcagcagctcaagggtctagtgtttttagctgtcttcccagccctgctccagagcccccatgtaacctgctgccctgcagtgcccagcacagagcagtgtctgttgaatgcgtgagtcaagcaaaacatcaaacagaatccttgacatgggaaaaacatgctcccagccaccaccagctgaacattgacatccagctgctttcccactgggcagtggcttgtgaagatggggacagagtatcataaatcatctcctttgtggacagcagggatgatcctgaccttcttgtcacagactaaacagactaagtagccagaagaaaaaaaaagaaagaaagaaaaaaggggcttaaaggcactcagctgtcaaaattataaggagggtttgttaaaactattttttaaaaaagaaaagtggttaagttatgcagtaggatataatattctataataacttattaccaaacttttagccttaatccagttgctattttcctcttgtctattggatagacgtatggaatgttctttttttccctaaatttagtcatgtgcattttttttcctatttatattgtgggttttttttttttttgagatggagtcttgctctgtagcccagactggagtgcagtggtgcaatctctgctcactgcaacctccgcctcccgggttcaagcgattctcctgccttccaagtatctgggattacaggcatgcaccactatgtctgggtaattttcatatttttagtagagacggggtttcaccatgttggccagtctggtcttgaactcctgacctcaagtgatccacccacctcagcctcccaaagtgctgggattacaggcgtgagccaccgtgccctgcctatattgtggattctatgtagatgttccagtggcttttaggaaggtctttatgatttcacacatctgtctacagtcatgtctgcagagcagactctccccactccctctgcagacagctgtaaaacattgtctttcatctcacaggtattagcttcctacatgagtaaaatcaggtttaagtgaataaaaattgtgcatctcttcccatgtaccagggaagtatttttggtgcctccaaagaccgagcacggttcacgcctctgctggccttcacaccgctgcagccacacagtgcagaagcctgctccctgctgcccacaagcatgaggcaggtgggaagggggatgctcgtgccaccttgtaggcgggcaggcagtctcatgggcagaggtgtacacaaggtgggtgatgaggaagacagctctagggtatgaatgatcagctgctgaaaaacatccagtgctcagtgtgggtacttagagttattctcataaaaaatgtgaggcagagttagtcaggtgtggtgatgcatgcctgtggtcccagctactcaggaggctgaggcaggaggattgcttgagcccagtggtttgtggcttcagtgagccatgattgtgccactgcactccagcctggctgacaaagcgagaccatgtctccaagaaaaaaaaaaaaaatttctaaaagtacttgctgggttacactaaatgaaacctaaaaaacaaatagataaataataaaggttacacacagcagaagctttgttaacaaattaacttatattaatagttgctgctgggaaaacaagctgcttggtgacttccctaaagggtgtcccacgcatctggcgaatgaacagacagagctcctgctcccgagtgtcctgggaggcacgtgggcatgccgcgtgggtggtctgggtgctgcagcgtgagttgtcctgggtgtggagtgtcagtgcctgcagacccacactgcctcctccttcagggctcactggcagttttctttccaccgcttcagtttcctacttgaagtcaggtttaaaaaggagaagaattgcacattcctcctcagtttcttagaaacttacctttgtgcctgagtcatttctagtccctctggacctgagtcatatctgttcgctgctttgtcaaccttgtgcccagtttaagctttcgtagttgctccttgtatgtgtgttttcagggtgtggagcgttttctttaaaaacgtcattgcaagccattacagaagaggaaagtcacatagctacagaagacatggaaaaacagatttagtgcctgaagtttctaggaaaactggcagtgctgacagcacttatgatcacgccctaagtggaatcatcacctgtgtgtctcctgcaggctgctgttgtcaggaggcagcctctccaccccctgccccggctgccattgtggcttctacccaccatttttcctcctagatctgtttggggagcaccagttcctgagcaggggctctggctggtgggcctgtgcatcacctgacctagaagcatgtggacaactgagagtggagaggcagttcctgcaaggagcaaggcgtgcagtgtagatgaagaaccagaagcctgggttcactgcatctcatctgccttgcctggctaggctgaaagctccaggggcagactgagcctgcccaggctctccaggaacagctgatgattccttgggtgtcttgcttagtgctcctggcttgacttgacctggtcttcttggctcagaagcccctgcttattcgtgggtttctccagggggccggggaggaggtcgcacagcctgagatgatgtatgcgtgcacttgtcgtatcccagggttgtatttctagataatttatcagcaaaatggaggggctggatgactctgcatcccaggcatgaacttcataacccagcagtggaaggatggtcccagagtggatggggaccagggtggttacagtgtgtatggcagctcccgtgcatagaaaagtgacatcgggccaggcgtggtggctcacgcctgcaatcccagcactttgggagcctgaggtgggcgtatcacgagatcaggagttcaagaccagcccggccagcatggtgaaaccccatctctactaaagataaaaaaaattagccaggcgtgtggcgcacgcctgtaatcccagctactcatgaggctgaggcaggagaattgcttgaacccgggaggcagaggttgcagtgagctgagatcgcgccattgcactccagcctgggcgacagggcgagactctgtctccaaaaaaaagtgacatcgaataccatgagatgcctgctgttgcctctcagcatctcggtgggaggacagcactgccagcggctctgtctgttgctgcaggggtggcccacatctgctgtgtccacagtggtagccgctcacccacgtgactgccaagcacttgaaaggtggctcatgagactgaagaactgaagtctttatttaattcaaatgtaagcagccatatgcggtgactggctactgtaaggcgctgagcggtcacagaggttttcatttcagtctttccattcacactcaagtctccagccttatccaaaagttcattgatgccaaatcttagaccacatggttcgtgcggggaaagtggcttccaggaggctgatgaccacagtggataatacaccaaacaccagaacatgggacgcttctttctttctttccttcttttctttcttttcttttctttctttctttctctttctttctttctttttctttcttctttctttctttctttctttctttctttctttctttctttctttctttcctttctttcctttctttcctttcttccctccttcccttctttatttctctctctctccttccttccttcccttccttctttcttttctttttcttttctttcttttcttttttttgagatggaatctcactcttgtcaccccggctggagtgcaatggcatgatctcggctcactgcatccctcccgtcctgggttcaagcgattctcctgcctcagactcccaagcagctgggattataggcgtgcgccaccacccccagctaatttttgtatttttatttctttttctttttttttctttttgagatggagtctcactctcccaggctggagtgcagcggtgtgatctcagctcactgcaacgttaggatcactgcaacctccggctcactgcaacctccacctcctgggttcaagcaattctcctctctcagtctctcaagtagctgggagtacaggcgcccaccaccacgcccagctaatttttgtatttttagtagagacagggtttcaccatgctggccaggctgatctcgaactcctgacctcaggtgatctgcccgccttggcctcccacagtgctgggattacaggcgtgagccaccgcgccttgcttgtttttcacttattttctttttcttactctctgcaggtctcctttttctctagtacacatgtgaacccggcacaggaactggatagaaaacctctcggcaaggccacatagtcatgcacagaacagatgtttgcttagcgcctgcccaaggcctcacccttagtgaacttgggacagtccaagagtgtcaaaagcactgccctgaatgctttagatctagtcttttctttgatcctgagaatgcctttggaaggtgtaaacagcggccagctccacagggaccagcctgcagaaggtgggctgcgaatacacctgaccacagcatcttccctgtgtgtgtgggcctgcgtgtgggtggggtgcaggaggaagggtgacagtgcatggggcgagagtgctttcccttgtttttggcctgagcagggggtgctgggagttgccattcgtggaggtagaggcaagtagagaaaaccaggagttcccttctgtgcaggtgaatcttgagagaacattgtctcggtcaggttcctagcaggacagacgcacactcaagtgaggattgtagggggccttgtttgcagagggactcattacaaaggaggggccagcccagggcctgctgcagagtgcaggagcaggccgcccatgtccctctagcaggaatgtgtcaagcaggccacatggaggagtggagcctgcacagggcacatggggcagggagcgtcccagcctctctccttcctgcagccccacccttgcttgctcccagagggaagctggatttgtgactggccaatgtagcaagaccccacctctacaaaaataaaaatactagctgaatgtggtggtatgcatctgtagtcccagctacttgggagaacaaagcaggaggattgcttggatccaggagtttgaggctgcatgagctatgatgataccactgcactccagctgggcaacagatcaagaccctatctcttaaaaaacaacaacaaaaaaaccagggaagtcagataccagggcaggaagggcacctttgggaaatgaaccagctgcgggggggctctgtttgtcacctgtgtctgcagttcaggtgagccaggctgggtacagacgtgggagatctcagctgcaagtgacatttaacccctcggtgcccaggtatcagcattgactgggagaatcaaagtcagagtcctgggccaccttgcttggtcatatctcatcagcctcctcccctacagactgaagttaaaatcgagtttagttttgcttcagaagatctgttttccagtgttcttcacgcttgcatttctctgcctggcctgctggaattccctggtgctctttctgaacgctggcactgaggtgtcactctgttttctaaatcctgctgagtaggtccgctggcaggcaggtcaaaaagcacatggttgtttaaagactctgcctctgtttgacccagagaaaccatgatgacatctgtttgctgtgccacctttttctttaatgggactggaagcaatttcaggcacgttattctgtgtccttggtgcattttctcaggctgggttcttccactgcaggttcattgcagaagaggccgcggcttctggggccaagtgtgtgctcacccacagcccgacgtggatcatcgaccccatcgacggcacctgcaattttgtgcacaggtgagctgagcagggatcgcctccattgcagggcttaacatgtcctcttctgtgaggttttgtcttttcaaaagcagcattttttaaggcaggaatatataaacaaacctatagtacactcatagtctcatcagaaagatgatcagatcttgatatttttaaaataaggttttccgtttgtgagaggctcttggagtatgttaggaaatctgcacttgtttaaaaaccagtttgttatgttaaaaatgttgggttgcatttaacaaggaccccttgaaggagtctgactcccctcacaccccacccccactggagaaaaaggtgaggttgggatacaaagcctgtgctgccccacagtggcccggagcccaaggtgtagagagtggcctgtgacaggtgagacttgagagccagcttcctgtatgagagcaaaccttgtggttacaaaaagcaggaggtttggggaggtcagaagggcccgtgtggggaggtgaagggaatggagcttcggggatggtgaagtgacaggatgcaaaggtgacagggacacgaccacaggtgttctctggcagtggcaggtgatggtgctgcgctgcctgtctacacgcacaggtggctgggggcctggggcacagagcatgatgtggcttaaacggagcgtggttctccagctctggagaaccctggagagattcccattccatgggcgggtggcttgcagctcctgcgctcacagtgcacgccagcacactaggctgcacgcgctaagcaggaagggtgagcagagcccgggtgtgggctcctttatgatctgcctctgatggcatgtttatatgtaaaacatgaagttattccatgctaagcacagcctttttctaggtgagttgcctcgagaattcagttgtgcctacataaggtgaccctttcgaggcagtggagtcgtgccatctggtgccagcaaatgtgtcaccaatctctcctctcatttcaactaaagcatgatccttcccagggctctcctccccagagtatgtcactgagtggagcctcattacttctgcctgctcgtggttccagggtgctcataatggtgacatggcaggtgaagccccgtcacatggtgaaggccacacgtccattcgagggtcttcagtggctccagagacatagtttccagtgctttcctgtctgcacccctggggggatcctggtactggggaggtgactgggaaaagagcagcaatttcagaacagtctccagagctgatcctgacagttcctgaaccccacgctatagctgtggtgattgttgtggtctgaagacatccgaaagccaccagcatctgccactcagatggcgcctgttcacccctgtgcccaccagtgctgggccacagcagtgggagaaagctctcctgggcactggaacaagcgtgaggcctggcacatggtgcatttgctctggaagccagcggctcatcccaaggtcccacacaccctggcagtcagagttgcatttgtgtacaattggttttgcatttttcctgtcagtttgcagtacccagcctttcctgcctgtttttaagctccagtgatctccctataaaggaaggattattttgaagatattgagcggcaatagcagaatcacaaaactgcaggcaaactgatcatgaaaactgtctgcagccgtggctgtccctgcagctggctactgggcactcaggcagggatgctagcagtgccacagggtgagctgtggctcagaactggcccccatggggaggctgtggtgccttctgggaccacctgcctggcgccccacctgggactgggtctggcctttggggagggctctgctgtccctttaggtctggagaaccagaaaacagatgattgagatccttcctaattgggcttcagagggttgttgagttacatcagtcttatgtgactttcacagtgctgttttctttcaaggttaactgtcttacgacatggtcagtttattctgtttgtcttggaagcagttagtgaaactgtgggaagtagtttttaaacaaccaacccacccagagtgtaggaaggtccttctgagcctgcggggagccgcacagcacacaggctcccgagagctgccgctcttgttccagagagtaaacctttctattttcctttgcagattcccgactgtggcggttagcattggatttgctgttcgacaagaggtgcgggtgtggcccaggtccccagggcccctccctgggctccctctggccatccttcctttctggcttcagcctctgtgcgcctggtttgctgtttgccctgtgccttaatcatgactggcaaatccaagcctgtgggtttcaaatccgagaaaataaacaagtccagactggctttggggtgtgcggggtggggctccgtggctggcccttgtcccccgtggagggctggcctcgtgtcaaccgtggtctatttgtgacactgctgtggaagcggaagtcttaagtgaacggtccaagtgcatctccagctgacccctagagcgtgtgatctcacaaactaaaaggagcacttagttttggagagcatcctcaatcccaatattctaataattctttcttatcttcctctggttattagcatgagaacatagctctttcatggttcccatagaccttctgaactacacagtgttgtgcgacctgcatggaaggcgtggggctgaggtttaaagcttattaaataattcaagcagcagcactgagaagagccttaatttctttctaattgaaacagttttatttaaatagggccgagggctgcatgtttctcaaaagcagccctgcttcagagcagcatttgtgcagcttcaccttagtctcagcacagactccctggcaggggagctgagagaagtacttaagttgaagtatttaaagttaagtactaaagtatctcaaagtacttaagctgaagataagtaagaattgtaatactgtaatttgtctaaggatgcaatgattgacgtctttctctgttaaataatattgtggtgcccagagtgggtgggaggctgagcagtacttcaggggttgattgatgttctgtgactgtgtgaaggggctgctggaacagctggctaggtccttggcccttctgtgggttggctagggtctgtcctatgttactacactgaatacgggagctcctggcttttcgtggtgggctcctccccatgggagtgggggacattcctctgcactctgggagctcttcacaggcctcaggaaccagccgaattctaggactgacctggtcatgaggattcctttaaagccagggtaccggaaggggaaggatgatgaaatgctgccagacacctgcaggctctgaaaaagcgttgactgaatgacgcctccaaccgccagaaataaaccctttctctgtagcttggggtgtccactctagggtgtttgtgctcaccccagggccagccaaggctttcctaaggcatttggccagggtgtttttttaattttccagagaggtgaacacttggctaacttgctaagcaagcatgctggcccttgttaaccctgagtggtgaaaagtcggtagaggaaagatcacagaggcacgcggccgtgggctgccgtccttttccacgctgacctcttccttttgctgcttcatcctgggaggctgtggtctgatgctttgttccctgatgtggggcagtcgggccactgttcagcgcactgcctgctcacggatcagtccccagtctgcggcggtgcctcttcctcgctggggctgtccttgggcttctgagattccgctggctttacagatgcattctccattcttcacacatcagcaattttgaggatttcttgtggggtttggttagagtcacaagtaacattctttttttcagcaacaaaaggggcctttctaaaaaattaagctttttcaataacttctggttactaatacttgattatgatgttaatttttaaagttttgtttgtctgaatatattttaaaattgtacttatttagcaaaagcaagcttgcttttatgtccaggtctcattttaaatgcaggcactgctttttctcagttccttttggaaaggtaatttctgtcacagtgtaatgtgttatcctaacgcctagcgcagccttcatctttgaataacaatgttttttcccacatcaaacgagtgaaccatctttgttttctgtcctgcctctgccgcccacagcttgaattcggagtgatttaccactgcacagaggagcggctgtacacgggccggcggggtcggggcgccttctgcaatggccagcggctccgggtctccggggagacaggtgggcttcacaacgctcgtctcagtttacttctgaaataaaagtgtgaaaggagaatgccaaagccaccatgatgtgggacggtggtggaggtcccttgctgatggtgtcatctctttttagggacatcgtgtccctgatgaactggaaatggagccagttctgtatgttagtgtttttgttcacgtggccaggagctttaaataacctcattctgctttgcgctcacatccctcatctttcaggctaaaagtactccagtcgcagtcacgatttggttgtagtgggattgggtgagcagcccgaggccaggtgcttgttcccctcagagcacccggcacacctcggtggtcccgattttgcccaggcactgctgcccaggtgcagtctgtggcccctgagtgtgcacaacagtaactggcttcagcttctgtgagaagagccatcctggggaatgagtcatgtgaagaggcaccttagcccctctgcagttatggcctgccgtgatttccttagcccagaatctcagggtcatccagtggctctgagagaggggttcccattccctgcatactgcctggaaccgcctgtcctgaatgggccagtttaggttttcactgattcttttcggcctttctcccacatggatgaatctggtgatattttaactgcattgtgagacaggtactgtagggaacagaagaatgccagacaaatgagagaagcctcagactagcagcagctgcatgggagattttacaagctccataatacctgcatgtctgggtttgaaaaggcggaagtgcactgctgcttgtttctgccttgtgtgtctctggcgtggacatcatgcagggccccccatctcattccctgccagttacactctttcttctgctctcccatcagcctccctgccgcctcccctcttgacccacttccagcctctcttaaaaattcctttcctggcaacctttcttcattgtctctatttattcctacttctttcctccctggctgatgcctgtgtgcccagatggccttcgaggcagcgagaggagctatggccatggcccatctctgctgctgtgagcccgtgcggccaggaaagtggcgggccaggatggatgaggtgtcaggagagggcccgccactgtgtgagggacacgaagggcaagattgtgcaaaggagaggaggtggctgcaggagagcccagagcaggggaagggagaagtcatgggggcctctgaggggcaaccagcagttggactcaccagttagagcttctgatcccagagaggccttggaatggcctctggccctgcctcaccttccctctccagaagtgttttgtttggcagtgaaaaaagtagctttaattacagctgtgcgtgccaggaggtgcccactccagcctcattgtgtaactggtggtgaggaagcatgctactaagcatgctcgggtgaactttgctctatatttcactggattataacactgaactctattaacatgctcttggcatcctggctgcccgcccgtgtagctcagtcaggctgcaactctgcgtcctcccagcctgcaggctgctagctcaagcaccaactccactagggcaagggctttgtccagggcccctttatgtggcccccagtaggcctggtaatttcgtagaatgaaggaaacatgaagtgctcatgttctgaaactcatttgtgactttagaaaaattctgatggataaaatgcatagcagatagctgctgctagtctgaggcttctctcatttgtctggtattcttctgttccctacagtacctgtctcacaatgctataaaatatcaccaaattcctccatatgggagaaaggccaaaaagaatcagtgaaaacctaaactggcccattcaggacaggcggttccacgtgttttctaccatggttgttttctttcctatgggtagatggacttcaggaggtgacagtgcatgctcttcagcagcacggtctcttggcaccatgcagacccaatttcagatcctgattctgccgcttttttttttttttttctgagatggagtcttgctctgtcacccaggctggagtgcagtggcacaatcttggctcactgcaacctccacctcctgggttcaagtgattcttctgcctcccaagcagctgggattacaggtgcgcaccaccacacctgactaattttgtatttttagtagagacggggtttcaccatgttggccaggctggtctcaaactcctgacctcaagtgatccacccgcctcggcctcccagagtgttgggcttacaggtgtgagccaccacacctggccgattctgccactttctaaggtgactagaactcgagcaagttccttaacctctctgaatctcagtcctcatattgaaaacggggatgctgatgataataaaaataaccgagaggattaaataagttacgcatataaagcacccagcatagtgcctggggcacagtatcctaaaatgagaaccattatcaaagaagaaacttgaatctttgcacaaaaccaatcaagtcatgccccgttgttaaaattaggacttgtttctggaggacacagtcattaaaacaagcaccactaatctctctctctttctccctctctctttctgcttcccttggcttcccctttcttatttctattatgccttgctggaatatcttcaactcacaagttaaaaaacagcactggatagaggtaaaggattagaagaaggcaagaattttattagctgcttcttcaaattctaccatgcaaatttcagacatacacaaagtacacagaaaaagcaaaatgatgccccatgacccctcacatggcagcacgcctgcttcgtgtgtgtccaccagctcccgccacccccagctgcctggagccaatcccaggcatcaggtcacttcctagtcagtacttcagcgtgtctccaaaaacagactgctctcttacaaatacaatcacatcatcaatatcactctctacccaaaatgcatccctaaaatcagcaaataatcccatcagtgttcaaatttccaattgtctcgtttttatggaaagtggcctcctaaggtcatagtctgcgttctggggggacttcctgttcctgggtcagtctttgttgccttttcactggactgtgctaggaagtacgtattttttatttgttttgttttgttttttgaaacaggatctcactctgtcacccaggctggagtgcggtggtgcagtcttggctcactgcagcctccacatcctaggttcaagcaattctcctgcctcatcctcctgagtagctgggactacaggcatgcgccaccacatctggctaatttttttgtattttttagtagagacggggtttcaccatgttggccaggctggtctcaaactgctgacctcaagtgagccttttgcctcggcctccgaaagtgctggggttacagttgtgagccactgcacctgaccatatttttaaaatatagagtcgataatgagttatactgggtttttttttttctgtttttttttttctgagatggagtttcactcttgttgcccaggctggagtgcaatggggcgatctcggctcactgcaacctccgcctccctggttcaagtgattttcctcctaagcctcccaagtagctgggattacaggcgcatgccaccatgcccagctaatttttgtatttttagtggagacagggttttgtcatgttggccaggctggtcttgaactcctgacctcaggtgatccacccgcccgggcctcccaaagtattgggattacaggcatgagccaccacacccggcctcaaccccatctcttaaaaaaataaaaagataacctttgctctcagtaacagttgacaagcttgttctatgggtcatgtcctctctctgtcacctgtccacctctggatggttgtgctgcatcctcattgggatagcacccagccactgtgtgccacgctctcacctcaaagccatcattcagtcatggttccacaggtgggtacagatttaacgccaccactgtcctgtgtgctgatgcttctccagtcattctggttgtgtgaagtacattctctagtatagcatttttaaagctttttgatcttaggacaaacccattcatactcctaaaaaaattactgaaggcctttaaaacatttattaattcattttaagattaaaaattcattacattttaacgtgaataatatatttttatgggaactaatcatattttccaaaataagaaagctttagtgaggagagtgggatagttttacattttttccaaatttctttatgtctggcttaatgtaagacaactagattctcatatctgcttctgcattcaatctgttataataagttgttttggtgtcttttattattattattattttttagagacagtcttgttctgttgaccacactggagtgcaatggtgtgatcgtagctcaatgcagccccaactccagggcccgaatgatcctcccacctcagcctcccaagtagctaggactacaggtgctcaccaccatgcccggataatttaaaaaatatttttgtagagacagggtctcgataggtttcccaggctggtctcgaattcctggcctcaagccatcctcccacctcagcgtctcaaagtgctggaattacaggtgtgagccaccaacccagcctgtttttgatgtcttaaaaaatgtctaacctcacatagatacgtagtttaaaaaaggagaagtgttttaaatctcttttcagataactgagggcatttttgtttgatatcaaaccaaaactcaaaaagtagcaattttttttgtttttgagatggagtctcactctgttgcccaggctggggtgcaatggtgtgatcctggctcactgcaacccctgcctcccaggttccagtgattctcccacctcagcttccggagtagctggaattataggcacgcaccccatgtccggctaatttttttttttttttttttgtatttttagtagagatcaggtttcaccgtgttggccaggctggtctcaaactcctgacctgaagtgatccacccacctcagcctcccaaagttctgtaattacaggtgtgagccaccgcgcctggccaagtagagatttcttaaaggttagttgcagtgtgaaatctagtggatttgttggtactcagttacattgaaatccattgggctatcttgtactttgaatggatcttttgttcattgttgattttataacatcatgtattggtcgtttgggaaatggtttcactgagattttcagcgcttctaagtgctgatgtagtttttaataaaatactaaaaatgtcatattaatatcaccactcctcaggagagctcttgaagtgttggaaagttgtcaggcttacagtgttagatacgatttttcaaaaaaataaaaaaatatatatatttttgagacagtcttgctctgttgcccagtccggagtgtagtggcacaatctcggtttactgcaaactccaccttccaggtttaagcaattctcctgcctcagtctcctgagtagctaggattacaggcatgcaccaccatgcccagctagtttttgtacttttagtaaagacaggatttcaccatgttggccaggcttgtctcaaactcctgacctcaggtgatccacacgcttcggcctcaagtgctgggattacaggtatgagccaccacactcggcctttatttattgattgattgattgattgattgattgattgaaatggagtttcgctcttgttgcccaggctggagtgcagtggtgagatttcagctcactgcaacctccacctcctgggtttaagtgattctcctgcttcagcctcccaagtagctggaattacaggcatgcaccaccatgtctggctaatttggtatttttagtagagatggtgtttctctatgttggtcaggctggtctcgaactcccgatctcaggtgatctgcccgcctcggcctcccaaagtgctgggattataggcatgagccactgtgactggcctctttttttaaattgtagaagagttttcttgaattacagtttttaatattttttttatttcccaattgtgttgctttgttttttgtcttctgggacttgaatgtatgttgggctttcactatcatttcctcttgtactctttttatcttttccaccaattatcttatttaaaaaagtttcctctttttcaccctcaatttcctgcaaagcataatctcttgtgtttattcattatgttccttttagtttgtcttcttttctgaaatatttcctttatgtaatttttcctaagttctgtgacctgtgatttggattatgctcttttttcctgatattctttattactcctattttgtggttagatttcttttttttggcaaaattcttttattggcatatacatgttactctgctcctcactctttttttcttaggataattgtgtgtgggattcaaccatagttctttttggttacctactgttacttgacattggattcctgggctttgggggcttggagggcgggggtgggggctccagacagcatttgtagtttcatggttctagagctccctcttcattgtttttgtgaagtattaaaatattggccttgttaggcgaggcacgatggctcacacctgtaatcccagcactttgggaggctgaggcaggaggttcacttgagagcagaagtttgagaccagcctgggccacatagcaagaccccaatctgtacaaaaaatttaaaaattagctgggtgtggtggtgcatgcctgtagttccagctactcagagggctgacatgggagttcaaggtaacagaagttcaaggtaacagaagctatgattgcaccactgcactctagcctgggaaacagagcaagaccctgtctcagaaaaaacctccaaaacaacacactgatgaaagtgtagtcacagaagttatatatccaacaaaaccagcttgtgccacaggcatgttttataggctttaaagcacaactgcctcttactctgtgagtacgtatttcttttttctttttcttttttttgagactccgtcacccagcctggagtgcagtggctgatctcggctcacggcaccctctgctcctgggctcaagtgattctccaaagccagccttccgactagctggaactacaggcacacaccaccatgcctggctaacttttgtatgtttggtagagatggggcttcgccatgctgcccaggctggtcttgaagtcctgacctcaaagcgatcggcgcacctcagccttgcaaagtgctgggattacaggcatgaaccaccacgcccagctcatgagtacgtatttcagtgtactcaaatgacttctctcattatttgagttgtaaagtttcccctaagacagcatactcttagcattgctcaaccagagcaagggtttccaaactgtcggaagtcactggctattcattttcatcctaaaatctgtttattgaaagaataaacagagatgtcctatttcaaaatgtatgagatatttttattgtagtaaaatgtatgtaaatatgattttccattctaattactcttcagcataccattcaatgacattaattatagtcacaatgttgtacaatcatcagcactatataatctccaaaatgtttgttcctacaaataagaactccacctattaagcaagaactccctgttccctgcttcccatgaaatcacagaatatttgaaattaaaaagatatacattaggccgggcccggtggctcacgcctgtaatcctagcactttgggaggccgaggtgggtggatcagttgaggtcaggagttcgagatcagcctggccaacatggagaaaccccgtctctattaaaaatacaaaaaaaattagccgcatgcctgtaatcccagctattcgggaggctgaggcaggagaattgcttgaacctgggaggcagaggttgcagtgagccaagatcgcaccactgcactccagcctgctgacagaatggggctccatctcaaaaagaatatatatatatatatatatatatatatttgtgtgtgtgtgtgcgtttaagacctaagatatggtaaatataggacaaagggtaataaaatacaaaaatcatagtaattgtggataactagtcagaaataatcataagataatattaagtaggggttgtcataagttttttcccccttatctggagcaaaatcaaacagtagaaagcattttgcttttaggtggcaacattcagacctcctttatactctgttcttttttttttttgagacagccagtctcagttgcccaggctagagtgcagtggcacgatcttggctcactgcaacctctgcctcccaggttcaagcaattcttgtgctttagcctctccagtagctgggattacaaatgtgtgccaccacgcctgcctaatttttttttttttttttttttttttgtacttttagtagtgacagggtttccctgtgttggccaggctggtctcgaactcctggcctcaaatgatctacctgctttggcctcctaaagtgctgggattacaggcatgagccactgcacccagcctatactctgttcttgatttcatgtgggaaaacgtatgttggcaagaatgagaaggaattaattcagggtggccagaagaagaaggtgctggattcagagcaagcttttcacaaacaggaaaactatggaagaaacccctgccttcacacaatcaccagacaagcttgggtgtaagtctggccccaccatgtaatggctccatggcctgagcagctcatgtcgcttctccaagcttgggtttctcatctgttgcacggggcagtggcacgtaggctgggaagtgctcgcacaggcctgtcaggaagagtgaggacctggtcactgtcagcaagtgaaaaattgctgtttcttgcacacaaattaacttccctttgtgaaataccccagggcacttggttggaagatctctgtgcttcctacaccagccctggcatggggagtacctgcctgtctaggctggcactggcggactttcctccacccacccgccctgtgctcatctctgccctcaggtgtggggagactgggtgaggcctttaagagtaggtgcttatctcccaatggaaattgattgctcagcttcctagttcctggggagaaatcttcagtgtcttccttcatctcttcccagggtcattaacactggtgccagcaagtgccctgtgtgttaggatttcactgtcctgattttactgctcagagaaaatcactcttagagtgtacctccagggtgagcctgcctgttagggacttggaaatagtacaggatccctcatagcccagtagggttgagggggcgtatgtataattgattcagctttcccagagggcaatttggaaaattatatcaaaacctaaaatatgcacaccgtttgattcagaaatcccacttgtgttcatctatctcgaaaaaaatcagtatgactgtataaacctctatagaaaagatgtttatgaagcattgtttacaataaaaatgaaaattgttcatcttcaggggaatggtgacataaattgcagttattgcaccagatggaatagagtgcggctgttaagagtaagatactgatggcaaaagatgtatatgagatgtttttatattgaaagagtgagcaacagaataagctataaaatcatttttaaaaagcactgtgtgagatgggttgatcacctgagatcagcagtttgagaccagcctgaccaatatggtgaaactctgtctctactaaaaatacaaaaattagctgggcatggtggtgcgcacctgtaatccccgctacttgggaggctgagacaagagaactgcgtgaacctgggaggcagaggttgcagtgagctgagatcgcaccattgcactgcaggctgagtgacagagcaagactccatctcaaaaaaacacaaaagcattgtatgcacttgtatgacttgaagttgttagatgagtacattagaaatagggtgggattagacaagatgtcactgccacttcactttcttgtcccccatggcctcctctgggacaattcattcttccttgattttcctggccaaagtatcatgcaagccatcccatttttttcttttctccttcccttctttccttttcctcccttgcttttctccccctccctcctccctccctgcccttcctccctctttctttcactttgttttttagagtaacggttttaggttcacagcaaaattgagcagaaggtgcagagagacagagttcctatacacctcctgtccccacacacgtacagcctccccatccatcagcatcgcgtacagaatggtgcatttgttaaaatgagacacattattatcacccaaggttcatagttttcattaggcttcactgttggtgttgtaaggcatccaccattacagtatcatatagaatattttcgctgccctaaaaaccccccatgctccgcctattcttccctcccctgagcctctggcaaccactgatctttttactgtctccatagttttgccttttccagaatgtcatggagttggaatcatacggtgtgtagcttttgagattggcttctttcacccagcaatatgcatttaaggttcatccgtatcttgtcatgctttctcatttcctttaagtgctggataatattccactgtctggatgtaccacagtttatttattcacctactaaaggacatcttggttgcttctaagtgttggcagttatgaataaatctgctcttaacactggtgtgaaagttttatgtgaaaacaagttttcaactccttgggtgaacaccaaggggcacgattgctggacggtatggtaagagtatgtttagatttgtaggaaactgccaagctatcctccaaagcagatgcaccattttgcatttccaccagccatgcatgcgagttcctgttgctccacatcctggctggcacttgttgtagttagtgttgtttctccattctaacagatgtgtagaggtgtctcgttattgttgttttgagacggaggctcactctgtcacccaggctaaagtgcagtggtgtgatcttggctaaccgcaacgtctgtctcccaggttcaagcgattctcctgcctcagcctcttgagtagctgggattacaggcacgtgctgccatacccggctaatttttgtatttttaatagagacggggtttcaccatgttggccaggctggtctcaaactcctgatcctcccgcctcagcctcccaaagtgctgggattacaggcgtaagccatgctcctggctttgtctcgttgttaatctgcatttccctgaggacatatgatgtggagcatctttctatatgcttatttgccatctgtatctcttcttgtgagtccaatttctattttttaattttaatttaacacgcattccccagattaccatattattatatttcaaaagagcatttttttttttttttttgagatggagttttgctcttcttgcccaggctggaatgcaatggtgtgatcttggctcactgcaacctccgcctcccgggttcaagcgattctcctgcctcagcctcctgctagcttggattacaggcatgcaccaccatgcctggctaattttgcatttttaatagagatggggtttctccatgttggtcaggctggtcttgaactcccagcctcaggtgatctgcccgcctcagcctcccaaaatgttgggattacaggcgtgagccatcgcgcccgaccaaaagagcatttctaactaaaatattcgtaattcagaattagtttacccccaaaatcagtattgtatatagtatttagattcttagattagccaacaaaattctgcctcaaacatttctcccataaattaaaatactagtaatttaatgaaccaaatcaaaacaaagactccaatcctaccttcttgagcgctggcatttgagggaaagcactcattcattcagtaactgtttatcgagtgcccactcagcctgggtctgctgatgtctctttctttaatggaagccttccccacccccaccccggaaaaaataccatctgtttgtggccaggtgagggtggggtttggagggtaaggaatggaagggttgctggagcctgtctgcagatcctgtgtggattagggagcacctggaacagccgccttttgtcccagctgtgggtggcagctgcagggctcaggtggtatctgtggagggcctgctgccagtcccagggcaggagtgccctcatagctcagcttcagtgctgggcatggccggcggtgaatgatctggacctcctgagggcaggcaggttgctttggtgtggagccaggtgttttgcagaaagtgctttaaggtgtaaaatgagagtttccatggaagaaaagggacacttggacctggattctggctgagagatttcctgggtgagcggagaatttgaaagtggtgacacagaactgggtccattgagtgcagtaatgtgataggatttgtttcccccgactttgggagtggctttattttgtcatggagcacacctggtttggcactgtcctgcccgggcagtgaggcctgacgggacatgaccgaagtttggctgtgtttgggtgtgtggcacaacaaggacaaactgctctgatccccagcagtgagtcagggacaggagcagaatcccggtcacgtcctgccctgagccaggcttgccagccctggcagcctcgcctgctgttacataaacggcaggccatgaattccaggtgtcggcacccccctgcatccagagggctcactcctgcagcttccctttccaaagcagcattatttaaaagttgctttctccaagaaaatggtatttctatcgttgcgattgcagcagttagacgattaatgaagcattttttccctccaaacattgagtgttcccagtttggagtcattttgcttttctttttggttgaatgatggtgatttttttttttttttttttttttaaagaaacagggacttgctctgtcctccaggctggaatgtggtggcgcaatcatggctgacagcagccttgaacccctgggctcaaccaatcctcccacctcagcctcctgagtagctgcaactacaggcctgtgccaccatgcccagctacttttaattttttttttttttgcagagatggagtctcaccatcttgcccaggctggtctggaactcatggcctcaggtgatccttgttccctagcctcccaaagtgctggcattacaggcacgatccactgtgcccggtccatccttagttttcaacatagatatcaaaaaagcattcagcatgaaccagtcgaaagatgatccttactctgagaaagaaaggctcacgttggaagcctgtactccttagttagaaccaagacttgatttttctggtgacaggaaattctttttattgcagatctctcaaaggccttggttctgacagaaattggccccaaacgtgaccctgcgaccctgaagctgttcctgagtaacatggagcggctgctgcatgccaaggcgcatgggtaggaggttcagttcggggaacaccctgcagcccgaggaggaagaacggaacacggacttgctaaaactcccctgggatttgaggaggaagcctgacgtggaaagagtgggaggggcacatgaacatcagactcagggaagccctgtgaggggcccgcctgcagtagatactcctatagccaggcctctggagatgcgtgggcacctgtgttgcttctgatcagaatccatggaactgacctcatgctgctcaaccagcgaatggtgcaaatacttacagtccttcccgagggggcctggcgtcagacaggtttatcaaagcccagtgaatcctctttgtctcttgccttcccagtagggctgtgctgtgagccctagccatgtgagaccactgacacttaatgtcacgttcagtagaggaggattcaattctctggttgctgcatctcaggtgctcagtagctaggtcagctgggagctgtcatggcacaaggcatttgcgtctggcggaggcctgttggttggtggctccaggccctatattcagcctccagagctttggcagaagtgctgtgcttcatttttcactagggaaaatgcccagccggggtacctggctgaagtcggcttgcacaccacagaaaaggctccactcccgcctgcatctgtcctcccttccctctccccagggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtgagctctcctgtccctgaaatgcagcggcagaaactagactgagagacactgtgggtggggcacttcctgaagtccccaccaactgaatttcccaccttccccagagtttctgtttttttttttttttttttttttttgagacggggtcttggtgtcacacaggatggagtgcagtggtacaatctcggctcactgcaaccatcctactcacgggttcaagcaattctcctgcctcagcctcctgagtagctgtgattacaggtgcgtgctaccatgcctggctaattttttgtatttttattagagacggggtttcatggtgtcagccaggatgctcttgatctcctgacctcgtgatccgcctgcctcggtctcccaaagtgctggaattacaggcatgagccactatgcccgaccccattccacattttttcttttttttttgacacggagtttcactcgtcacccaggctggagtgcaatggcatgatctcggctcactgcaacctccgccttccaggttcaagcaattctcctgccttggcctcccgaatagctgggactaaaggcactcaccaccatgcccagctaattttgtatttttagtagagatggggttttgccatgttggtcaggctggtctcgaactcctgacctcaggtgatccactcgcctcggcctcccaaagtgctgggattacaggcctgagccaccatgcccggcctccattccatattttaaagcccccatcactctgattttaccactagagcacctgaaggctcacgtatgtgcaagcaggtctccagcccatgcatccagagctgtttcatatccctcaggaagatgcaaggctttatcatcttgcccgagcttcttcgagtgtgggtcccgcagcagcggtgcacccccaggagcttgtgggcaggtagcctcagccccacccagacctgttgaggcagagccttggtttcacaagcccctggctgacccctgtgcacagtcaagcttgagaagggcagctcccctgttcgggtctagcccattgcttgcatttcttaggacttttatgttctccatctcttaaggcagtggcagcttcagagccgcactctgttctgtgcagcccttgactgcattcacactggggtggggcgggagaggctccatccctctattctttgccgaattcactcctagaccacctgtttaatacgagtgttggggcttgggcacggttccatgtgccatttcctgtgctgtgtgcatgtgggataagttgttacacaacattgttcagccctctctggtaacccggatgcctggctctctctgtctgtccccaggtggacccctcgacctcatggcttgcagagtggttgcggccagcacccgggagatggcgatgctcatagctcaggccttacagacgattaactatgggcgggatgatgagaagtgactgcggctgaggcaaagctgctcccaaggcctccctgggctgctgtgggctcctggggaggtggccctcgtggcccacgctccatgccagtggctcacgctctgctcctggctaccccagagggagttgtcacgctacagtgagtggctggccttttaaatcgacgtctctctcaccaggatttggtgtttagctgtttctctctttaatctcacgtagcctttttcaggttagtacgtgttcttctgtcagggccaaaactcaaatctcctgtgaaatacgtattgataatccaatcttgatttttccccccagaatataaatctcaggtaataaggctttagaactgctgataaagcggatcgttctcaggccctccccccggagtacttcagaatgcaataaatcaaaataatggcc

SEQ ID NO: 36341 - DNA, 69210 bp, Homo sapiens
ttctccccgccccccagttgttgtcgaagtctgggggttgggactggaccccctgattgcgtaagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaaggtaagggaaaagaaaaaatgattttttgtttataagggaagtccctgatcagactctgggactggagaaagcgaagtaacttcaaactttgggcgacaagaaaaaaaaaaaggagctggattccagttgtgtgtccagagagtaatttttttttttcggaataaacttcacttggggacgggtgggagataaccatagagttagaaagtctaggtattttttttaaacacacattttccagacctatttttaaaaacaatgtttttctaacaaccctatggcctcccaaagaaattgtttaggcttacatttttgaggtttcttttgggagtgggggtggtgttcgtgaatactgggccgaacaccaaggaactgggggtggaggcagaggtgtttgccctcttcttggcagtgggtcctggaaggcgacaggttttaaatgagtgttttcattcctcgcctgcggtttggcgggacagcgctgcagcccatggtgtggagcgcggctgggggaccagggggaggtggggagaggggagcgtggaggggagcgtggaggggggcgcgcgaaggggttgcggggcgcaggaggcgggctgggctcggctggagaccggacctcggtgttggcctacagcacagggagccggccgaatgcgcgtgattactggacggcgctgctctgggagagagtcggggccagatttggcgcggcggtgaggcggctgcgggacaagcagaggcgcgcgggcgtgggcaagggtttggggcgctctggagcggtttgttgggtcagtgaggtgccagggagagcgggtgcctgccgggcagtgtgctcgggttgcacgccctagcgcgggggcgacagcggcggcgcgggcgggcggtctggaataatgacaaacacatttggccctgagtgaagaagtcgtcgtcgcctcgcattccagcaactgggatttgaggaatttcgaaccgcacaccaaggggccctcattgtgctccgtggcccccgcccccgcctgtcttcccgcgccccctcctcggtggaatcatttctgcattgcccgggggctctgctttcgctcagttctggccgcaggcaggaagagaggaaaggtctccaggaaggtgccgaacttcttgtgaggaagttagggacgacttggaactggggaaacttgtttgcaggtaagacagaaaggtgggaggtaaaccatattctccctccgggcacccgagccctggacaccccctacccggcacccttctccgcgcgggggtgcgtggcacttgccgtctgagctcgcccagcgctgctcggtcctctctagttggccttttttccattcctctccctgccggcttcagagccgtctgtgcgtacttctccttcctctgctgtctacccccatggaaaccagatttacacacgaaattaactccgcccggctgcgcccagggagcgggcggcgtccatttggcattgaatatgtgggatcagctgttctattccgggagggtgtcggccaggtcggagcgacgagtgtggcccaacccgagtacgttgccagagggagccaggagcctgggccgggccaggtgtgcgagagctgccgatggcctggcctcgcgtcttggtcgggaaggacttgctggcctggcaggctgtgcgttgtgcatccctcccgcagccagagcgccggtcccgcacttcgctccccgaattgtgctaagacctcaggatgtgcgcaaggagtgcctggaagaacttgccactcactccatcttcctgggtgggaggcaagcatggatggggcccatatcaggtccctaccgccccgcgtccgaaaagccgcgggctgggcggtgtgggaaatggctttttggctccgaggccaaattgctcaatgttttggaccgactcgcctcgccgcggtcgctcctgacaagaactagacagatttttggagcagggagcatccagggcaaacgcacgacagtcctccgcagtgcatctcaccggacaaacatccccggagccacaggaggggaggaaggggctctccgggcgtgcgcacctccccagccgccgcgctgtcccatccccgacccctaatctggtcaacctggaccccggcactgctgaattgcatcccctcttctccctttctcctcggcctcctcctttccacaaccctcaagatgaggaggccctgcctcgactccccgacaggcgcaaggccgaccaggctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggccgggctttccagctgcaaacacgtctggcgccgaggcgggcccattttgtgcctcctggggacggaccgtgggcggcgcgcagcggcgggacgcgttttggggacgtggtggccagcgccttcctgcagaccccacagggaagtactccctttgacctccggggagctgcgaccaggttatacgttgctggtggaaaagtgacaattctaggaaaagagctaaaagccggatcggtgaccgaaaggtgtgggtctcagggttccccgggtctaactcgccgggtccaaccgcagcatcagccttggggcggcagataatctttcggtctcgcctggggcgcaagatgcaggatcgggggcaaatggcttctcccaacttccccctaattcgggttctgccagatggttgtcgtttgctgaagtggctcggcggcatttccttttgttttaaactgatcaatgagcgaacctgggatgggctgaaaaagtagattgtaggagggaataatgggaaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtgtgacaagagtctcgctctgtcgcccaggctgaagtgcagtggtgcgatctcggctcactgcaacctctgcctcccaggttcaagcgattctcctgcctcagcctcccgagtaactgggattacaggtgcccgccaccacgccaggctaatttttgtatttttagtagagacggggtttcaccatattggccatgctggtctcgaactcctgacctcaggtgatccgcccacctcggcctcccaaagtgctgggatttacaggcgtaagccaccgcgcccggccaggaacggttcttaaatgccgagagggcgcatgctagctctcctcagcattcccggtgagccgctacccacggccgtgcggctctcgtgcccataggaggcgctggcgagctcctgtaaccctaaacccctcggcccctttccccccacccgcccggattctcttcccgctctcccccctctctccacacccgcccggccccctctcgggtctcagttgaaaacaatgcaaacgcagagcgtcgtgcctggggcgcagcggcctctgcagctctgaggttcagagcgcggcgcgcaggggcgcaggggcgcaggtccccggagcggctgggcatcgccgccaaccccgggacaaccaagccgccgaggacttggtggaggtgggagggagagcggaccgcgcagtgttcctctgggtcccggggtcagaagccggacagtggcgggggctggacagtccgagcgcagagcctcccgggcgaagtctgcgcgcagcactcccggctgcgctgtcggggaccaggagcctgggctgcgggcgagctagctggcgagccgggtaagattcgcggggctgtcgcgccctctagtgggctccggggacgcatcccgctttccccagccccgggcggtcggcgccgctatctcagtggagcgcagcgctggaaccccgggggcccggagcggaggctaatctgggtcacctttcccctcctccgggcagccagtggactcctcgcaggctctgtgtgggcccgggaggcgccgggtggacgagagggggccgaggtctctgggtttggattgagaatgggacgtccttgtaattcaatgtgggagaagcaggggagtgtggaggaggacgggtcccgtgcgttcttggggggcaggcgccgtcttctgcgttccagcccctcgccagctcccttgccccgcgggcggcctgttgctgtttgtttgttttacgaccctgcgttattgtgcaacggtaacagtcgtttccaatcagctgcgcggccgtcgcggccctcgccaggctggtttatgggggcggcggtggcgcgcggacagataggacagcgcggcccgggaacggcgtcgaggtccaggcggtccccctgccccgagggggcggaaatgctgaggtggcgagagcgtgggttgcacagaaccctagtagcgagtccggctgagcctctgcggcctagcccagcagcgtcgtcttcccggctccgaagacgtcttcccgaagccccgctgccccggcgcaccagctcccggtgatggggatgatgatggggatgatggggagatgtccccgaattctcctggggtcccgaggagatttagccattttcaacagcagttttcctatttctgcttaaaccccgcgggctttcaactgaggtcaccacgaaagctaaaagtacaacctaaggaaggaagagactggaaattaacatttggggtagtggagctcagaattcctcgcagcggcgtctgtgtcgcaacccgtggacgcacgtccttggaccaacactgccatctgctggccactcgtaagaactactgcgacccgctgtgagaatgggcttcgcggagaccattaggaaggtgctttattttttattttttatttattttttgctcagtaggaccgtaataggtgactgattttcttttgctgtgaggctacaagaattgctggaagacaacatttttatttcgtggaaatttgtgttgtgtttctccttggttgttaatgctttgcatttacatagtgaacatcttattatcagagctggcctgtgaggagggtagtgggggggcattgatgttcccgtttctgagtgaggagacctatgtcggggccttggtgacctcaagccgaatgctcaaactgctactgctactcctaaggttgtgccattaggagtcacacccgtttggtgatattcaaaaggatatgtcattttattctcccgtggttaaatatatggtgagaggagagcaggcatgtttatgagcccagattgtcccataaaaggctcctgtttaaaaacactccagccccctcccattactggaatgtctgatggagctccgggagatcaaaacaacaaaacaggctctggtagggtgcagaggtcctggtaaacacaccctctgctggaaaacagggagaagtttccaccagtgtagacctgcacttggtttgcctgggctgaagttaggagactgcgtagaaaaaggaaaatgtgtaattttcacagttagaattaacttaggagagctgaaattaactgagcctcggaaatctgaatcttgaagtcaccagtggcttttggggctgtgagagagtctcctgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtctgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctgaatcagagttcagatccatgtctccaggaggtaggaggtgcagggcaagtcatgtggcttctggggcatccctcactttcttagttaaggagaagttgaaggagccgatctaaaatatcttgggagtctgcagaaaaagtcgtgaaaatcaaagcactttcaattaaactatataatttagtccttacaagaatgccacagggcaagcaaccagtcaggccttggtagtcgtgcttcctagaagaaaagactgaggttcagagagttggatagagtatcagatttgggatcagtggctagtccaatgtgatttccatcctttcttctgagagaaagcataagaaggccaagaggatggtggaaaagcacaagtcacctgcctgagagtcaacagggcggggggtctctttctcagtttgttcctctaagttatggcaaatgttttttgagctgtgattattgagaatgggggctgaagttcaacatgtagttggcatgagggaagtaattatgattgaagaaaagatttgggtgaaatctagtgttcttccctgcaaagggggttgttctcacggattcttatggtgccatgtttctcagaatttgtagtttcagttacttatatttgcacacctgactttagatgagctccagaatagcagttactaattaaggatgagcatttagagtagataaaagtggcaggaacagcaagactcactcccagagagcctcactacaggtctaataggtgaggaaattccccatgtttcccatttttcttcattacctccctgtggggcaagcactgccattattcatgagtaaactgtctgagttatagataagtaatgacatgaaacttcacaaacacgctgagcacagtggctcacgcctgtaatcccagcactttgggaagccgacgtgggtgaatcacgaggtcaggagttcgagatcagcctgaccaacatggtgaaaccctgtctgtactaaaaatacaagaaattagctggccatgatggtgggcacctgtaataccagctactcgggaggctgagacaggagaatcgcttgaacttgggaggcagaggttgcaatgagctgagatcatgccactgcactccagcccaggcggcagtgcaagactccatctaaaaaaagaaaaagaaagaaagaaaaaagaaaaaaagaaagttcacaaacaggcctgatttctacccagggaaccactgttatcagagattggggtttggaatcttaagcaacaaacacatgtttattctcttccttcctgatggcttgctcagaggacctgtttccattgcccactttttttttgagacagaatcttgctctgtcacccaggctggagtgcagtggcgagatcctggctcactgcaacctctgcctactgggttgaagccattctcctgcctcagcctcccgagtagctgggattataggtacctgccgccatgcctggctaattttttgtatttttagtagagatggggtttcatcatgtcggccaggatggtcttgaactcctgacctcaagtgatctgcccacctcagccttccaaagtgttgggattacagatgtgagccaccacgcccggcctcattggccactttatatgtcagtaaataatctttcctggcagagggtccactgtatctggaggcactgaaggaaatctgggagtgtctggccagggcaaagcactgcttagagcttgcacaggaaaagcagtgagcccttcttttaagctggagaaagctttaaagatgcatctttggcaagtcttgccaaagaaatatgggttctaaatgtgataaaaccaaagacatcaagctggctctggaggccttgtttgaagtttgctgagtggattgtcagtgggaggctgatatttatatgtacaaacacacaagcattactgctaattgtggtaaatcaggctggccagcctggctctggggcccactgtgcctgccaccgcagcagtgtggaagccttgcatcccaggcacatgtcaggatcctcggaggccatcagccagccagcattgtgtgaattgcatttgggttcacagcactgtaattgtgtttctcctgctgtggtgagcaaaggaggaaaatggaaggaggaggtataatttgccctaggaaatagtcaggcaagtaggtggcacacaggggtgggatatggctaaaacactgaccttcccttgagagagaccatatggtgaagtggagagggcatggcgtttgtatcacacgaccttgtgttcaaatcctggctctgtcactggctgtgtgactttgggtcatttgcaaaacctctctgagcctcaactgccacttcttaaaatcagctctaagtaatcacagggttattcttcacaaacacagcatgcacatgcaaactttggcttagtaaataatggtttctccttctcttactttgttttctacataccccactccccttcctgtgaggagccttccacctttttctctgtgttctcttcctctcccattttcctggtagcattcaataaaacagaaatctgatttctgcaaagtaggccaccttacggtagaaatacatgattaggccccaccaaaaactttgattaggctattatcttctggatcctggatcccctccaaccaaaccaaacccaactagggctaaacacagcaatatatgaatacattgaatttctctctcactctttcttttttttaaaccagtttactcaggaatcacatgcacacatattttagcttccaaagccaatgatggaacaaattgtgtcccattaggctcactccattgtatgagttagcatcagaggagttcataccagagtgacttcatcttgaatagggcctaggtaagaagaggatgagacctgctgggctgcattcccaggaggttacacatttgtagtcacaggagagaaaggagttggtataggagttgatagatacaggtcataaagaccccagtgataaaacaggttgcaggccaggtttggtggctcattcctgtaatcatagtactttgggaggccaaggcaggaagattgcttgagcccaggatttcaagatgagcctggacaacatagtgagaccttgtctctacaaacaataattttaaaaacatgagctgggcatgatggtgcaggcctatagtcccagctactggtctgaggggcagttgggtggcaggctgagatgggaggatggaggctgcggtgagctgagatcaggccactgcactccagcctgggtgatggaataagaccctgtctcaaaaatagataaataaataaataaataagccagcaaaaccagaatgcagtgaagaagctggccaaaacccaccaaaacgaagatggtgatgaaagtgacctctggtcatccctactgcttattacacactaattataatgcattagcatgttaaaagacactcccaccagtgccatggcagtttacaaatgccatagcaatgaccagagatactctatatggtctaaaaaggggaggaaccctcagtcctgggaattacctgtccctttcagggaaaactcatgaatcttctaccgcttgttgagcgtataatcaagaaataactataggtatactcactcaagcagccatgcagttgctgtgcccatggagtagccactcttttattcttttactttcttaatatatttgctgtcattttactcttttggcttgctcttgaattccttcctgcatgaagccaagaacctttgtgacctcccaggctgaaccccaattttgagttccaccctatgacatcttttctggtgaccaatgaagggacaatggtaacctcccgttgactttaaattaaaactgattggcactgtttgggcttcaccggtgggtgagtctctccttgcccagattcaacttgctaacatttttttctcttcaattttggctcctttgtccttcctaatgttcttcattttggacagatgggaaagtggctgtgaggcctctggcttagcagcctgatagcagcctcctgttgtctgggtgccccagatgggagcacgcctggctggccacatcttttgcaacccaccttgtcatcccttctctgggaccttttctctttagtttcttttttaaaaaaaattttaaattatttatttatttatttatttttagagatagcatctcgctgtgttgcccaggctggagtgcagtggcataatcatggctcactgaagcctggacctcactggctcaagtgatccttccacctcagcctcctgagtagctgggactataggcatgcaccaccacgcctggctaaattttgtattttttttgtagagacggggttttgccatgctgcctagactggtcttgaactcctgggctcaaatgatctgcctgcctcagcttcccaaggtactgggattataggtgtgagccactgcacctggcctctctttagtttttaatgactggctgtttgacttctctgctcttcaggctgaaattcttatttcatgtttgtagtctttgccttggctatttggcaactgtttaaggcaagacacttggttttgagagttctcccgttgtgttgaccctgggacaccagggtcattgttctgtagctccaattatgttaggtctcatgcttttgggtttcactattggccaccccccagatgctctggggtttttggcatttggtgtggggacccttgttagctgatactctgggcttttcggcatttggatgctccagggtgtttggcactgacattcccctctagcattgtgggttagagtcccacccaggggaaatcttggttttgccttttcttgttttctactctaaagttatcattttctataaaaacattttcttttcttattgtcactttgtttaatgctttgctccaggaggtgggaatttgcaggggaaaataattgggctctccctatacttagaaaaacttctgtgtctagtagagatccttgttagacaaagggacagtggtgagtcccagagaactcgtcactagggtgccttttaggcaattggagcaaattcaaattagcaaactaagtttggccatttggataagtcccagttttgtcagggaaataatttgggtccagctatcttttataaaatagtgcgtttgcgttcctacattatggctagagctcaaagataaaagctattggatctttgtttatgtgtgtgtataaatgtctagatgtgtttatgtgtatgtacatttattatgttatatattgtatctacagggtaccaaattggcttataaataaaagagtgctcataaaaagagtaaataagtccaagcatttctcaagctcatgtaacttaagtttactaaaatttagagttactaaaaattcatatataactctgtataaatgtgccaaagaagatatgctcttagtgaaaataaattctttttggccaattcagatgtcatttatatgtggggtttaaaatatgaatttcgaaagaaaataaaaacaagtagaaagaaataaaaaacaataagcagtggagagagatgtgaggaaagttatgaatatgaagacgtatttttggtaaggaatgttataaagaaattttatgagaaaggatcttatatgataaattcttgtcctaaggtagaatgactgattgtttagaaaagaaggaaatataggacaagtcagaaagtccaagcatgttgtagatgacctatgtaagtcacgataaagtttatacaagagaatttattaaaatttagatgtaattagccataactgaaaggaaatttatttatttatttatttatttatttatttatttatttatgatttattttgagaaggagttttgctcttgttgcccaggctggagtgcaatgtcatgatcttggttcactgcagcctccgcatcctgggttcaggcatttctcctgtctcagcctcctgagtagctaggattacaggcatgcaccaccacacctggctaattttgtatttttagtagagatggggtttcatcatgtttgtcaggctggtctcaaactcctgacctcagttgatccacccaccttggcctcccaaggtgctgggattacaggcatgagccacctcatgcacccagccaggaaatttatatataatactctatctaaattttggtgccctatgttaaaacaagtttttcttcaagtattggtttgctttcagtaagattgcaagaaatattgacttttaattctagaatctgtttcctttgaaggcctctcagatttatatcttttccttttcccttgaaaaggtatagcctttgcaagttcaaaactgacttccctagactccttttaggaaaagcaatacagtggttgtttcaggctgtggctcaatagctaagcctttgttctttcatggtggtggcctgggttcagttcctggcttagagaatgagaggtttccagtttgctacttctgggacttttgtcatttatttattctttttgtctccatcgacagcttctgattttctcacttgaatttttttttctgtgagctaccttaagggtaatgttggatcttgtaaaaattgcttgccatctctttggagatacctcttgtgtccatggttaagttataaccttggttaaggcctgttggtttcactagggaaaatacctttaaaaaaaggcttaaaagccagagatgttggctatttgtcctggctagagtctggtattaagggatttaaaaggattttttaaaggacctctatagttataagtcagcttaattaaaaatggatattccatagtcatatttatatatatatacacacacatatatatgtatgtatgtgtgtatatatatatatttaaaagacctgtatgatttttttcttcttggaacttatttttttgagagaaagtgttttgtgtgtttgttgtttgtttttcttctcagtggactgaattatttctccattctgtctttttaccccctttaatgaccatattagaggacctaagataatttctgacagcctgggactccttgggaggaaacagaaggtgccacagacctcgttttgggagaaacctctgttttcctcatggaaccccaagagctgtaagcagagagttctccctcagaatccaaggctctgctctgtttacgtcacattacctgacctttgtgacttttgggggcatcagaaattactttgcattatgagggaacctttagcattggtgtgtattacctaggtaggatgtgtacttttagggattgcagttgcttacatgagtggttattactacagaccaatacttctttcttctcacatttaaatgaaaaaaaagcatgctcttgggcatccacctatgaatggaggatgggctgatttgctttaggttggccaccagcctttggggaacatcgttgcagtgaaatgcttggtgaaagcattgcactgtctgatcgcatagtgcacttctatgcacttctgcctgatgtcctaggctcaacacctgctacataattaagatcacttacttatcaggtttttaatcaaaatgaaatgttgctaagagttaacattatagcatatgtaattgagattactggagaaagttttacctacaagatatgtaaggaaagcaaaatgtgtttttggtaaaagattataggaaggtgtgccagtatagttttttattttgcttactttaatgggttaaaggattgttttaagtttgataggagaaagctgaagcatgagcaagttgtggaaggtatatgaaagattaacattttaaaagaaattctgtgtgtaaacattggctaaagttaaaggaggaggttggagccaagatggctgaataggaacagctccggtctacagctcccagcatcagcgatgcagaagatgggtgatttctgcatttccatctgaggtatcaggttcctatcactagggagtgccagacagtgggcgcaggacagtgggtgcagcgcaccgtgcgcgaaccgaagcagggcaagccattgcctcactcggaaagtgcaaggagtcagggagttccctttcctagtcaaagaaaggggtgacagacggcacctggaaaatcgggtcactcccaccccaatactgcgcttttccgacgggcttaaaaaaaggcacaccaggagattatatcccgcacatggctcagagggtcctacgcccacagagtctcgctgattgctagcacagcagcctgagatcaaactgcaaggcagcagcgaggctgggggaggggtgcccaccattgcccaggcttgcttaggtaaacaaagcggctgggaagctcgaacagggtggagcccaccacagctcaaggaggcctgcctgcctctgtaggctccatctctgggggtagggcacagacaaacaaaaagacagcagtaacctctgcagacttaaatgtccctgtctgacagctttgaagagagcagtgattctcccagcacacagctggagatctgagaacgggcagactgcctcctcaagtgggtccctgacccctgacccctgagcagcctaactgggaggcaccccctagtaggggcagactgacacctcacacagccgggtactcctctgagacaaaacttccagaggaatgatcagacagcagcatttgcggttcacgaaaatctgctgttctgccgccactgctgctggtacccaggcaaacagggtctggagtggacctttagcaaactccaacagacctgcagctgaggatcctgtctgttagaaggaaaactaacaaacagaaaggacatccacaccaaaaacccatctgtacatcaccatcatcaaagaccgaaagtagataaaaccacaaagatggggaaaaaacagagcagaaaaactggaaactctgaaaagcagagcgcctctcctcctccagaggaacgcagctcctcaccagcaatggaacaaagctggacggagaatgactttgacgagttgagagaagaaggcttcagacgatcaaactactccgagctacaggaggaaattcaaaccaaaggcaaagaagttgaaaactttgaaaaaactttagacgaatctataactagaataaccaatacagagaagtgcttaaaggagcagatggagctgaaagccaaggctcaagaactacatgaagaatgcagaagccttaggagctgatgcgatcaactggaagaaagggtatcagtgatggaagatgaaatgaatgaaatgaaatgagaagggaagtttaaagaaaaaagaataaaaagaaacgaacaaagcctccaagaaatatgggactatgtgaaaagaccaaatctacgtctgattggtgtacctgaaagtgacggggagaatggaaccaagttggaaaacactctgcaggatattatccaggagaacctccccaatctagcaaggcaggccaacattcagattcaggaaatacagagaacgccacaaagatactcctcgagaagagcaactccaagacacataattgtcagattcaccaaagttgaaggaaaaaatgttaagggcagccagagagtaaggtcaggttacccacaaagggaagcccatcagactaacagtggatctctcagcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattctgtcaccaccaggcctgccctaaaagagctcctgaaggaagcactaaacatggaaaggaacaaccggtaccagccactgcaaaatcatgccaaattgtaaagaccattgaggctaggaagaaactgcatcaactaacgagcaaaataaccagctaacatcataatgacaggatcaaattcacacataacaatattaactttaaatgtaaatggactaaatgcttcaatcaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaggaagagctaactatcctaaatatatatgcacccaacaatacaggagcacccagattcataaagcaagtcctgagtgacctacaaagagacttagactcccacacaataataattggagactttaacaccccactgtcaatattagacagatcaacgagacaaaaagttaacaaagatagccaggaattgaactcagctctgcaccaagcggacctaatagacatctacagaactctccaccccaaatcaacagaatatacatgtttttcagcaccacaccacacctatcccaaaattgaccacatagttggaagtaaagcactcctcagcaaatgtaaaagaacagaaattataacaaactgtctctcagaccacagtgcaatcaaaccagaactcaggattaagaaactcactgaaaactgctcaactacatggaaactgaacaacctgctcctgaatgactactgggtacataacgaaatgaaggcagaaataaagatgttctttgaaccgacgagaacaaagacacaacataccagaatctctgggacacattcaaagcagtgtgtagagggaaatttatagcactaaatgcccacaagagaaagcaggaaagatccaaaattgtcaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagactgctagcaagactaataaagaagaaaagagagaagaatcaaatagacgcaaaaaaaaaaatgataaaggggatatcaccaccgatcccacagaaatgcaaactaccatcagagaataccacaaacacctctatgcaaataaactagaaaatctagaagaagtggataaattcctcgacacatacaccctcccaagactaaaccaggaagaagttgattctctgaatagaccaataacaggctctgaaattgtggcaataatcagtagcttaccaaccaaaaagagtccaggaccagatggattcacagccgaattctaccagaggtacaaggaggaactggtaccattccttctgaaactattccaatcaatagaaaaagagggaatcctccctaactcattttatgagggcagcatcatcctgataccaaagccaggcagagacacaaccaaaaaagagaattttagaccaatatccttggtgaacattgatgcaaaaatcctcaataaaatactggcaaacagaatccagcagcacatcaaaaagcttatccaccatgatcaagttggcttcatgcctgggatgcaaggctggttcaatatacccaaatcaataaatgtaatccagcatgtaaacagaaccaaagacaaaaaccacatgattatctcaatagatgcagaaaaggcctttgacaaaattcaacaacccttcatgctaaaaactctcaataaattaggtatgtaaatgggacgtatctcaaaataataagagctatctatgacaaacccacagccaatatcatactgaatgggcaaaaactggaagcattccctttgaaaactggcacaagacagggatgcgctctctcaccactcctattcaacatagtgttggacgttctggccagggcaattaggcaggagaaggaaataaagagtattcagttaggaaaagaggaagtcaaattgtccctgtttgcggatgacatgattgtatatctagaaaaccccattgtctcagcccaaaatctcctgaagctgataagcaacttcagcaaagtctcaggatacaaaatcaatgtacaaaaatcacaagcattcttatacaccaataacagacaaacagccaaatcgtgagtgaactcccattcacaattgcttcaaagagaataaaatacctaggaatccaacttacaagggacgtgaaggacctcttcaagaactacaaaccactgctcaatgaaataaaagaggatacaaacaaatggaagaccattccatgctcatgtgtaggaagaatcaatatcatgaaaatggccatactgcctaaagtaatttatagattcaatgccatccccatcaagctaccaatgactttcttcacagaattggaaaaaactactttaaagttcatgtggaaccaaaaaagagcccgcatcgccaagtcagtcctaagccaaaagaacaaagctggaggcatcacgctacctgacttcaaactatactacaaagctacagtaaccaaaacagcatggtactggtaccaaaacagagatatagatcaatggaacagaacagaaccctcagaaataacgccgcatatctacaactatctgatctttgacaaacctgagaaaaacaagcaatggggaaaggattctttatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacatagggcatgggcaaggacttcatgtctaaaacaccaaaagcaatggcaacaaaagccaaaattgacaaatgggatctaattaaactaaagagcttctgcacagtgaaagaaactaccatcagagtgaataggcaacctacaaaatgggagaaaatttttgcaacctactcatctgacaaagggctaatatccagactctacaatgaactttaacaaatttacaggaaaaaaacaaacaaccccatcaaaaagtgggcaaaggacatgaacagacacttctcaaaagaagacatttaagcagccaaaaaaacacatgaaaaaatgctcaccatcactggccatcagagaaatgcaaatcaaaaccacaatgagatagcatctcacaccagttagaatggcaatcattaaaaagtcaggaaacaacaggtgctggagaggatgtggagaaataggaacacttttacactgttggtgtaaaagtgttggtgggactgtaaactagttcaacccttgtgggactgtaaactatttggttggtgggactgtaaactagttcaacccttgtggaagtcagtgtggtgattcctcagggatctagaactagaaataccatttgacccagcaatcccattactgggtatatacccgaaggattataaatcatgctgctataaagacacatgcacacgtatgtttattgcggcactattcacaatagcaaagacttggaaccaacccaaatatccaacgatgatagactggattaagaaaatgtggcacatatacaccatggaatagtatgcagccataaaaaatgatgagttcaggtcctttgtagggacatggatgaaattggaaatcatcattctcagtaaactatcgcaagaagaaaaaaccaaatgccgcatattctcactcataggtgggaattgaacaatgagaacaacacggacacaggaaggggaacatcacactctggggactgttgtggggtgggggtagtggggagggatacctttaggagatatacctcgtgctaaatgacgagttaatgggtgcagcacaccagcatggcacatgtatacatatgtaactaacctgcacattgtgcgcatgtaccctaaaacttaaagtataataataataaaataaaaaaatttttaaaaaataaagttaaagggatattattattattatttttgtaagttaaacattaggattaaaaagcacaacagagttttctagagcactgatctactctgtaacagaaaattgtaaagggtttaaaaggtttatgagaatcttaccttatggtcaaactggttaagattgggaagatttgtctataaagttttattaagaattgggtttgacattaatactacactaatgcaaacgtgaaatgtggctttctctcttgaataagattttcatgtattattacaagataatgaaagatttttatttgctttttaaataaactataggaaaaataagggagagaaaagtgacagatcatttggaaacccaagtctcccctatatcaatgagtaaaagtttttacctttttgaaatctttgagttatcattttggctaaataaatgctttatggtgacctgggattctattttgtaatatcaactgtttaaaccttttgtatttgacaaacgttccaaactgaaattctaatgtaagtctttttctgacctgattagtccttctagatattaggtcccctaaagtccaaaagtgacatatttggcttattagatatattaaaatcatacaggaagcactttcaaatataaaatgctatttggctttctttggactatacttatataaatgtgttattggtatatgttccaaaattatgcaaaactcctataattctgatatgacttagtgtacattatcagtcataattatagttcttatgttacattattgtgtgctacagagttaaccaaatttctttgtcaattgcatctttaatcagctgtcctaagacttttgtcacccacagacaattgtcttgttttaatccttttcaaaaggtggtttataatcagctataggactctgatgggtactctaaaatgcaagcctctgataactttgaaaattgtgccattggctgggcatgatggctcacaactgtaatcccagcactttgggaggctgaggcaggcagatcacgtggggtcaggagttcaagactagcttggccagcatggtgaaatgccatctctactaaaaatacaaaaatcagtcaggcatggtggcatgcacctgtaatcccagttactcgggaggctgaggcaggagaatcacttgaacctgggaggcagaggttgcagtgagctgagatcgcaccattgcattccagcctgggcaacaagagggaaactccgtctcaaaaaaaaaaaaaaaaaaaaattgaaaaagaatattgtgccattgaaacagaaaagaaaacacaaataaacttccaggattctcatagaaacttaatatattcataaggaatgtggcccaatatcaggcaaaacaagagttaacagcatggactaaactaataaaagaccaaaacaatcttttaatgactttttgcttaaaacattgcatatcctttctgttttgcttttcagagtcaagaaaacttttcctttggaaagtatttactgcttttaacaattgaaaaaagtatactactatggacaaaatttggagcatatgtctttctttttacctgatttctccagaatttgaaaactatttgggagtattcttaactaatagcaatatagttatttgcctaagtgcagtaagaatcttttcttttgtaataggacacaattaaagaaactgcttattttatgaaggctttgactagaatggtgtgctttcagatacaaacagactgctttaagggatcaaagttgacttatagagccaataaaagccactatggaaaactggccttattctttgtctatgcagtctctgtatggggttcctgacctgtggtaagtgaagaatgtcactttctgacaggcccaggagccccaagttatcttgggacatcaagaagaaaggaatgcacccaacttatacaggtatttgcaggcacagataaatctgtggctggctcaaggctttaagaagcctaatgtgagattctttttaaattaaatttccatcgaaaccaattttaacaagagcctatgtggcaaataattatttttgctgcactttatacaaataatcaggccaaatttcataagattaaaactttatggcaaacaaatttgtcccactatgatttgtctttggtaaaaatggaagctagagagagaatttgtttcaaaaactatgatacaccagttattagattctagtctcgtctgttgtttttgagtttcttctgcaatttaggcagaccctgcttattcctgagaatcaaccagtgatctatggctgttgctcagaagaaataagagggatggctaacgtaaagatctggattagtattctaattctaggcatgtattagaattggctagtgaccccatatcagcttggttttaacaattacccagttcatggaaagccttcttatttagtttacttgggataattgtgctgattttgttttactgttgtggaatatattgctgttgtcctctttgtgtaggaatgcaggaaaagcttacttaacattttcttaaattgaacacttattaatcttccagatttcaccttttgtcagaactcagagttatgatttgtcctcactgtactgacaacaggctctggtagggtgcagaggtcctggtaaacacaccctctgctggaaaacagggagaagtttccatcagtgtaagcctgcacttgggttgtctgggctgaagttaggagactgagtagaacatttgctgcagaaaaaaaagaagatgtgtaattttcacagttagaattaacttaggagagctgaaattaactgagcctcggaaatctgaatcttgaagtcaccagtggcttttgggactgtgagagagtctcttgtggtctttaatcatgtgagggtggggtgaaattcaatattcagtggttctgcaatgggatgcactgtgcaattggtgattgagaagccaactctctggctttaggagaagaatgtcttgctgttagtccttctggaaatagagccttgcattgcctactgtccgtttacactacctttgcacattgcctttggttatagagtcatgtccaatggctctttacttctgtttgcagggcaggagatggcaccctgttaaagagaaaggatagtagctgcaaagtcatttgtttctctgtttctgtgactgtatatattggctcatctttgaatggtctttatagccacaccaggctggaggtaacagggtcatgggagtggactgctggtgtgggctaaatcagagttcagatccatgtctccaagaggtaggaagtgcagggcaagttatgtggcttctggggcatccctcactttcttagttaaagagaagttgaagtaatcattctgaaatattatgggagtctgcagaaaaagtaatgaaaaccaaagcactttccattaatctccataatttagtccttacgataatgtcacagggcaagcaaccaatcagaccttactagtcgtgcttcctagaagagactgaggttcagagatttggacagagtgtcagatatgggatcagtggctagtccaatgtgatttccatcctttcttctgagagaaagcataagaaggctaagaggatgggggtaaagcacaagtcacctgcctgagagtcaacagagcaggggtctctttctcagtttgtttctctaagttatggcaaaagctttttgagctgtgattattgagaatgggggctgaagttcaacacatagttggcatgagagaagtaattatgattgaagaaatctagatgaaatccattgttcttttctgtaaaggggttgttatccctgattctttttttcttttttcttttttagatggagccttgctctgttgcccaggctggagtgcagtggtgtgatcttggctcactgcaacctctgcctcctgggttcaagtgattctcatgcctcagcctttccagtagctggaactacaggagtgtgccaccatgcccggctaatgtttttatttttagtagaggtggagtttcaccatgttggccaggctggtcttgaactcctgacctcaagtgattcacccaccttggcctcccaaagtgctggaattacaggagtgagccattgtgcctggcctgttctcactgattcttatagtgccatgtttctcagaatttgtggcttcaattacttatatttgtgcacctgacttttaggtgagctccagaatagcattactaattaagaatgagcatttagagtagaaaaagtgacaggaacagcaagactcacttccagaaagcctcactacaggtctaataggtgaggaaagtccccatctttcccatttttcttcattacctccctgtggggcaagcactgccattatgcatgagtaaactgtctgagttatagataagtaatgacatgaaacttcacaaacaggcctagatttctacccagggaaccgctgttatcagagaagggagtttggaatcttaagcaacaaacacatgttgattctcagtatttgcctcctgatggcttgctcagagagcctgttttcattgcccactttatatgtcagtaaataatcttccctggcagtgggtccaccatgtctggatgcacacagggaaatctggtggggtctggccagtgaaaaacactcctcaggttttgcaggaaaagcagtgaacccttcttttaagctcgagaatgctttaaagatgcatcattggcaagccttgccaaagaaatacgggatctaaatgtgataaaagccacgacgacatcaagctggctctggaggtctcctttgaagtttgctgagtggattgtcagtgggaggctgatatttacatgtagaagcacacaagtgttactgctaattgtggtaaatcaggctggccagcctggctctggatcccactgtgcctaacaccagccctgcatcccaggcacatgccgggctcctcagaagcgatcagccagccagcattgtgtgaattgcatttgggttcacagcactgtaattgtccttctcctgctatgaggagcagagagggaaaagggaagggagggttgtgtaatttgccctaggaaattgtgggggagggacaggcactgggccgggtggggggcggtgcgacatggctaaaacactgaccttcccttgagagagaccatatggtgaagtggagagggcacagcttttgcatcacacaggccttgtattagaattttggctctgacaccagctgtgtgaccttgggtcatttgcgaaacctctctgagcctcaactgccccttcttaaaatcagctctaagtaaccacagggttattcttcagaaacacagcatgcacatgcaaactttggcttagtaaataatgatttctttttgttctatctactccacctccctttcccattagaagcttgctacctttcactctgtgttttcttcctctcccattttcctggtggcattcaataaagcagaattctgatttctgcaatgtaggccaccttagagcaaaatacatgatcaggcaccaccaaattaggctattatctactggatcctgtttaaccaacccaaacccaactcaggctaaatacaggaatacaagaaaacgctgaatttctcccctttctttttttttttttttttgagacagagtcttgctctgtcacccaggctggagtgcagtggcgcgatcttggctcactgcaagctccacctcctgggttcacgccattctcctgcctcagcctcctgagtagcggggactacaggtgcctgccaccacgcccggctaattttttgtatttttagtagagacagggtttcaccgtgttagccaggatggtctccatctcctgatctcatgatctgcccgcctcagcctcccaaagtgctgggattacaggcgtgagccactgcgcccttccctccttttttttttaaaacaacaacaacaacaacaacaaacagtttattcagtaattatgtatacgtattttagcttccaaagtcagtgatggaacaaattgagtcctattaggcccactccattgcatgagttagcatcagaggaggtcaaactagagtgacttcatcttgaatatgggctaggtaagaagaggatgaggcctgctgggctgcattcccaggaggttaggcatttgtagtcacaggatgagataggagttgggtaggaatggtttcataaagaccacaggatgcaagctgggtgtggtgccttatgcctgtaatcccagtactttgggaggccaacgcaggaggattgcttaatcctaggagttcaagaccagcttgggcaacatagtgagacctcatctctacagataatttttattttattttattttatttttttgtgatggagtcttgctctgccgcccaggctggcgtgcagtggcatgaccttggctcactgcaacttctacctcaggggttcaagcgattctcctgtctcagcctcctgagtagctggaattagaggcgcacaccaccacgcctggctaatttttttgtgtttttagtagagatggggtttcaccatgttggccaggctggtctcgaactcctgacctcaggtgatccacctgccttggcctcccaaagtgctgcgattacaggcatgaaccaccgtgcccagcctctacaaataattttttttttttttgaaatggaatctcagtctgtcgcccacactggagtgcaatggtgcgatctcagctcactgcagcctctgcctccctggttcaagcgatttgccttacaaatgatttttaaaaaatgagctgggtgtggtggtttcacaagatacgggtgataaagaccccaggatgcgggccgggtgtggtggtttatgcctgtaatcccagcactttgggaggccaaggcaggaggattgcttaagcctaggagttcaagactagcctggacaacatagtgagacctcatctctacaaataattttttaaaaatgagctgagtgtggtggtgcaggcctgtagtcccagctcttgggctaggcatgggggtcagctcaggtgggaggattgcttgagcccaggagttcaaggatacagtgaactatgattgtgccagtacactccagcctgggcaacagtgcaagaccctgtttcataaacaaattaaaaaaccccaaaaacctaggatgcaatgaagaaggaagccgaaacccaccaaaaccaagacggtgatgaaagtgacctctggtcatcctcactacccattatatgctaattataatgcattagcatgctaaaagataccaccagcaccatgacagtttacaaatgttgtattaatgacaggaagttaccctatatggtggaaaaaggaaggaaccttcagttctgggaatttcctccctgtttctgggaaaatcatgaataatgcacccttagtttagcatataatcaagaaataaccataagtatactcagttaagcagcgtggctgttctgcctatggagtagccacccttttttattcctttattttcttaataaatttgcttgaattccttcctgggtaaagccaagaacccatgtggcctcccatggtgatctccaattttgggattcaccatgtgacattaggagcaacttagggatctggtgcatcccaggccaagactaacatggtgatttttggggggttatgttaaaactgggggctctgcccaggcccctcagtgtggcttcttgagtcaatacctgggtacttactggccctagcacctacaagttcattcacagttccttctcactgacttcaccagtgaccactatcagtgacttcaagggagaaatgaggggggagataaaataaagtgaatggggaagagataaagaagagaggtcttttcacagtttgccagaatagtcccttcagtggttttaccccagggcaacaggagcccccttttagtttctttctcttttaattttcttttcccttcccactttttgcccactttttgccttatttgtgtctgactcaatttccgtctctttctctacttcttcattcccagatttggctgtagaaaattagaaagttcttgaacttggtttgcacgggtgcttttactttaacatgaaaatgaatgatcagcctccttctaatttcatcctagagtctactgcatccctcctaccccctgcacaggaatttagtcacacttatctctcccactttctctcccttcttcactttctctattgctcctcctttcatgcttgtacctgcttttccatgccctgtttagcctggcttgggatccagcaggttctccaagggttcctgcaagaaccccggctgggtgcccaggtctgagcctggtatgtgcctcagtatcacaaaggcctcctgtaaatgacacacattgttggaagtttcagaaattctaggtcaaaatggcactgaaatattaaggtatttaccccaacccaagcaacttttctaaaagttgtagagagtgtgacctctttattaattgaaacgtgaaaatcagctctagtttggaagctgagaaaaaatatatatatatgtatttatttctttgttgtttgaattcttaatataaatggtttaaaggaccattgaaaactgcatgcaatcacagaaggttttggcttcaggcagctcccgccatgatcttggggccccattgattctttcatctttcaggcgtcttactgtttgaaccttgaattttaacctgggacatgtttgactaaaatgatgctgttaatattttctgttgtgcaaaacacaaagagaactaggctccagggttgtttctatttgctaatgctgtttctgttgacttttgacttttctagtttcccagagctatggggacttcccatccggcgttcctggtcttaggctgtcttctcacaggtacggagcccagtcctctctgagttccttgtttgggtgtcttgtttttttaagctttgtgctgcatgggtttattaccagtactctgcatacacagtccaaaagagtgaaaagaaatagaaaactataggacgttatccagaatgaccacaaaccttcagttccctttgctgtattgcacttactccatttcaaaaggaatgctctccagtggcagttttagtacatatataatgttggcattgaaatgttgttagtaataatgtctaaatttacttactactctcttccttttcctaggacaaggcttctattagagctggattagataaattcaggaatggtcagctgtgggaggtggcacatctgttgtcccagccccttgagcagctgaggtgggatgatcccttaaggccaggagttcaaggttgcagtgcactgtgattatgcctgtgactagccaccacactccagcaacatagcaagacctcatttaaaaaaaatgttcaaaggaaataaataatagaaaattcttgcccaagaaatcatacttgtcttaaatcataactctcttgaggaaagatgcttacattgcttctaaatctcagagtcacctttatcttctctaggaatcaaattgatagatgaatgtttggctcttggaaaatcttaaaaactttcccaccaaaaggatcattggggtaatttgttgaagtgtgtattggactgtcttagttttcctccagatatttatgcactgcagatgttcgccatgaaaccagtgctcttctattctgaggagttagctcagcccgttagtgtctttgtcttacccatttggatatggtagaattgagcaagaccagagattcaacagttctaagctccactaagtataccccatctacagagtaataggtgatccagatgtacttacaaatcctatcttaacaagctttaggaattatagtggtcatatattgaagttgggtgggagtctcacaccaggttccaagggagattacaaatcactaattaataattaagtcataatatctcttctatcagtctcgggtttcttgttttctaagttctgtgctccatgggtttattatctgtactctgcttacacagtccaaaagagtgaaaagaaatagaaaactacaggacgttatccagaatgaccacaaaccttcagttcctttgctgcattgcacttactctattgcaaaaggagtaagtgcaatttcagtctaaataagcgagactgaaatttgagcttcgaagatgaacttagagttttcactcttgggttttacttaccaattgtgaattaaaatccgtatcatctggcaccactgcactccagcctgggtgacagagcaagactccatctcataaaaataaagaaataaataaacaaataaatccacatcatcctgctttggccctggaagtcatgagggagagacggcatgcccgagggctataagaaatggaagatgtggaattcttgagcacagatgtgctttgtgttttcttcagtctgtgtccttgcctccattcttattccatgtgggtttttttttttttttttttttttttttttgagacagggtctctcgctctattgcccaggttggagtgcagaggctgactgcaacctcaatcccctgggctccagtgatcctcccacctcagcctccagagtagctaggactacaggtgtacaccagcacacctggctaatttttttatttttttattttttgtggagaccaggtctcactacgttgcccaggctggtctcgaactcctgagctcaagcgatcctcccacttccacctcacaaagtgctgggattatagacatgagcctctgcgccccagcctcatctcattttaactaaaggaaacctttgcagtgattgtgaaccataaagaacccatatgtgcttgagcccgtgccatcttgggatattttatggttacacataagagtctgaaatatggaattggaatcagacatcctctgtctatttgagtgtttggaggggtgaatctagtggggcttggtggagctatttggaacatttgctgctctcagcagatgcagtggctgttataatgggggagctttcatgggcatccaggctaacggatttttgtgtagaaatggtcattgttcatctaagctgctactgttgcttctctcagttgtcgggatgagactgtcctttctgactgcatcctattcagagcgtgcttccttttgcagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccaggtgagttggctgggtctccaggaccaagcttcttctcttcctgtctctcctgttaaatgtactaaggttttaaacatatatataaataattaatatttattgcgggaagtttgaaaaatgtaagcgaacacacacaaaaatcatttgtaatattatcaagaaatattcattgttagcatttcagagctgtattaagtttggaaagtcatctttgttatgacatgtcctgtattgatactgtataaacaatctgaaatatactcatctctattcagttcattcaagttgcacacatactcacagtgtgtccagcactgggctaagtgttgagtacacaaaaattaataggtaagccctgtcttggagttgctgatagttcattataatatcttccaaataaacactcgatttttcagattcactatcaacatacatttattcttggagagttggaaggaattttctttttccttttaaaaaagttacatatatatatatatatatatatatatatatatattttttttttttttggtaacagggtctcactctgttgcccaggctggaatgcagtggcatgatcatcatagcttactgcaatctcaactcccttggttcaagcgattctcccacttcagcctccccagtagctgggattacaggcatgcaccaccacgcccagctaatttttatattagttgagacgggggtttcaccatattgaccaggctggtcttgaactcctgaccttaagtgatctgcctgcttcggcctcccaaaatgctgggattacaggcgtgagccactgtgccctaatttttatttttatttttgtagagatagggtttcactgtgttgcccaggctggtctcaaactcctgggctcaagtgatccacagccacctcagcctcccaaagttctgggattacaggcacgagccactgggcctggcctactcctgcattttaattaaaaggacaaaagggtcgagcacaagtgatggcaatttcagtatgcagttgggtaaattaaaaaggactatggctagaatccttggttttagaacaaaacctaaactgtttatgattcttgccatccttgctgttttggcataggtgtgtcttcctacctttctgccttttctttttcagtttttaatgggctcctcttcctaccctctataactacgagtgtccccagggatctagaccctctttactttttcatgatactcttattcatatgaaccttccttcttaacaattaaaaaaaaccaaaaactttgttttgaaaagggaaggtatttagaatgtcactccaacttcattcacacttagattccttcaggaaaatcctctaggtgtggagggattttcccctgctgtgaagagaatggtaggaacgtgaatgtgttaaaggcacacgagtccctgaagttttaatccgtgtaagattgtccaaaaattcttcttgttccagcacagatgccatccaagtagcccctgcatcgctgtctgactgagatctttttattcgcaatcatgcagacgtaggggccctttctgcagctgatgtttgagactgttagaacttcttaccaccgtagcttaagtagctgtttttcttttggaaaggaaattctcaggctccttctccttctttaaattttatgtatttctcaaaggattactttttaataaacagatttctatgctatttttgaatcatactgactataggtggtaagagtttttaaaagcatttcataataaaactcgaaatattttttcctgttttaaacagagttggactgtattattttattgttaatttttgtttttagttgtttaaattttgatttagattcctggttagtatttatttatttatttgtagagacagggtctctctatgttgcccaggctggtctcaaactcctgaacacaagcaaccctcccaccttggcttcccaaagtgctgggattacaggcatgagccacaactcctgtccagtattgatatttatcatcagtattatccatcaggagacaggcaatttggtattattcatacttaaaaatcactttgtagctgtcatgataactaatgccagtggggcaattcttctggatatatgtgtaaaggtgaacttcatacctaatatcaataatgccagtgggatagtttttctggatttatgtgtaaaggtgaaattaatgtctaatagagtcttcattcttttttaaaccacagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaaggtacttgtatcatctccttccttctttaaataagagtaacaggcaaaatcataaggtgcgtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcagaagacctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaaccaaaaaattagaagagcaaaaaaaccactggattttactattgcggagacagtgattgattctcatcgtcttggcttctgtgccctgaggtttgattcatctgatagtgttgattgcccgcaccccttcctcttctgccttgttggcacccaggacaatgtgtcttcctgttccacctcctatgtgcctgacctttgcatggctcaccttcagtgaaccgttatgatgtaatcattcagcaaaggtttaatgaagtttgctcaatcccaagcactgtaccagaagctggttcagtattgcaggaagaagggaggaggggagatggaagtggggaaggggagccaccatgctgcctcttggtcactggagatttacagagtctcagtcattctaatgcattgtcactaagtgtgtaagacagccatgtgtaagaggctatgaatgcccaaatgcaggaatgactaatattcttatggagaacaaaaacgagatatatatatttcttgcctccactcctgacttgtaaatttctgctccctgttcttttaggcatttgacagctttctgtccttctatccattgatctccctccttttatccgtttctctctcccatgcatttgccgctgcttttcatttgtcctggggcatctgataggaagttgggcattttcactattgcctcacaaacttcacacagtgaagggacatttacagtccaacaaatgtacatcttccctgaaatatgaagtgatttggttcttctgttcatacttgattgactttaatccttaacacataaacactgctttctatttataggagacagcaatttttttttccaaaccgaagtacatgctatttggcttacaaatatataatcaaagtattgtttcatacagtatgttttttccgattataaaagtaatgcaggtttattgcagaaactttgtaaaatatggagagacaaaggaaaggctacttcccagagcatcactgtttatattttagggagataaagcttttatttttcatttgtatttctttcttttttttttcttttttcttttttttttttgttgtggagatgaggatctcactacattgcccaggctggtctcaaactcctgggcttaagtgatcctcccaccttggcctttcaaagtgttgggattgattacacatgtgagcctctgagcttgactgagataaagctcttaagtatttcttatccatagataaacattgaataataggtgttattctttaaatggtaatttattacattctttatccttcagcagtatagcacaaacaccttatatgtgtcattaactgtccttttaaaaaatgggctgggtgtggtggctcatgcctgtaatcccagtactttgggaggctgaggcaggagagtcacttgaggccaggagtttgagatcagcctgggcaatgtatcaagactccgtctctacaaaaatttttaaaaattagccaggtgtggtggcatgagcctgtagccccagctactcaggagactgaggtgggaggatcacttgaacccaggaggttggggctgcagtgagccatgattgtgccactgcactccagcctgggcagcagagtgagattctgtctctaaaaaaattaaaaacaaaataaaaaatctcatgattttctaagcagctagcttttattctttaggttttatcttttagagcagttttaggtttacagcaaaattgagaggtacagagatttcccatgtgttccctacacccacacatgtgtagcctcccaccttgtcaacatccctaccatccatttgttataactgctgaacctccattgacacatccatatcatccagagtccatagtttatcttagagttcactcctaggagcgagctttttaaaagtcggttttcttccccttttgctgtagaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatggtacattccgctttctaaaatgtcagttgtccatgctgctcgggatccatatgtggtaatcattatttaatggaaactcttccctgtacagagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtaaagaaactctctgcccaagtatgcctttttttagtgtgcatcagaggcggactgaggtttgtgtgtgtcttacaacccagacccaaagtcagtctagaaaatgtaacaatctgagttaagagatgcttgaaatcacatccctttaatgataacattgcaaagtggtattagtatgctggtaagtatttaatgagaagatgagaagaaagaactaaaagctctggcccctggggaaagacaggtcactggattcagctagggtggaagaaaggaagtaaaattggactcaccaggattgaatagattgaatatattccctgatgttcatcatccatatcgcaagtagacagatatggtgattacacccatgaggcagttatcacatcaccttacgtgaaagttaacgtcataggcttaatctggaacccatttgccctaattgaggactccacaggaaagaagagtagagcctggctaatcaggagagagatgtgcagtgagttgcttggatccctaccttttaatcagaatggtagattgctctcatctcttaattggtggtggagttttgaatgagtcacccctcagccacagtttcctcatctacaatgtaggataaacaataccttatgtccttcaaggcaaggaattggatcagatgatatcatgaggcctcttaaggttttaagctgtgattagaacccaagagtcagaagatacatctcacagcacccagctaaccagccctatacttttgtcagaaatcatctcagaaagacaaagtcagtcctgtatttcaagccttcaggaggaagaacagagcctttctcatcagttccattcacctcaggatttgctttcttctttgtgaactaaattccacgtgtaattgagaagcaatgtctgagaaaatggaattttacagcctctatagaatagtaaaggaaaaatgaagtgggatactgaatctggaaggctttctgttgacacaaaatgaaggtgtacaacaaggagggcagctttccacgaggaacttccatgaggctgtgcagccagagaggaatagggtaacaaccctggtacagctaacacctccaacacgtgtgtgagcactgtctgcaagccataatccatagcagtggcaggacaggctcgccaactgagtggttctggaaagctgccttttccttttagtgattcaaggatgcttcaacgtggattttttagttcctgttatgagccagtgaatacaaagatgaacatggtagatgggggatctggcttcctggagcttaaaactccaggatgggggatctggctttcctggagcaagaaaaccagtggttttcttggccgaagaagtgaagagaacaaacagcagaggataatttggtaatcagcatcctagtgtgccccagggtactctcttaaggaaatccagtcctggagcacacccagtatggtccagcctgctgtcttcgtaggtctgagtgccccagtatttgcaaagtgttttggagcctatgaaatgctttcacacatacaatctcctttaattaactctcacaatgactctgtgctatgtgtacaattatcacgttttacacacaaggaaactgaggcatggagcattgtaataatacccgagatcttctcactccatgaccaatgcttttcttctccattccagttgctttttcaactgtgatgatttataaaggacaatcaaatgggcacatactatatttatgcacatacatacacacacacacacacacacacacacacacaaccagatgtcatttataatccatgtaaaatatttttggggaagtttctctttaataaagtttgaagagacatatattttttttttttgaagaggcatattttttctaacttttttttttttttttgagatggagtcttgctctgtcacccaggctggagtgcagcggtacgatcacggctcactgcaacctccgcctcctgggttcaagcgattcttcagcttcagcctcctgagtagctgggattacaggcatgtgccaccatgcctggctaatttttttttttttgtatttttagtagagatgggggtttcaccatgtttgtgaggctggtctcgaactcctgacctcaagtgattcacctaccttggcctcccaaagtgctgggattacaggtgtgagtcatcacacccagcctataacttttttttaataggtgatagaatcccgtgcttgaaaaataatcaaacaaaaagagaatgcattgtaagaagcctcactgtactcctgtccccagctgcccagttctcccctcctccccacagggaaacatcttcattagtttcattaggttcttatgaaaccttccagagtttctttaagcaaaatacaagcaagtaggactgtcatatcctgcagaccgctacatacaaatacatagaaagtgtcctcattctatcctccagtgatattccattttttggctgaaccacctaaatgatggatatttaggggaagcaagtattttttaaaaaaggtaaaaatcaaaggtttttattttttatttttttaaagaaaagttggtaggctgtgtttattcattcagaagtcaggccgtggctgaactgatagctcttggagatggccattgctcatctctgaatgtctggttttctcttgtaagaattgtgtgtatgatccagaccttcagtgtgtgcactatatattgagaattccagaagagatgatatggacaagaaaaaaagatgactttactttttacagtaaaaataaaacttaaattgaagagtacaattgtttaaacaattggaacttacttagctactgcttgttgaaacaaaatcctttttttaaaaggtatcgaagcaaattaaagctgatccgtgctaaggaagaagacagtggccattatactattgtagctcaaaatgaagatgctgtgaagagctatacttttgaactgttaactcaaggtatgtaaagggagtataaagataatgctagctctgtagatgagtgtcttccaaggaaagcctggcacttttctccccggtcatggaagaaaagcagcacttaggggagaagcagtgtctgcatatgtcacatatcgggaatacctctgctggactcatgaattcaggtatttctgggaggttctgggttactctagagtaggcgaggaatccctaggctccaccagctagctttatttttgtagagatggagtcttgccatgttgctcaggctggtctcctgggttcaagctatcttcccaccttggcctctcaaagtactgggattacaggtgtgagccactgcacctggcctccaccagcttacttagcacctgcttctcaatctgagaagagagaagcagatgaccttagattgttctggagagttttgctacaagttttccttatagacattgtacagtggtccttaccagaagggagtgcccaagtctgtttacattcaggctcagcacctatccagagtcccagccatgagccaggtgctgtctgaggtgcgctcatgtgatcctcacagtaaaacctgtgatacaagcaacaccgtatatctaatttatttgaccacagatttagaaaagaatctttaaaacctaataacataccacagatgcattttggtaaatgctgctttagattatactttagctgaatccattagttgaatcctaagctataatataattttaagaacctccttgcctttcaagccaaataaccaagggactttctctctctctttccctccctcccttccttccttccttccttcttctctccctcccttgttatctcttttcctttcctttctctccttccttccctcttccctttttcctttctctccttccttccttccttgcttccttcttccctccctcctttgttctctcttttcctttcctttctctttttctttccttccttccttcctcactcactcttttcttttcctttctctccttccttccttccttcctccctccctcactctctcttttctttgcctttctctccttccttccttccttttcctccctccctccctcccttgttctcccttttccttccttccttctttcctttcttccttccttccctcttccctcactctctcttttcctttctctccttccttccttccttcattctcccctcccctcccccctcccctccccctcccctcccccctccccccctcccctccccttcccttcccttcccatttttcttctcaccatgttgcccaggcttgcctcaaactcctgggctcaagtgtttctcttccacctcagcctcccaagtagctggggctacatgtgtgaggcatcacaaccatggacttttcactttcttcactccaggttaaaaacatcacagggataaatctcaaaacaccaaaactgtgaaaatgctgctaaccatgtgggtctgtctaaactggagtgttacttgtacaactggtttcagcccctccggagtgttttgaatgccatgtagatgagttgtgaactcatattccactttgtagtctcatatgttctgggacacgagctattccattctgacttctttctgcctcttgcagttccttcatccattctggacttggtcgatgatcaccatggctcaactgggggacagacggtgaggtgcacagctgaaggcacgccgcttcctgatattgagtggatgatatgcaaagatattaagaagtatggaaaacagatgtgtcttcttctttcgtggtcagaatatttctcccttgacacaaatgatgtcaaatacattttacttattgactataagatagggttttgggtgtgatagcttcagggtgtgtatcttttgtcatgaatagctgtgagaagaaggtccagggctctcattagaccttcaaaatgtctccaatctaaaaacaagagtgaattttaagaaccactgttctaagaagatttttactaccctggctcacatatcttatttggtgaactttgtttggtagtcggactgcatgtaaacataaatgtgactgcttagtcccttatctgcccacctgctgtttggtgggttaattcgccattccctcctccctcccccgagtcctcagccttcttaaatgggcacatgagcaatgtgtttacacttcatccatggtaactggttgtgttcagaagcctcagttgtttcttcctctagacagagactcctcatcttaacttctagggctaagaacagacttggatgttgactggggtttctagtagattccagtgtggagcaggattctaggtcttataactcaatctgaggatcatcgcaaccctagtgacaccctaggggctcttcccagtgtgagtgttgagaagggagggctccaggcctttttgaaggggtgggagattgagatcattaaatatggttgaagttgaactgttcagtttgctcataggttcaagattggggaatggtagtcatattttattaaacttgattatctctgcctgctatgtaaacacttagctttcagttgttcatgtgtgagttattccctcttcagcacatgcagacaagttttaatgttcatctgcatgtaaaataaatcagtgtgtattgccccgaaatgcagacaaggtcccaactccttgccatcttagagtgttcccgtggctccactcattgccatgactctcaggaattggccctatacttaggccctttttctctctagatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccagtgagttcctcaacagtcaggacaactcatcagctgagccgcatctgccccaggcggaactttgaatcccagataggggttatatagaaatgaaggtcccaaggcagaaattcagttatgaatgctcttaaagtcatgtgggactttgttttattttgttttgttttttgagacagagttttgctctgtggcccaggctggagtgcaatggcacaatattggctcactgcaacctctacctaggacgttgttttagattcagatccaaaactgcatttttgcagaggcccctcaacattttgcttgtctaataatatagctacagtctctactttgaatgtctgtgtatgtggatggagtgtggggaaggatcttctgtctcattgctccttaaaagatagatgaagccaaaagcaatataagcaaaatgcaacttacaaaataagctttataataaagcatatgaagtagaggtgtctgcccatatagtagctgtcaattgcatttatcctattcaaattctgtccacaaggttactgttggagcaactttggagaaaatactgagttctcctgattgaattttgtccccttcttgtataaggaaagagttgatgtagtttcctgggtgtagatggtttgagagatggtactgcctatccctaaaatgaaccaggcagccctcacacttccccaccagcagtgagagattcctggctcagacacagccacactaccttgctgcccctgtgcatgtctgccaggaaacttttcattgtgcctctctctcttgtcacgtagccctgcgttctgaactcacggtggctgctgcagtcctggtgctgttggtgattgtgatcatctcacttattgtcctggttgtcatttggaaacaggtagatattttctcataaaactaaagatctttgaagccaatgagaacaagcatagcaacctagttcagtgcttggcacagagaaggagctcagcaattacatgtggagtgaacgttgttggactctactgtgtccagtcactgtgctgcttcagtgaagctctggtgcactgggactttggtaattcaccagttacctgtcctggtcatttatagaaaccgaggtatgaaattcgctggagggtcattgaatcaatcagcccagatggacatgaatatatttatgtggacccgatgcagctgccttatgactcaagatgggagtttccaagagatggactagtgcttggtaagttccatggggtaacctcccaagactcccttttcccttgcacacaactttacaatttataggccttggcagaatagagatctgagcttgtgcttagtaagaactaggcaatggaaatttgctttcagaaatacatttctgtcttgacagtaagttaattggatcattgcaatgatttttttaaatctctttccataacaaattatagttaaggaaaattttacaaagggagaagagaatatgaagagggctggcaaagatacccaccaaaattgcttttctttagaaatgacacaaattgaaaatgaatttctgtgactaaaaatgagcagatgagaaatgaatgaggacaaccacaaaatgtattttgattcagtacattctgaagatgcattagatactcctttttacatatttggaatatggaatataaaaatataggtacattttgaggcaaaatatgtaaaaataagcaagccaacttatcacaagcatttcaagtatttcaatcctgggctgagaccaagtatatgaagctttagtccaagggagtatttcttttttaaatcacattcctaatgaatgaaagcaagacaaaggcaaatgaaagtagaggtagaggttgtgttatgatgaatgatctaacagtatatatgttaaagaatgccaaatgcaggttttaattatccaccggtctcattgcaaaatacagaagagtttaagtcttcttagagagttaggtaaactgaaatcaagcaaggcaccagagtgaaatcacctttgcaaaaattgtaactgaggaaattatgacagtgaatgagatatgacctaaccaactccattttgctttagcctccaagttgtccttgttccttcctgggcataggccgaactaactttgagaggaacttagtttatagtttgactttgaaaaaaagacaataatagccctttgccaaaacaaaccctctttttccctgggaactagactgcctttgcgggactaacgaattagctacaagattagaaagtatggtttaggggtcactgttgtaaaacctgaggtcagtgcttgagatattttggagaccctgtatttcgatgcaccagctgacaccacccaggtcaataaactggctcatctgatcttggggcccctacctaggaactgactcagtgcaagaggacagcatcagctccctataatttcatctttgacccaaccaatcagcactccccttttcaccccctacccaccaaatcatccttaaaaaccccattcccccagtttcagagacactgatttgagtaatagcagaatagtagaaattcccccagtttcagagacactgattcgagtaatagtagtaatagtagaataggtctcccgtacagctggctctgtgtgaattaaaccctttttctattgcaattcccctgtcttggtaaatcggctctgtctaggcagcggacaaggagaatccatggggcggttataagagctgccccccaatttcaaatatttatatctaagctttctttattttcctgcctatttcccaacaagggatgaggagcttagggagttaaaaagtagtaaaatatggggaaaagggcataattcccattataccaagaggcattgctggtgaagcaatacctttccaggtacgattttcagtaacacagacgtgcagtaagaggcagtgttggctgttagtgtcttttatgagccaagtcttttcctggcttggctatccgtggtgagactgacaccccgggaaatgtttctctcagggtgagctctttcagggtgggacaacagcttcagtgtctttacgtatgtctcctcccaacatgaagctaattgctgtgctctcgggcatgtttagctcttggtagagtggctttcctaacaaatagggagcagtgagcccagcctgaagtttttatttagtcactccttagaatcagtgatattttgaatactgaagtatttccagtggctagtaatttactaagacaaaagatgcccctgtttgcatatggaaaacagaaggggagagagccaggaggtgtgggtgagagccccgaaggcaagaggatcccaggggctggcccagcacggagctggtagacagcgcgctcacaccagggagggctgcaccctcctttctcccgtctgtgttttctttcccttgcaagtgttattcgacaaaagcaattatgctaatttccttccctgtgggctcaattccttttttgacacgatgacttggaggagtcattatgattactccaaacaggaaagacactcgcccagctgtccgcccgcagagagctggctacggtgcagaaagctgaggaggcgtctggagtttttgggtgttaatgattctgcctgcccacaggtcgggtcttggggtctggagcgtttgggaaggtggttgaaggaacagcctatggattaagccggtcccaacctgtcatgaaagttgcagtgaagatgctaaaacgtaagtgctccttcctggggattttttgagcacggggattttttgagcatggggatattaagggaatttctcaaaatcatgcagctagtaaataagacatttaggactaggtcctgattattttgactccaggttttatgtgtatttagattaggtttatttagattgctcttgctgcctgtatgttggaaaattaagagcttgttatttccagtgacttctttttactagaaagaccaggaattagttattagcactgaggccaagtagctatctgcttcttttagacttctggtaaatagaatgatatccaatcacaggattagtcatattcttggtttttttctgagaacaggaagttggtagctcagctggactgatatgtgatttattctttcaacagccacggccagatccagtgaaaaacaagctctcatgtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaaaaaaaaaaaaaaaaaaaacttttttggtatcttatttttttctgtgccatatggtctgcaggacaattcatggcttttctgttcttcattttcatacccatctcctaacggcttttgtccccataggccccatttacatcatcacagagtattgcttctatggagatttggtcaactatttgcataagaatagggatagcttcctgagccaccacccagagaagccaaagaaagagctggatatctttggattgaaccctgctgatgaaagcacacggaggtgggtgcaaagagagatgttgctgtctatcattatcttacaggcatcacaaatggaaagacccatgtcctgatagatatcatgtctgcagattcagtgcccaaggtagcaagacttagagtcaaaccaccctgtccagtctttccatggtcatgcagagagatgcatgatgtctaaaggtgttttggactggggtgtcacatgggaaggccttgctgataggtttgaatgagagtgagttagaatgactctgggagctcttctgctatttacatgtgatccacttagacctataaaatgcagctctggccagggatgcttgagttctggaaccttgcaagaactgtctgtggatctccaagctcgaggtccttgctgaacctggacctataaatgacgtcaatgatagtgatccctactgcagaaatctacaagtggctataaagaactctgtaggtaagaaattctgtaagatcagaaagtacaatgaattcacttcataataaattacttggtggacaccaaatgggtgctaaattgattgggtagaaggaattgtatgcccaagccacatggccacacggctcaagttccaaccaaggcttgtgagttgaaaaactgagaaagaataatgacagacttaacgtagtgaattcttcaaactttaagtgtaatggacttacaggtccatgggagcacagccccactgtcttagatgtggctcttcaggatgtgcgggctcctgctaaggatgtgcagggaactggctctgaaaacaagtgaacagtagtcatcatggcagctgacatttgtggagtcctttgtatgtgccaggtgccatgacaaatattccgctagtctttcccatctttgtcagtgggatccattctacgtcttctgaaaagtgcttccttgacccccagatcaagtcattttccttacaagctattgaaacctttcttccttcacaacacagctgagtttgagttgatctgtgtatttattttgttttttacatttctttttttccctatttaaaaaatttttttatttccataggtttttggggaacaagtggtatttggttacatgagtaaattcttcagtggtgatttgtgagattttggtgcacccatcactggagcagtatacactgaacccagtttgtagtcttttatccctcacctgcctctcaatttttccccgagtccccaagtccattgtgtcattcttatgcctttgcatcctcatagcttagctctcacttatgagtgagaacgtacgatgtttggtttccatttctgagttacttcacttagaataatagtctctaatcccatccaggttgctgcaaaagccattaattcattcctttttatagctgagttacatatatatatatatatatgcacacctacacatacatatgtatagatacactgcagtttctttatccactccttgattgatgggcatttggggttggttccacattttttcaatatgtgaattgtgctgctataaacatgtgtgtgcaagtatctttttagtatgacttcctttcctctggtagatacccagtagtggaattgctgtgatgcatgtatttgtgcgactatttgattaatgctcatttccttgactagatcacctcatgtgaaaggtatggattggttttgcttttacccagttagctcccatgcctacctcagtacctggcacataatcatcatctactgaaagtggaatgaccacttcagaagggcaccctgggtaagatttctctttctgtttttacagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggtaaaagtgtctatactcactctgggtgttgggactttccagtggtttaatatgatacttaaagtatttagagggaagtgtatagggatggtaagtgaacctggcagcccacgtggtctctaaatgcaggtctgcacaaccagttctgtgacatgtttccaggtttgtggcctgtaaattgaaaagaataaaagctgacaatgtaacaaattttttaaactttaaatttaatagttttaaagaattttcttggtgtgttcctgcagtaaacattttttaaaaaaaataattatttattctgatataatgaacttccttttttattgctgtctttttcttttttaatgaaaatatggtgattgattttttttaatgcccttacttggcagaattacaagttggctgtcttatgttggttcctcaccttgctttttttcccttaagttttagaagtctctgatgtctatgagttcagtaacccttgcttttacttttcctaacattcaatttgtgataggaactctagagtagataatttgcagttatattttctggaccagtgtttctgttgaatgtattttgaaggtgggtctatctgtttttcaagtacatgaatatgtggcagggttaaattgatttataaactccagggagtccagctgatgcccagaccagatggatcacttcacatctgctcagggtggttcctccagagccctgaactggtcacagacatgaagctggaagtctgacattggcttgtcctgtgagcttgcctttttgggtctgagccttcccattagtcaatgcaaaaaagtgttgagctgccctggacattgttttggaaattattgatgtgctctgaatgttttcaggttcttaagtgaaaggtacaatccatttaaaaaagaatgtgtttgttttgcaaagctcagtacacaatattttccatttctgcggttccaagttccattcacttctcattgccaaatgggtgaacttccaagcgcttttaaaagattagccagtgagagttatcggaaccagtacttcctctcccctcccatattgttaaaaatagtttacattgcttcccaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgagaacttctggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaactactttttcatgtagcttgtatgtgtgctccatgtatttcatcatggaagattttagtgtgtgtttatgtgtatgtgtgttttaaaggtagctgagatgatttgctaattatggttgaaaaaaagaaatttaggaggtaaacaaaataattatgtgtaagattggtccttgtggctgtgtgtgtgttttgtgtgtgcgtgtatgtctctgtgtgttttaggctgttcttttattgctataaataaatacttgagactgggtaatttataagggaaagaggtttaattagttcatgattctgcaggctttacaggaatcaagatactggtagatctgctcagtttttggagaggcctcatgaagccatgaagtcatggcagaaggcaaagcagtgcaggcacatcacatggccagagcaagagcaagcgagagagagaaagagagaggtgccacacacttctaaacagtcagatcttacaagaagtcacttactattgcgaggacagcaccagaaggatggtgctaaattgttcgtaagaaatctgtccccatgatccattcatctgccaccagtccccacctccaatactggagattacaattcaacatgagatttgggtggggacacatattcaaactatatcatactgaccctggaccctcccaaatctcatgtccttctcacatttcaaaatacaatcatccctccacaatagtcccctcaagccttaactcattccagcatcaactcaaagtccaaagtcttatctgacacaaggcaggtcccttccacctatgagcctgtaaaataaagaacaagttatttactttcaagatacaatggggttataggcattgggtcaacattcccattcccaaagggagaaatcggccaaaagaaaggggctacaagccccacagaagttcagaacccagcagggctgaaaactccaaataaactccattgactccatatcccatgtccagagcacactgatgcaaggggtggagctcttgggagggatggaacaccctgtggctttgcagggtttagcccctgcagctgctctcaggggctgttgtcgagtgcctgtggtttttcctggtgcagagtgcaggctgttggtggatatattattcatggaggatggtggccctcccctcgtagcttcacgaggcagtgccccagtggagactctgtgtggggacttcaaccccacatttcccctctgcagtgccctagtagaggttctctgtgagggctccaatcctgcagcatgcttctgtctggacaccctggttttttaatatatcctccgaaatctaggcagaggctcccaagcctcaactcttaacactctgtgcacccacaggctaacaccacatggaagcggccaaggtttatggctgtcacaagctgaagcagcagcccaagctgcacctgaactcctttgagccacagctggagctggagtcatagggatgcagggagcagtgtctcgaggctgcacagggcagtggaccctggggctggcccatgagaccattcttccctcctaggcctctgggcctgtgatgggaggggctgccatgaaggtgtctgaaatgccttaaaggcctttttcccattgttttggcaatcagcctttgcctcctttttagttatgcaaatttctctagcaagtggttgcccagcagccctctttaattctctcccaaaaaagcttttactttctctgtcacatggccaagctacaaattttccaaccttttatgctctgcttcccttttactttttttttattttaaagagatggggtctcactatgttgtccaggctagtttgaactcttggactcaagcaatcctctcactcatcctcccaaagtgttgggattataggtgtgagccactgcgcccagcctctgcttctcttttaaatataagtttcaacttcaagtcatttctttgcttctgcatctgactgtaggctattggaagcagccaggccatatcgtgaacactttgctgcttagaaatttcttccaccagatatcctaggtcatcactctcaagttcaaacttccacatattcctagggcatggacataatgtggccaagttctttgctgaagcttaacaagggtgacctttactccagttcccaataagttcttcattttcatccgagaccttggcagcctggatttcattgtccatatcattatcagcattttggtcacaagcatttaaccagtctctaagaagttccaaactttccttcatcttcctgtcttcttctgagccctccaaactcttcttatctctgcctgttacccagttatctttacagcaattccccattccttgataccaattttctctattaggctgtttttgcattgctataaagaaatacctgagactgagtaatttataaagaaaagaggtttcattggcacatggattctgcaggctatacaggcatttgcttctggagaggcctcaggaagcttccaatcatggtggaaggtaaagggggagcaggcatatcacatggccagagcaggagcaagtgagagagagacagagagagagagagagagagagagagagagagaggtgccatacagttttaaacaggcagatcttgtaagaagtcactcacttttgcaaggatagcaccaaggggatggtgctaaaccatttgtgagaaattcacccccatgatccagtcacctcccaccaggccccacctccaatactggggattacacttcaacatgagatttgggtggggacacatatccaaactatatcattgcgtgtgtgtgtgtgtgtataatttttaaaccagatatatgtttctgcatatctctttcctttctttcattctttctatcttttttttttttttttttttttgagacagagtctcactctgtcacccaggctgcagtgcagtggtgtgatcttggctcactgcaactcattgcaacctcctcctccctgattcaagcaattcccctgcctcagcctcctgagtagctgggattacaggcacatgccaccatgcctggctaatttttttgtattattagtagagatagggttttaccatgttggccagactggtctcaaacttctgacctcaggcaatccacccacctcggcctcccaaagtgctgggattataggcataagccaccatgcctggcctatatatctattttctaagatagaatctttgcatagtgatattcatctgtgagatctaaacattctacaaaaaaattaagaaaatatttttggatgtgttctttgggcatgcctctgcaacctgatgatttcctgctgcctgccagcaccaatacatttaatttcttttctgcagactcagaagtcaaaaacctcctttcagatgataactcagaaggccttactttattggatttgttgagcttcacctatcaagttgcccgaggaatggagtttttggcttcaaaaaatgtaagttcaaggaacacagacctttttagacccagatttcagtgagtggagtgtggacggagatgctaggagatagatgttggaaaggccattaataacaggggcctcttacttacctgtctctctccttcatcccctacgcaggtcagggagtctgaaatcatcaggcatctactcttctctagagctttctctctgttgggagtgggtggagtgagaacctgggagaaggccagccctttatatccaggcagacagctccaagtgccaccatggatcagccagtcttgcaggggtgatgctattcagctacagatggcttgatcctgagtcatttcttccttttccatgcagtgtgtccaccgtgatctggctgctcgcaacgtcctcctggcacaaggaaaaattgtgaagatctgtgactttggcctggccagagacatcatgcatgattcgaactatgtgtcgaaaggcagtgtacgtcctcacttccctcactggtcaggctcatcctccttcactttaatctctaaagtcaggtgttgcttctagagattcggtgcctgttttttaaaacatcaatagatttcaaggggtcagtacactgccttggcagcagattgcccaggtttgagtgccagctccaccacttacttaatttggatttggggctagatacttgactgttctgcccctctgtctccctgattgtagtgggaggtgataatagtacctatttgctgagttgctatggggattaaatcaatgaattcatgtaaagtgcttaggacagtgcctggcatatagaaacagcactcaataatgttagctattttatttatttatttatttatttatttatttatttatttattttctttttttttgagacagagtctcactctgtcacccaggctggagtgcagtggcgcaatcttggctcactgcaaacttctgcctcccaggttgaagcaattctcctgccttagcctcccgagtaggtgggattacaggcatgcaccaccatgttcagctaatttttgtatttttagtagagacagggtttcaccatgttgcccagactggtctcgaactcctggcctcaagtgatctacctgcctcagcctcccaaagtgctgggatgacaggtgtgagccactgcatctggcaagtgttagctattaatatgtcaattgcgtgtatgcatggacaagcatgcattcccaaggatggtgtctttacattttaagcttttatcagattttcaaaagccatctgtgacccctaaaatagattggaaccatttgggtttatgtatcttggaggcacagtttccttaaagatactcattttgttgtctacttgaaccattcttcccatcccttccacttctcagcagatgacatagctccctgtggggatatatctgctccctgtaggtacaattccaaatcacctcactgcactggatgtgagacagcttatggcagctgctgcttccacctagagaaagacatgggcctgcatccatgctgtgtgtgattcatgtactcatgtggccgtgatagctgtaatcggctcatagatcattggatctgttcttagttttgttcccaggaatatctaaaaataggaaactggtccattcagggcttacaccttttgggtgaaaattcaggattaatgtttttggatattattcctttggaggacataaaaggcaatattgaccattcatcattcatctagtatttattgagcacctactatgtgccagggactgagagttcagtaatgaacaaaacacatgtaaaagacactcaaatgggacaagataattagcacaagttattaagagcccaaggggaacccttttctatttccactgctgtggatcatcagtgagtagacatgggtttaactgtctccctccttccttgcagacctttctgcccgtgaagtggatggctcctgagagcatctttgacaacctctacaccacactgagtgatgtctggtcttatggcattctgctctgggagatcttttcccttggtatgggcctgacattgctgcttatttgggctgttctgaaacaccactggaaggaaaatgtgttctttcaagccccaggatgtagacagtgttaagataacctggtgtgaggccagtatgctgcagccacctcaaaccacatgttgtgccttattgtgtctgagataggcccatgcaggtggagatgggggtttttgttgggggttgcgtcttactcctggcctctgcccctcctctcctttgggctatgccagagtgacttcctcccactggaagtggtcccaatgacattcgcatcccagctgctttttcattttgggctttgggtcacatgggttcacccatggagagtgggccctccctcacctggtggcgattgatgctcaggtgaaaaggggtacgtggcgggaagggcagggctctcattcctggttgtcattggccagtcttgacaacccaggtgctgaacaacccaggtgccctgggctatccggtgaggtccctaagagaaggatgagccataaccctgacatctggatggttcatctggggagatgagacttacacacttagggataaacagtgtgctgctgatttaaaattgtaatttgagtcttgagtaaagagaaaggagtcctggaatagtgtgggaaggcttcagagagggaacttaacttgacctggccttggctttgaaagtgtgaaatgtttcatgaatttatctgtgatcaggatgtaatagtaaagtgtgtcttcctgccccgtctcctttttcatcctagttctccctccatggatgatcacaatggatcatcccccagtggcttaatggagtcctgtactcccttaaaagcagagaggccacaactttgatttttgctttagctatttgaacatacctggtgaaaaagactctctgggttttaatgattcagaatttctccttgcttttctagttcattttgtctgtgttgatccagtagtcatacacattgaaaaacacttgaacgcttatttctaaagatgtagaatttttgtgatggtacttggacttgaccaacctggagtcctaattaaacttaaggtttgagctggtctctgaagtcaaggagatgatgacactgaattttcttgaaaaaaccagtgcttcaaggctataggatctgaaaggttttctaacagtgttctatcatgccaagtgtttcagcaatgcactgagcgtttgttagtcctggtgttttattgtttggcttttaggtggcaccccttaccccggcatgatggtggattctactttctacaataagatcaagagtgggtaccggatggccaagcctgaccacgctaccagtgaagtgtgagctccttccccatcccgggggcctgtgttcacagtctgtgggtctagggggagggaggggccctgagacttccccctgtgcccactcttgagttctgtccccacagctacgagatcatggtgaaatgctggaacagtgagccggagaagagaccctccttttaccacctgagtgagattgtggagaatctgctgcctggacaatataaaaaggtgtgtttggatctgtgggtggaaaggtctggataaagctggaagttataccagtgagctgtgctgttccgcagttctagaggagcattttcaaaagaggcaaaagactgtgtgatccagtggctgggcttcatggcggtgctccacgagaccctagtagcaatgatgaatgaaaaccctccccttcccgtggggctttcctttcatcttatatgtacagtacctgtaagcactattctccagatgtttgagtatcagaagttagtgtgcagttagaagactcagggcatccatggccattacatcactaatttgagtgcacttaaatccatgcgaaattggcttttaccagcggactggaaggaacaacctcagctgttatctgtggcaccagctggttttttgtggaatgggaagcattgttcaaaggaacaaatgtaatttcttggaaccaggcaggatatgtaaatgaatgaaacaactttctgctgaggtgttgagaggaaaactcagacataacctcagtttcttagattgagattagtccctgtgtagactttttatacttatcatttttcttccttcttctcaaggaggaatagtgttaggagattgtgtgccgaactggaagttaaatgcttctgtctgttaattatctcactgcccactacaactttcacaggtgaggcagtgaggaggcagaaggaaattaaccctcagttggtcaaagatgctctgactggtggaaatgtgttggtgggaagagattgaagttattgttgaaaatagggtcttttcacatccaatgttagacctctccaatgtttaaggatcatgaaggctttgggtattatccacccaatagaaggcctcactgcctctctatgggacccatccaagccctggaaaggcaacgtgatggggaccagaaggattctcagttgtagctactgacttggagaaggggctactggtatcttagcacctaatggcagaagctctttaccattggtggccccttcttcatgttctatgtctctggggatagttgacatgactctccttcaactaagtcccacatcttccaggtagtttggagatatgtacagttaaataatagtaagttctgagtgtctctattcatttttgaggtttggttgttaacacttgattaaatatgttcaatgaatgtttatagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacaggtagctgtgggggcagcctcggtgtctcacctttcccctcccctataggccctgaaggagaggacccattttcccgataatggtgcactcccggttggtaaatatgtactcagggacaagttgcagaatcctcaggaggtccacgtggttttgaaaatgcttcccagatgattctaatatgttccccctggggctgggagagggatgtgcatgttgtggggagagggacatgcttccctggtggagaatctttgagctaaattctcaggtaatttgatcaaattgatacagaactgtgattactgagatcatataagcctctcctgccattgtcttaaatagtcattgaactggggaaaaagtgaagagaggcgggactgggtcctttgacgctataccctacctgtgaattggaatcacctgcagagatttaaaaactgctgatctacaagcctcacccaaaacaacaaattagaatccctgggggtggtggccaactgctccctggctgatttgtttcttctttcttttaaattttgtattatggaagatttctaacgtgtgcacaattcacatagtatagtgagctgttcagtattcgtcacccagcttcaatgactatgccctctgccagcctggatgcacacatggccatgtctgtctctcctcagcctcctctggattgtttggaagcaaatcctagacaccttatcatttcacccataaatattccagtgtgtgtctcttaaagataagggctctattttaaagaagaacaacagttattaaaaataactacaatgccgttatctcacccaaaacagggacaataaatcgttaaggcatcaggcagccagttaaagttcaaattatctcacaaatattatcatactccattaaaaagtgggcagaggacataagcagacacttttcaaaagaagacatacctgcagccaacaagcatatgaaaaaatgctcaacatcactgatcactagagaaatgcaaatcagaaccgtgatgagataccatctcacaccagacagaatggttattattaaaaagtcaaaaaataacagatgctggtgaggttgtggagaaaaggggaagcgtatacactgcttgttgaagtgcaaattagttcagctattgtggaaagcagtgtggtgatttctcaaagaacttttaacagaattaccattggatccagcaatcccattactgggtatataaccaaaggaatataaatcattctaccataaagacatgcatacgtatgttcactgcagcactattcacgatagcaaagacatggaatcatcctaaatgcccattgacagtagactggataaagaacatctggcacatatacaccatggaatactatgtgttgataaaaaagaacaagatctgagataccatctcccaccagtcagaatggctattatttaaaagtcaaaaagcaacagattgtggcgaggttgtggagaaaaagaaacacttttacaatgttggttggagtgtaaattagttcaaccattgtggaagacagtgtggcgattccccaaagacctagaggcagaaatactgtttgacccatcaatcccattactgagtatatacccagagtgatgtaaatcattctattataaaggcacatgaatgtgtatgttcactgctgcactgttcacaatagcaaaatcatggaatcaacctaaatgcccatcaatgatagactggataaagaaaatgtgatacatatacaccatggaatacgatgcagccgtaaaaaggaatgagatcatgtcctttgcagggacatggatggagctggaagccgttaccgtcagcaaactaacacaggaacagaaaaccaaacaccacatgttctcacttataagtgggagctgaacgatgaggacacatggacacatggagggaaacaacacacactggagcctttcaggggttggggattgggtggaacatcaggaagaatagctaatggatactgggcataatacctgggtgatgggatgatctgtgcggcaaaccaccatgacgcatgtttacccatgtaacaaacctgcacatcctgcatatgtacccctgaacttaaaaagtggaaaatacaaaaatgaaattaaaaaaagaacaagatcatgtcctttgcagcaacgtggatggagccggaggtcactatccttagcaaactaatacgggaacagaagaccagataccgcatgttctcacttataagtgggagctaaaactacgagaacacatggacacaaagaggggaacaacagacaccagggcatagttgagggtgcagggtgggagaaggaagaggatcagaaaaaatacctatcggatactgtgcttattatttgggtgatgaaataatctgtacatcaaaccgccatgacatgtgatttatccatgtaacctgcacacgtgcccttgaacataaaataaaagttaaaaaaaaattatcatacacttgttttgttctgtctgagatccagataagagtcacacattgcacttggttgctatgtctctgtaagttcactatgtctctattttttgccctcttacatattatttgtgaagaaaccatagtgtttgcctgtggagttcccacaatcggcattttgctgattacatccttgaagtgtccttctcaggtgcttctgtcttctctatgtgttgtaaactggtagttagtctaggaacttaacctgactcaggttagatctttggcaaacatgcttcatagatggttctgtgtgcttctgtcaagaggtatgcactgtccagttgtctgccttttgtaacattatcagtcattgggtgatcattacctagaatttctttttttttttttttttttgagatggagtctcgctctgtcacccaggctggagtgcagtggtgtgatctcagcttactgtaacctccacctcctgagttcaagccattctcatacctccgcctcctgagtagctgggattacaggcacatgccaccatgcccagctaatttttgtatttttagtagaaatggggtttcagcatgttggccaggctggttttgaactcctgacctcaagtgatctgccggtctcggcctcccaagatgctgggattataggcatgaaccacctcacccggcctagattctttaactcagcaccaaggtggagctaatgcccaggcaggactgagaatcactggctgacgtggtcagatggaggagaccatgccccagttctccgctgtctttgcatggcccttggacagaggtaggagaaggtgatgatagtggcccctagttcaaggtccaagttgcttgtgtgtgtgtgtgtgtgtgtgtgtgtgtgtgtgttttcctcttctttcccatcagaacattattttggaggcttatgactgtgacctttgttaaccaatttaggtataatatgtagacagcccttgtttatttgtatggactgggtaattttgaaagtatggcttttctattttgttttagaatatgttatgtgatttgaagatgggacacagtggcccatcagtcttcggttttttattatgctttgctcaggccagtttttataacgtgtttatatctcttgagcatacggtgttcctccaagttttgggggtctgcgatggaacttcacgggggtcggggaaggctgggcagtgaatctagggctctctgtctcagatcctttctcaatttggttactttgtgtttgtgggctctgaataatatttgagttgtaagagggttctgcttttatataaagttagaaagtcacattggaataaataacatgagaaaggtgcccagaagttttctagggctacaacaggctgagctgcagaatttgacacgccaggaattgaactttctcagttgaagttcacgttcaagttaagtaacttgtgtggcatcacacagctagtaagtggggggaccattccagacctaaggctttctgactccagaactcccctttcagccacttctctagtacgtaaggagccgtcacctgggccctcaagttgggggttggtgggggggcatttgatgtcaagagagaggggaagagggcattccaggcaagtggcaggagatcctgagaacacagtttggatgctcaggaggcttccgggagagcacctgatgggcctggctgcagcttgcaccctgatgggcctgacttcaccccctgctctgccttcccaggcctttggatcaggcattgcttatgttctcttccactaggattgagtagggaaagtagaaattcttgcagcttgtcagtaactttgatgaaagacccagcagaaaagcaggaaagctgaagagtaaaaatgatgggtggaccttggttttccacgtggcctaccacagcatgtcaggcctgggggcagaatcttgccatactgtgcagcccaaatttgaatgccaaaggctttcgtttgtctctggggggccacagtctaggtctagttctgtgcaggagttgtaatatttgctcttctctccctcctccagctcgcagacctctgaagagagtgccattgagacgggttccagcagttccaccttcatcaagagagaggacgagaccattgaagacatcgacatgatggatgacatcggcatagactcttcagacctggtggaagacagcttcctgtaactggcggattcgaggggttccttccacttctggggccacctctggatcccgttcagaaaaccactttattgcaatgcagaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggcattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgtgtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagtt

SEQ ID NO: 36342 - DNA, 8331 bp, Homo sapiens
gccagctgccggtctttcgggggctccgtaactttctatccgtccgcgtcagcgccttgccaccctcatctccaatatggtatggcggcccttccatgatccccgcctctcccagaagccctgactcctcctgctttgcgccgtgcttttcctctgtagctcccttgcttcccccagcctcgggtgtgggtgtctaggccggggttctggggcaggcctgccgcgctcacccgtctgtctgcttgtctccctctacagcctggtccgacccccagtggcactaacgtgggatcctcagggcgctctcccagcaaagcagtggccgcccgggcggcgggatccactgtccggcagaggtaaggaaccctgcagttcgttcgcttccagactcggagataggacccagaacctcgctgattctggggtggagaccctagcatgtgaagattgacaaaggcaaaatgagcttctagtgacgtggccgtgggagtagttaaaggccttttgggaggaaggcgacattttttttctcgttgctcagtttagggcactactcttaaaaaaggaaagttaacaaactggaatagagtcagagataactttgagaaaaccgatgtcattaaactggtgtctctggacctgaggtttgcactcacatttccatctggcggccccataagcaatctgtcctacagataactcgtcctacacaaaacttagtctcttttcagctcagctctctcactctcaattatatctccttacttccatatggcactgttgtacactcatttactcagagccagaaacgtcagcgtcatcttggatttttcttatgctctttctctctctagtcatatgccagactttaaactctgcttgaaagctttctcataagctctttccttttccctttctactgctttgcatttgctacttaacccttttcttcaggctgtttgctttccagtccatcgttcgctctgctgttactcttctgcgtagtttctgttacttgttgctgaactaaaaaaaacaaacaaacaaaaaaaaaaaaccggggggataccaaagctcttagtggtcatttcagcctaacctttctttttcctttttttttttttgggatggaatctcactctgtcgcccaggctggagtgcagtggcacgatctcggctcactacagcctttgcctccagagttcaagcaattctcctgcctcagcctcctgagtagctgagactgcaggcacgtgccaccacacccagctaattttttgtatttttagtagagacggggtttcaccatgttagccaggatggtctcgatctcctgaccttgtgatcctccgtctctgcctccaaaagtgctggaattacaggcgtgagccactgcgcccggccttcagcctaatctttctttgctgtcctatgatccagcactcgtgaacccattactgttttctgaattcacaaactttctccctcatctcaaggcaaatttctacttattttccaagactaagctcaggggttatttcctcttgaggccttctctgtctgtaagcagcagtagctactagttttcccttttgcccccatagcattttgttcatatcattataagaccagtgatgtttccatatttatctccttcattagactttaacagagaacctgctcaagtcatttctatcccaggtacccaccataaggcatgacacaataaataatgactgaaggaaggaatcaagcaaccaagttgttttgggatttttgaaggaactagtggggttttatctagggaggaaaaaatcttgaacacatgcatggaaacttctgaaggatgtgaagagggatgtgacattttctggctgcaacaggtaaatctaaaactgatgatttgaacttacatgaaatatttcacatcagaacaaagacattctaatagaactggcagaaatgtaaaattatcctgaatgattttgagttccctgtcattgggatgttcatgaggagtgtatcaggctgtggtttaacttatatgggctttgagtgctgtccccttcccaccctgggttttagagatttttcgtgcaggaatggaaaacatgtcctgtgggtgcggttccttgggaatggttctgcttaatgagaattggtaatactgtggcagggaagtttggccatccgagaatttgtaaagaaataaaagaaaaagcacatatttatcaaatgtacatatgataatgaaattatttatttaatagtaaaaatgaaataactgatgcacaagtgaaatggagaactgaaacatttgaagacagacagatgcagtttttaaagtcgtgggtgttggtgtcatcttttaggattcagtgtgatagagctagtgtaacaagaaagaccatggttgtatgtattgagagacctgacagtgtttccttctagaatggtagtgattaagtatcatttcatgagtataatgtaataagtattggttgtttaagaatatctttgctttataagtctgagaaaacattggaagttaatgattcataatagtgctttggattatgttgtctgtagagctgccttctccatgcttgatgaggtgatagatactaccttggaggagaaatgttattaaatttaagctcaggccagagttggtgttcttgctctcctaaatacaatataaaaggaacttgctgtgaggagcaataatgctttataaactgtaaaggtgtgaagtgccacatagtgttctagcaggattaatgggaatcagggatattaagatggcggaatagccaccaatgtatagacatcaaggtattgaggtctactacatgccaaatgctgtttcatctccgaagatgggtctgtgaacaaggtaggcaaggtttgtactcatgaaccttatattccagtgtgggagatcaaacgcaaggaaaataagacaatgtaatttcaggcaataagggctatgaagataaataaagctgggtgggggatagagagtggtggggatagggcaaaggtaggtagttgttttagatagggtgttcacagtaggtaatacctgagtagatacctgaaagaagcaagagagcaaatcacacaatggtttggggacgaataggcctcctaggcaaaaggagtgggtaagtatgaagattctgaggtcgatgaggttggctttgaggagcaacagaagcaccatgttagaaccaagtgtgtaactggttagttttgaaaaccattgtgttgaggtatagaagggagagacagttacacagtggccagaaagaaagggtaaaatagcccccaaatacaaatttgagagattcaatgtgttttattaacctttacctagctacccctagggaatgggaagtattttgagtacactttagtatttctaggggctctggttttcaaatactcttctatgttccatgcgccagcagaaataagaaatcttaagagaagccagcctgactcctctggggctcctgtaattccaggaaactttgaagtcaggaactggaggtgtgatattgtggaaatagtaggaagtgcatgcgtccaagtcctggctcagtccatgactataatatgttcacactgggtttatcttctagcttaaaatccttttcaatgaacaaggaggaagatttcagctgcataccccacagatggaatgacatatatctgtgtgtgtgaaaccttttctaagggcatgaatctttctgtaaatccctgtacagttatgttttgccatttacaatcagttttcccataggaatggtcacacaatgaagttttaagttcccaggctaccacgtagtccataattaatgtgtctgaaatataatccttgtagtacaatagacccaaatcatggtttggcactgattgctttcaaagttctggcatgaacacagctcttcctgttagaaccaggactgcactctcccactccgtcatgtagcagggcaggctccccgtgctgtagacagtgcttcctgcattcagaatgtggagtaaagaccgtggttgggtaaaggaggcatgaggaccagaatggggaggaaagcaagaagagatggtagggatagggttttcacttctcttcttttccgtatatgcccttccctttttcaaaaatccagaatcatcagcccacagatactggaatgagattttgagggagggtatactgggatttgatgctgaatggtgcaggcagcaatgagataggcttcccctctcctccccactaggacttctgagttggtgatacatggtctgaagaaaattgcttgtgacttctcaccacttgccccttacccccatattgtaccactccaacatggggcacgatgagcagctggggttggggaagtactgcagggaagggtagttgctgggtggggttccccggtgactgagggcttctcccaaagaggagagaaaggattccttgggcctattccttggcagcagagtcctaagtgctgctaggctgcttctgtctgccagggctgcgtgtattacatagtgtatcttacaagccttgatccccttgtgagagacacaaggggtgttttggttgggtgttccctgcgttttttttacattctacctctctgtgcaagatctgtgatcactatattaaaatagtgaaaacacggccaggtgcggtggcttgcacctgtaatcccagcactttgggaggccaaagcaggcagatcatgaggtcaggagttcaagaccagcctggccagtatggtgaaaccctgtctctactaaaaatacaaaaattagctgggcatggtggcgcacgcctgtaatcccagctaagcaggaggctgaggcagaagaatcgcttgaacccaggaggcggaggttgcagtgagcagaaattgtactactgtactccagcctgggcaacagagcgaaactccatctcaaaaaaaaaaaaaaaaaaaaaaaaaacaaactagtgacaacacataacaaagtaattttttataaagtgtatactctatcttgggccctggatataattaaagcttaaagtttttgtctgtttgcagtaaatatactaattttaaaatacatcttttaaagtagccattttaagatcagcttgtatggattcagggcattttaaaacaggaatttattatttggcttcatgaaagatgcatgtgaggagaaagtgaaatgctttgtccacatgacacagctggatgttttgggcatgcagatgggctccagggtcagagctaggttcagccacctgttggctgcagggtcttagatattttgcttaaccttttctgaggccaatttgcctcatttataaaatggaaaaatcgtgactgcttttcagggttattgtatgcattggcatcaggtaggcacttagttcattgtggttatcatgatcaaaggagtaaaagcaggaatttaggtggattctagcaaagaaagttttttttttttgattccttaactgtgtaataatggtagcatatgttataatgctattctaataatttccagaaaaggccatttgtaacattttcctctctttcaggaaaaatgccagctgtgggacaaggagtgcaggccgcacaacctcggcaggcaccggggggatgtggcgattctacacagaagattcacctgggctcaaagtgtaagtcttaggaacagtccttgtgtttctgtccagtggcagcagagcagcagtggcagcactctgtctctgtcaccagtagcgtttgccttgatgcgatttactgtacacaacagcctcatttgtgccaggcggactgggtttggtttgcctgtttatcaaccgattaggcattgtagggccgggaatgacatcttttcatggagtgagggaaaggaaaggaagttcttcatggagctatgtcaaaataaatgagaacagagagaactggagggaaaactgcttaattagatgaaattgctcttcatttggtgatcttgccccgtaccaagaaataggagtaatcatttgaataggaattgggtgatttttcaaagttctcctgaaggcataagctgatattactacaacctgatggaggttttcccattaggctgtgttaccaggagttccttggcctctttgcctttggtgggtggtgagtagactcaggagggtgaacatgtaataccactttccaagttcttaggcattggagtgctcattaggtgatgggaaatgggtgtccagggacccctgtccccatgccttgctcagggtttctggtgctgtgtggcagatcttatcccacagatttctgttaggttccagaacaccactgcctacaactgtttcctgactaaactcggtggatgaggattcgaaataataacagcaactctgatttacatagcactttgtactttgcaaagaactttcaatgtctgttgtctagtttgatctgcccagcaatccagtgaggtgagagatgttaccattttgtagatgaggacctcaggttcaaagaggcaaagtgacatgctcaaagacacacaacaagaggtggaactggatattctgattaagtcctatgctctttgcatattgtccatctagttaaaataaaaaagacaaaattgaattaatttggattagttttaattaatttgaccagcaccttgactttagtttacaaagtcacaaatttgtaactttacaaatttgtaaagtttttattaattttaattagtttttataattttaattagttttaattaatttgaccagcaccttgactttagtttacaaagtcacaaaaggatcacaaatttagtttataaagccttccctggaattcttgttttctcttatattggagacttatatgataatgtgagaatatatctaggaagtaattcttggggttggggatatgtgaggtgggggtatcctgactgccaaccttttggtctttggtggaggtagtttgagtatttcagagagaatttttttttctcctttagcgacagggttttgctctgtcgcccaggctggagtgcaatggcatgatcatagctcattgtagtcttgaattcctgggctcaagtgatctttactccaggagacaaaattggataaatttggattaattagtcctgagtagttgggactacaagtgcgcactaccatgcctggctagttttttgtacaagcagaatctcactgtgttgcccaggctggtttctaactcctggcctcagcctctcaaagtgctgggattataggcatgagagggaacctcagagagaacatctgtagcccattgctcttcaggggactcattttaaacccttctcaagaaggttgtcttttaatttttaatttttatgggtatacaggtgtatatatttatgggttatatgagatgttttgatacaggcatacaatgtgtaataatcatatcagggtgtgtggggtatccattaccttaagcatttatcctttgtgttataaacagtccaattatactgttagttgttttacaatatacaattaaattattttttgctatagtcacgttggtgtgctagcaaatactaggtcttattcagaaggttgtctttaaataaatcttaatttgaaaaaaaaagtttggtaatgggttcatttgcactgaaagagttttcttctttttatttgagaagacaacaaatacatgaaattagattaatgtctccaagacatcagatcatttcatttgtatatgttttggtatgttttactaaaagataaggactcatcctttttaaacacaattgcagtgccatcatcacaccttcaaaagtatccacaataataattttagaaatattttaaaatgatacaaataatgtttctggatgaaccttgagtgctgcccaccttacctctacttttcccctaggcaatctttagtattgcagatctaatagtatattattactaaaagtaagcatgctttctcttcttatttctagtggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttatactg

SEQ ID NO: 36343 - DNA, 2643 bp, Homo sapiens
gctggttacagcagctctacccctcacgacgcagacatggcagcgcagaaggaccagcagaaagatgccgaggcggaagggctgagcggcacgtgagcgagctggctctaggccctcggaccagagacccgggagtccgggcccccggccccctcctccctcctccctcgagagcctggagtcccagccccgagccgcagaagtgttggccccggtctcctctaatgggaccctggagtctgggcccctagtcccctccctgcctgctgtacaggaatctggggtcccgggagggagtccaggcacccttagtccccttcttttgcgggggtctggggctccatcccggtccaccactgacccggccccaccccccgcaggaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtgtgagtgcctcccgggccccgcacccgcactagccccgaccggctggacccctcctctcgccgctcaggccccgcccttcaccgcccggtccctcctctcaccgcccagggccctcttctcaccgcccaggccccgcccccaaggattggctctgctagactaccttgtcaccaaagggccaggtcccctaccccaccatcaccctggccaggatgcagtgtgactaaatgtcacctggccctccctggtctccaggatgtagcttgccgcccgccggtggagaaggccagggccgtcgggctggcccagccccagctgtctaaccgctgcctccctgcactcctcctccagggtgacgtcccctatgttgctggtggctctggctgtctttttcggcgcctgttacattctctatctgcgcaccttggagtccaagcttgtgctctttggtgagaaaccccctgcccagatgaatccttggtccctcaaatcttggtcttttggaatgcagacagacctcagaccccaaatccaagtccttcaaaacccaagtccgcccaagcctagatgtacactagatcccccaaacctgatcccttaaaatctcagacacaaccgatccttccatcgagtctcagccccctcaaattgctattcctcaaacccaggatccacctggctgctgtgccttaaacctactccttttcaaaccacatgactcctcccctctctctcctccccttgccgctctctgcggccaacatcagctgcaggtgcccacactggacaccaggtggccaccttacactggcctagatctgttcccgtttcttttcctgctttctggggtgtgaccagaaagaacttggaacttagagagggaagccgaggagtatgtttcatgtggttcccagactagtagtaccaaggaccactgggaaaacaaaatgccaggggaaattccccccaggggaaaatcaaggtttggagtggggtcagggagttgggattggacagttaggtagacctgaaggccaggctcttcaggggcctgcaagttatgtgcttgatgggctggggtggagggagtgcctgaagcacaggcacgacttggcttcagctgatcaccgtcaccagagcatgtagaccccatccctgagacttctatgagaagcctgaagttggtatttttatgtgaaatcgttcactttgccagccacaaatcacatccttgcaaaacagctcaaaaaacacatccacaggtcagatttggcccttgggccaccagtttgagaccctggtctgcgcgagggttgcagcaggagagccctagtctagggagcaggaagccgggatcccaggaacttcctggaggatgtggggcagagggcagagggtggggctgaggcaggcgaggacggtgtgctgtgttctggagggcagtggggacagcaggggaacagggtgaccccaggacctggagggccttggcatgaggagtttggattcgatcccgagaacctggagcttgtacggattgttggggggcagcaggggttactctgggagagggcatggagagtcggaacagcaccccaatgccatctgcccccaggccgagaggtgagcccagcgcatcagtatgctctggctggaggcatctccttccccttcttctggctggctggtgcgggctcggccgtcttctgggtgctgggtgagtacagggtctgagcagctggggtggatggtgggagccaggtgcaggagtgtggccctgagctgccggctttcctgcaggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcagg

SEQ ID NO: 36344 - DNA, 69564 bp, Homo sapiens
cgtccttcctcagccgcgggtgatcgtagctcggaaatggcgggtaagttaccgggaaaagtttaccaaggggaggaggcggccagatcggggatagaacgccgagacggtggtgacaatgcccgcctagaactttcgggctgtagcctgggttccagaaggcctgcttgggaccggaagcgcggaactctcagcccagcagctccttgttggcggcggtccgcgcccccgcccccaactgcttggggttctgcgccttctgccagcaatccggcccctaccgagggccgaagacgccagggaaaagcgtcatgatttgggctcgtaaaatgccacatgccttggggcctgtttctcttcccattccttttgtccactgctgcttgcttcagctcttgtacatctggtcctgttcccgccagctgattttaatgctcagatcctcctcctcttccaggtctccgtctaccttccactacagtcaacttctgagctagcgcattgctgccttgccctgctctggcgctcccacttggatctcgactgacttcgtagtcgtctcgttaatctgtcacactttagtattccgaggatcgtatttagatgccctttgagaaagactttgttcctgaactgctcccttctcttttagggttggactactataatacaattctcttgtgtacattctagagacccttcaagttacaacatttaataatgtataattgctattactttgtacgtgtattaaggctgttttggtgtgattatttttttcgattacttatcttttgaagttatggacagtttctttttcctgagacagggtctctctgtcgcccaggctggagtgcagcgatcatagttccgggcagcttccaactcctcgtaggctcaagcgatcctcttgcctcagcctcccgagtagctaggactacaggcatgcgccacaacattcggctaaaaaaaaacaattttttttaaccttttagagacagagtctggctgtattgcctcaggccggtctggaactcttggcctcaagccatcctctcgcctcagcttcccaaagtgttggaatgacaggattgagccacttcgctggcctttgttgcttttatcatctctttacagggcattcctcatagtctctctacattaaccattccatttttatgaatatgtgggatagacaagctgttgtgtgagctctacagatgtttaaagaaggacttttctaccagatggagattgtaggatcttgaagtaccacagaagagggaggacgtactctaagaattacatctaaattcgaattttgggcccatcatttagtagttggatgcccttcaactaaacctctttctaagcctgaacttttgaatgtaaaatggggttgatgtaatacctacttatagaattgtgcagattgagctaatatatgatttcacaggttaaattttgttgcttacattcctcgaagtaaattctgtaatctcggttctgtagattagggtcagaggggttaagtaatgtgctctagttccctgagcttactagctcagtaagtgtgtgaaatagtcagaatccaggaattctcactccagactattaatctgtactgcttcaagtctttcccattttctgtgtgtgtgttttaacccctttttgaagtttatagcacatcattgtacccctttttattttttgcttatggcttttttctgtctgaatttttactgattttttttttttttggagactgagtctcgctctgtcaccaggctggagtgcagtggcgcgatctcggcaacctttgccttctggattcaagcaattctgcctcagcctccggagtagctaggactacagtcacgcgccaccacgtccagctaatttttgtatttttagtggagatggggtttcaccatgttggccaggatgatatccgtctcgacctcgcgatccccctgcctcggcctcccaaagtgctgaaattacaggcgtgagccaccgcgcccagcccatttttactaatcatatgcccattttgtcaggagatttgttatcttgaaagtttctcttgatagtgatatcttccaatgttatttattatgtatattattgagtagccactatgtagtaaaactattgtgccagtagctcacagtttatgactttaggcatacatgatttttaaatatttaatacagtggaaagatgttttctttgtgcccctgttcctcttccttctttctttacccatggtaactatggttaccagatatttgtgtattcttcttgagacattccatgcattatcatttccttatctgaagcactctggtagactttttccaatacttaaaatgaaattctgtcataattatcagaggacattctcattttgctttttacatcttataatgaaaaagacgacttaggtataaatcctagcaggtaatttgtattagtacatgttcagaaatgttagtaatctatcatgttaattttcaggtttattcatttatattaagtattcctagtttataagcctgtatctcaaaagtgatttctttttctgttttgtaatgaggcattctttttttttttttttttttttgagatggagtcttgctctgtcgcccaggctagagggcagtggcatgatctcggctcactgcaccctctgcctcctgggttcaagagattctcctgcctcagcctcccaagtagctgggattacaggcgcccgtcaccgtgcccggctaatttttgtatttttagtagagacgggtttcaccatcttggcgaggctgacctcgaactcctgaccttgtgatccacccacctcagcctcccagagtgctgggattacaggcgtgagccaccgtgcccagctggcattcttaatacatttatttaagagtatgtggagaatgacttgtgcttttatgatctatcagcatgttttaaatcatacccctattccacttataataaccctattgcaggtttgacaatttaagtcacttccaaactaaaccttttaaaaaccttttctcttaggatttggtgctatggagaaatttttggtagaatataagagtgcagtggagaagaaactggcagagtacaaatgtaacaccaacacagcaattgaactaaaattaggtatgtatgccatttctaagtgatgttatgtacatactgtgtgtgtatatataatctttcattttaaatttgaagtaaaattttatgtaagagcagttatttatgcaaatgtatggttttctgcatttattgaacatattcagattttattcagttttgatttatgtcatggaaggtgtagatgtttgaaaggtgacagaattttatataaaaaggaaagacggtggggcaaaaagtaataagtatatatagttttagcctcttaaaaatattttttacttttttgcctgtaagaataataaacaatagcaaatattggtgaggatgtggaaaaaaacacttgtatattgctggtgggaatgtaaagtgatataactattttggaaaacagtttggcaattttcttttctgtcttttttattttctttccttccttctcttctttcatttcctcccctcaccccttttttttctttctttcttttttaaagagacaaggaaggtctcactctatcacccaggctgtagtgccacggcatggtcatagctcactgctgcctccaacccctgggctcaggcagtccttctgcctcagcctgccaggtagctaggagaccacaggtgtgcaccacccaagcctggctaatttttataaaaaattttttttttgagacggagtttcactcttgttgcccaggctggagtgcaatggcgtgatcctggctcactgcaacctccacctcctgggttctagtgattctcctgcctcagcctcccgtgtagctgggattacaggcatgcgccaccacgcccggctaattttttgtatttttagtagagacggtttctccatgttggtcaggctggtcttgaactcccaacctctggtgatctgcccaccttggcctcccaaagtgctgggattacaggcatgagccaccacgcctggcttataaaaattttttcatagagatggaccctacgtgtctatgtgtccaggctcatcttgaactcttgtcttcaagcagtcccctggcttggcctcccaaagtgttgggattataactgtgagccacagcgcccctcctggtttgacagtttcttaagaagttaaacataaatgaattatatgacccaggagttatactgccaggtatctgtctactcaagagaaatgaaaatgtatgttcacgcaaaaacttgtacatgaatgttcatagctgcgttattcacagtagccaaaaaaatgtaagaaacccagatatatatcagctggtaaatgaataaagtatagtatagctataccacggaatactatttgacaataagaaggaatgaaattctgatacctattgcagtaaaccttaaaaagattgtgctaagtgaaagaaactaaacaaaaacaccatatattgtgtaattccatttgtatgaaatgttcagaaaagacacatccatagagacagaaagtagtggttgcacagtggagcgcagagtaactacaaatgggcctgacatttcttttgggaattatggaaatgtttgaaagttagattgtggcacagctctgaatttgctaaaattttacacttagaacaagtgaaaaataatatatgctcatgattcctggttgcattactttccatgcctgagtttcctcattgttaatagtacttcacagtggttacaaagattaaatatggagttaaatatcagtaaagtgtttaaactccttgacatgcagaaaatacttggtaagggctgagtggagtgactggatgtggttgctgagatctgcgtattttttttacatgtcccctcatttttcaattacttcattctttgatagtttgattaccttggaacatcctgtcatctgttgtctctgccccagccttggaatcagccatttctccaaggatccctggtttcttttagtaggaaatgttattttattttattttagagacagagtctcactcagtcgcccaggtagagtgcagtggtgcgatcttggttcactgcaacctctgcctcccagattcaagtaattcttgtgcctcagcctccgtagtagctgggattacaggcatgtgccaccagccctgggtaatttttttgtgtttttagtagagatagggtttcgccatgttggtcagtctgtctcaaactgaccaagtgatccacctgcctcggtctcccaaagtgctggaattacaggcatgagctactgcacccagccaggaaatggttttttattttgagatggagtctcactcttgtcacccaggctggagtgcaatgacgcggtcttggctcactgaaacctctgcctcctgggtttaagtgattctggtgcctcagcctcccaagtagctgggattacaggcacccgtcaccacacccagctgatttttgtatttttagtagagacggtttcatcatgttggccagactggtctcgaactcctgacctcaggtgatctgcccaccttggcctcccaaagtgctgggattacaggcatgagccaccacccccagccacaggaaatgatattttaaagccaagattcgggtgctaaagccaagatctaggtgctaggtgaacacattgctgttagtattgctctagcattaatgagagcaggcttagtagatagaactttattacttactgttcagtccctgccacctgcaaggtgactacagtctcatttctttgaccaaaattagctttctgtgttctagcactttatataaatggaattataccatatatactggctttgtgactggcttgtttcattaagcataatttttatgaggtacatcatatgttgtctgtaccagtagttcattccccattttttttgttgttgttgtttgagacagagtctcacgctgttgcttgggctggagtgcagtggcatgattgcggctcaatgcgatctccaccttctgggttcaagcgattctcctgcctcagcctctggagtagctgggattacaggcgcctgccaccacgcctggctaattcttttgtatttttaggagagacggagtttcactatgttggccaggctggtctcgaactcctggcttcatgatcgcctgccttggcctcccaaagtgctgggattacaggcgtgagccaccgtgcccggcagttcattcctttttattgctgaatactgttctgttgttggatacatcattattcgccagttaatagatatttgagttgtttctagtttttggctgttattgtatgagtttttttgtggacatatgattttattttggataaattcctagctgtggatttgctgggtcaatagggtatttgtatgtttaactttatgggatacttggccagactgacttccaaagtacttttatactcacatcaacagtgtattagaattttcgttattccatatcctcaccaacattttatgttgtcagtttttaaagttttaggcattctactgggtttatagtagtatttctttgttaatagtacttcatagtggttgtaaagattaaataggttttaattgtcttttccctcataactaatgctattaaggattgtttttttaatgtggttatcgactatctccttttggactcatgtattcacatcttttgcccattttaaaattaggttatttgtctttttgttattagttgtaggtgttatttacctacatattctggatgagtcctttatgcagattacatgttttgtgcacatttttctctcagtttgtggtttgcctgttcatattctcaactttttttgtataactggaagtttttagttttaatcatgtccagtttattaattttaaaaatttctattagtgttttctggttcatgcctaatatctttgtctaccccaaggagatcatgaagctctcctaatgttttcttctggaaggtttttagttttagcttattaaaattatgtccatgatccatctcatgttatttttcatgtccaatatgaggaaagggattaaggtttgttgttccatgtggatatccacttgtttcagtataatttgtgtgaatgccttggtgcgtttttaacaaaaaaatattgaacttacacgtgtggatctacatctggacttttctcattcattgtctgtttttctgtcaatatcgtactgtctggattagtgtaactttctattgattcctggtagtgtgagtcccacatctttattttttaaagattgtttcgattattcttgaccttatttctgtatacattttggaatcaggtggttaatttctatttaaaaagttctgactaatcttaagattacattgaatctaaaattgaatgtggggagaattgctatcttaataacattgagccttccagtatatgaacatgatgtatttctgtattctagaaatgtttcaggttttcagtcttgcatgtattttgttaaatttatctgagtaaatctacatcttttgatttttgatgctcttaaaaatggtatacttttttatttatttatttttgtatgtgtgacatgttctcactttgtcaccgaggatggagtgcagtagcgtgatctccactcactgcaacctctgcctccgagctcaagtgatcctcttaccacagcttcccgagtagctgggactccgcatacaccaccatgcctggctaatttttgtattttttgtagagacagggtttcgccttgttacccagactggtcttgaacttctgggttcgagtgatctgcccacctaggcctcccaaagtgctattacagatgtgagccactgtgcctgacctaaaaatgatatactttaaacattttctcttccaattgcttgttttatgtgtgtgcatgtgcatatgcatggacacacaatggcacagtttgtgtaattgttttgtattctgcaaccttgctaaattcacttattattgtagttttttgtattctgggctttttctgagagagtggctcactccattgccaaggctggagtagagtggcgtgattgtggctcactatagccttgacttcccaggctcaagcgaacctcccacctcagcctcctgaatagctgggactataggtgcgtgccaccatgcttggcaaaatttttttttttttctagggacagggcctcactatattgcccatgctggtcttgaactcctgggctcaagcaatcctcttgcctcagcttcccaaagtgctagggttgcagacataagccaccacacccagctataggatttttttttttagatgtagattatttcagatttcctgcacacaaacattacctgttaatgaagaaagtcacagtttttctttgccttatacagttgtccattggtatcttcagggatttggttccacgatcccccgtgaataccaaaatctgccgatgatccggtccattatacaaaatgccatagtgtggctgggcatggtggctcacatctgtaatctagcactttgggaggttgaggcaggcagattgcttgagcccaggagtttgagaccagcctgagcaacatggcagaaccccatctctacaaaaaatacaagaattagccaggcatgatggtgtgcatctgtagttgctactcaggaggctgaggtgggaggatctgcctgagcccaagagttctaggctgcagtgagctgtgattgtgccactgcactccagtgtgagtgacagagtgagaccctgtcttgatagatagatagccatatagccgggcatggtggctcacgcctgtaataccagcactttgggaggctgaggcaagagttcgagaagacaagcctggtcaacatggtgaaattccgtctctactaaaaatacaaaaattagctgggcgtgatggcacacacctgtaatcccagctacttgggaggctgaggcaggagaattgcttgagcccaggaggtggaggttgcagtgagccgagattgtgccactgcactccagcctgggcgacaaagcaagactgtgtctcgggggggaaaaacagccatatagtacagtcagctctttgtatctgcagattctgtgtttgaggattcagccaatctcatgttgatccgtaattggttgaatcagtggatgtggaacctgcatatgtggagagccacttgtgtttcattttcttgccttactgcactggccagaacctctattacaatgtcaaatggaagtgatagagtagacatccttgccttattcccaattgaagaaggaaaattttgagcctttcaccattcactatgatgttagctgtaggtttttcatatgtgccctttatcaggttgaggaagtttccttctattcctagtttggtgagagtttttattatgaaagtgttaccttctaatgctttttctttatcaagataatcataagatttttctcctttaattctgataatgtggtgaattacattgatgaggttttaagtgttaaattagccttgcatgccagtatattatcctttttctgctttgctagatttgacttggcaatgttttgttaagactctttgttcatgacaggtaatggtttcttttttcatacgtctttgcttgattttggtatcaaggtttcctggcctcataaaatgagttgggaactgtttcttctctatcttctggaagaatttgtataagactgcattattcctttaaatgttcagtagcattcaccagtgaagttttatgtgccttgagttttctttgttggaaggtttttaactatacatctaataaatagatttaatactgttctgatcttctgtttcttcttgtgtcagttttggtgatttttgtcttttaaagtatttctctattttatctaactttcttggcagaaagttgcttacagtattcccctgttaccatttaaatgactgtagagcgaggtgcagtggctcagacatgtaatcccagatctttgggaggccaaggcagaaggatcgcttgagcccaagagttcaaggccagcctgggcaatataatgagatctcaacaataaaataaaatttaaaaattagccaagcatggtggcatgcacccatagtcctagctacttgggaggctgaggtgggaggatcacttgagccggagaggtggaggttacagtgagctgcgatcatctcactgcactccagtctgggtgacagagccagacgctgtctcaaaaaataaaataagtgactctagaatctataatcccttcttgggggtattggtaattctttttctctttgtcttttaatgtctccttacaagtttaccaatcttactgatcttttcagcattgcctttgtctgttatttatctgttttcttaatctttataaattctttcatcttactttgggttaatttttttattccttcttttgagacaaggtcttgctctgttgccgaggctggagtgcagtggtgtgatcatggctcactgtagcctcaacctcttggctcaagtgaccctctcacctcagcctcctgagtagctgggactacaggtgtacaccaccacacttagctaacttttgtattttttttgtagagatggagtctcactgtgttgctcagggtggtctcgaactcctgggctcaagtgatcctcctgccttggcctcccaaagtgttaggattgcaggcatgagccaccttacctggtctaatttgctttttttaagatctttctttttaaagtagatgtgtatataattaactttaaactttccttttctaatactagcattaatgttataaatttacctctagttgcagtgagccaagatcgcatcactgcactccagcctgggtgacggagcaagactctgtctcaaaaaaaaaaagaaaaaaaaatttacctctaaatattgatatagttgcatcctaccaattctgttatgttctatttttattgctcaattcaaaatatttttaaatttcccttgcgacttcttttttgacccatgagttatatagaagagggttacttaatttccaaatatttgggacttttctagctgtcttattgtcactgatttctgaattagttctgtcaaggtcagacaatatagtcttatttcagtccttttaaattcattgagccttgttttatagcttatcatgtaggatctgtttggtcagtgtcctaggtgcactgaaaaataatttatagtctgcagttttatgtagtgttctataagtgtaaattgacttaatagtattaaagtcttttatatttttactgactttctagcgattaggacaattgagagaactgtcaaaatctccagctggaattgtggattgtctatgtcttcagtcattaatttttgcttgatgtatttgcagctctgatattaggtacatacagatttagacttcctatgtcttcttggtgaattgaccttactcattataaaatgttccatctttatctctgtcccctctttaacccatcttgcctcatatttaagtctactttgttagctattaatatagaaatgagaatgttttaaacctgtaagaaataacagcatgtttatatgctgatgccaatgatctatcagagaagggggaaataatacaggagtatttctggaagtatcagagaaggggagtatttgttgagtaatatccttgacaatgtaagaggggtaagtattttattaatcagtggaaggattagccttagataggagcatggagaatttctaccataacaagatgaaggagggtatacaggaattgctgcagtaagttagaaggtgtagaggaagcattttgtgcagtttcttttctgaatgcttctgtttcctaagtgagatagtaagcaaggtcatctgtggagaacgtgcttatagaagaaggcgttggagatttgaggaaatagtcatctaggtgagtgggaggagtgagtagacttgagaactgttaccattgtcaggtagcactaagggcccacttcaagttagttctcatgaatgtaaagtgaggtcagccacgtccagatgaaagtgtgccacaaagaatagacatatagttaaatttaactagagtgggttttttttttttttttttgagacagaattttggtcttgtcatccgggctggagtgcaatggcgcgatctcagctcactgcaacctccgcctctggagttcaagtgcttctcctgcctcagcctcccaagtagttgggattacaggcgcccaccaccacgcccagttaatttttgtatttttagtagaggcggggtttcgccatgttggccaggctggtctcaaactcctgacctcaagtgatccatctgcctcggcctcccaaagtgctgggattacaggcgtgagccaccgcgcctggcctagagtggttttctttttacgaggctgctatgaaaaaaattaaggccaaggggttgaggatgtttaggatggagtaataacattgatggaccatggaattctgcactggaaagggaggaaaacgaggatatgaagtagaagagggacagtgaaattatgttcaaatcaattcattgtggccaagcacggtggctcatgcctgtaatcccagcactttgggaggcagaggcgggtggatcacccgaggtcaggagttcgagaccagcctggccaacatggtgaaaccccgtctctactaaaaatacaaaaattagctgggcatggtggcacatgcctataatctcagctacttgggagactgaggcaagagaatcgtttgaaccttggaggccaaggttgctgtgagctgagattgtgccattgcactccagcctgggcaacaagagcaaaactccatctcaaaaaaaaaaaaaaaaaaaaaaaaagacaaaattcattttaagtcttggtgggggctgaagaattgttagaattggggtatggttgggtgtggtggttcatgcttgtaatcccagcactttgggaggcccaggcaggatgatcactttagcccaggagtttgagaccagcttgggcaacatagggagaccccatttctacaaaaaataaaatattagctgggtgtggaggtgcgtgcttgtggtcccagctactcaggaggctgaggcaggaggatcacctgagcctgggaggttgaggttgcagtgagctgtgattggttgtgccacaacactccagcctgggtgacagagccagaccctgtctcaaaaaacaaaaaacaaaacaaaaaagaattgggggtatagggagtgaggtaggaagataagtggtgatggtaagatggtacaatgtttgaaatagagattaaggaggtataattgtcaataatgataaataaaggctagggcacatcatgggaataagtggctaaggtacagtaaagacaaaattcttggggaggaatcaaggaactccaaggctggattggaagattcattttcattaattttgaagttaccaagatttaagtcagatgtagtgttggaaagtgcaacagtgagcctggagctaaattattcaaagaatgagggagagaggtggagcatgaactttaaagtggtttattcttagtgtgtggggagagagacattagtctgaaaccagcaatgaggagcaaggaggataccttgttctagcagtatgaagacagagaaaacaaccactacctgagaggtctgtaagacaggagcatccttaggggagagccatgtgtgccaaagaactgttagcgcaagataggagagcatttgataaagaggttggggatatggagaattttggtggtaactgacctctaagtttcacagtggtcacaatgagttgggaaggggtgggaaattagatgagtatttttatactactgtataatacagggatgagaatcccagtgataagggaatttttaagaattggactgctgttaatgggaataaagagtgtgatgggattaattatggcatctctagggaatatttaatgttgagatacctcattttgcagattgtttgtgctgatgggaatgttgccagcacactggggccactcttgtgttttaaaattatataattaagcttgtttttcaatttagcatgggtaggaaaagatgtatcgggcaatatgctaagatttcagttatttaaagaacacaggattatgaataaacttagatgtagtccagaatacaattagatactataccccgtgggggccagaatccatttatgtctgcattatgagcacctgttgatagatcatatatattaaatgtgttaaatacttaagtatttatttatttatttgagatagggtctggctctgttgcccaggctggagtgcagtggtgtgatctcggctcattgcaacctctgcctcccaggctcaagtgatccttccacctcagcctcctgagtagctgggactacagatgtgtgccaccacgcccagtgaatttttgtattttttgtagagatggggttttgccgtgttgcccaagctggtcttgaactcttatgtatttattaaacaagctttaaaaattgattaaaataatgtgccttggtgatttcttaattttacttttggttaataagacatgtagactatatcttctttcatgcatcttgcctctccaaaactactgaagtgattctaagaactaggaagtatatgaacttattgccatacatggtggtttgtgcctataaaaaggtggtgccactgacagggacacaaagattggaggggagagctggctctggtggtactgttgctggtgatagttgaagccaggaaaaaagatgagctctgaaaggaacacactgtgaaagaagggcagaccaaggaccaagtcttggaaaatgcctatatctaagggagtggcagcaaaagaaaccaggttaagtcagaaaaacaaggaggtatagtatataagtgagaaaggaagaataatatttcgggtagaaaaagagtttaataacatctactgttatggagttcaaggagagtgaagaaaagcagaacagcactaattgtacaataaagtcatcagtaactctgaaatagaagtagcatgatggttaattatagtaatggagctgtaggaaaaagggtggctgagggaggaggatcacttgaagccaggagtttgaggccagcctaagcaacatagcgagaccttgtctcttaaaaaaaatcaaacaattagccaagtgtgtggtacacacttatagtctcagctacttgggaggcttgagcacaggagatcaaggctgcagttagctgggattgtacactgcactgcagcctgggcaacagagcaagaccccatctatctatctgtctgtctactgattctctctctctctctctctctctctctctctctctctctctctctctctctctctctctttaaatgaactgtaagagtagaaacaatagggcagggcaggcatggtggctcacacttataatcccagcactttgggaggccaaggtaggaggattgcttaaggctagaggagttcaaaaccagtctgggcaacatagcaagactctgtctctacaaaagaaagaaagaagcaacagtaaatatattcaaaaggaagaatcattgcaggccctatgttctatatagcagcagtccccaacttttttggcaccagggaccagtttagtggaagacaatttttcttcagaccagggagggaggtttgcggggaatggttttgggatgattcaagcgcattacattcattgtacactttttctatttacattgtaattataatgaaattattatacacctcactgtggaatcagtggaaaccctgagcttgttttcctgcaactagacagttccatctgggggtgatggatacagtgacacctgaagtgtattgcttatgtccagtctactctgtaatctcgttttggttgctgtcattgcagaaaaccctgcctcacaaggataagatgttgagaatggaagcaggcttttcagtacttttctggcaatctcaggatgttctgccttgattttaatccagaacataaggagatttgaagttgtctgaaacatattttttttttttgagacagggtcttgctctattgtccacactacagtgcagtggtgcagtctcagctcactgcaacctccacttcctggattcaagtgattctcgtgcctcagcctcccaagtagctgggactatgggtgtataccaccaaaccccactaatttttgtaattttagtagagacggggtttcgccatgttgctcaggctggtcttgaacccctggactcaagcaattcgcctgccttggcctcccaaagtgctgggattatagatgtgagccaccaggcccggcctcatacacacttttaaggccaccttcatttgctgtcttaagcagttgaccctattccagcacggataaagtcgattcacctgacttattcaaaaatgggtcacggatccattccttcccagttcagggttcttttgtggttgggaattaatgctcaaactcttttgaaagctgagataggtgatcgtgcaccagctggaagtaagaggaccctgtgagccagggcctttcaaaatctctgctaatgtttgaaacatgtcaacaaacccagtgttcgctcgtcaccctaatacttctgctttggctttgaatgcagccactttatctgccaacttgaacacaattgttgttctcccttgaagtgatagatcaagtttgttaaacaggttgaatatgtcacaaaaataagcaagttttgtgacccattctgtgtcactgaaatgtgctgcccgtggtgactgtttttctaaaagaaatctctggagcggctgttgtaactcaaaaactttagccagtgatctacttttagaaagctatctcacttctgtgtataagagaagatatgtgtgatctgtgtccatttcctcacagagcaatgtgaacaggtgtgaggtaagggcatatactttaatgtggttgataattttaattacgtcctgcaaaatgtcaagttcaggtgacattttttagctagccagcattactcaatggatgaaatagtgcgtagactcacatttggaaacaactcctttttttcttttttttttttttaagacagggtctcactttattgcacaagctgactgctgtggcgcagtcatggctcattgtagcctcaacttcctgagctcaagcagttctgcctgggactacaggcacatgccaccacacccagctaattttttattatgtgtagagaaagggtatcactgtattgctcaggctagtctcaaactcctggactcagcgatcctcccacctcagcctccaaaagtgctgggatcacaggcatgaaccactgtgtctggccaaggtgacctctttgacctgaataatgaaaccagaaagctgtccagtcatggcagccacttcgtccatgcatataccaacacaaaatgaccaattcagtttccctgatatgtaatcattcaaagacttgaatagttctgcagtgtggtattggttggcaagaaaagtacacataacgtattctcatgcacatcctcctgaaaaatatattgcacaaaaacaagcgttgttgccttgttgtcaacattggtagactcgtcaacctggattgtgcaccatggtgactcaaccctctctaacaattgtgcctcaatatcccctgctatttcattagttcttctagttatggtatgagcctaaggaggaacacgcgccaccttttgaattcgagcctctcctaaaagttcacgacaaatgtccttagcagcaggcaggattaactcttcaccagtagtaaagggcttcttagttttagcaatttggttagccattaagaatggagctctcagtgcagatgcatttgatgaagtggtggccttcaataaattgcttctgttcttcatgttcatgtttttttcttttgaaaactccaaaggcttgtcttttaatgcagggtgcttggtctcgatgtaactaagcagttttgaaggttttgtggctttgttggatagctggtcaccatgtactatacaaagagggcttggagaatgtgaatcacctgttgcagtgaacccataatttaagtaggactcttggtattttaaatgcagctttctttttgttggcagtcttagagtcttctgctgtctcatcattgggtctttcccctttttcaaagaagctcttcagtgatatttgtttttcactcattttgactagggttagcaaaaagacttaccaaaactgtgactgagacaagtgtacagtgtgagaaagaggcacagatggaagtcgcaaataaaataatgggttggcaacatggggactaaaataaatgttggattctgacttaaagcctgccactagatgtagctgtacaatggaactacatgaactcacttgccattataaagcctgccaccagatgcagcttagttgtcacttgccactcactactcactgatagggttggtgttttttttgttgttgttttgttttttttgagacagagtctcgctctgttgtccaggctggagtgcagtggcgggatctcggctcactgcaacctccacctcctgggttcaagtgattctcctgcctcagcctctggagtagctgtgattttaggtgtgtgccaccacagctggctaagttttgtatttttagtagtgacggggtttctccttgttggccaggctgggctgatagggttttgatatgagtctgcaagcaattgatttattatggtctctttgcagtcaaacctctctgctaacgttaatctgtatttgcatccgctccccagtgctagtatcactgcctcagctccacctcagatcatcaggcattagattctcataaggagccgtcaacctagatcccttgcatgagcagttctcagtagggtttttgctcctatgagagtctaatgccaccactgatctgacagaaggcggcgctcaggcagtagtgcaagcagtgggggacaactgtaaatacagatgaagcttttctagcttacccattactcatctcctgctgtgcagcctggttcctaacaggccacaaaccgatacatggtgtttgggggcccctcctatagagcaataaggtgccatttagtattccaggccctgagcttccatttttctacaaaagtgtgagtgacatagattttttttgtttttgttttttgagatggagtcttgttctgtcacccaggctggagtgcagtggctcgatctcggcttactgcaacctctgcctcctgggttcaagcaattctcctagttcagccttctgagtagctgggattacaggtgcacaccaccacacccagctaagttttgtaattttaatagagacggggcttcaccatgttggccaggctggtcttgaactcctgacctcaggtgatccacctgccttggcctcccaaagtgctgggattacaggcatgagccactgtgcccagctgcaacataggtttttagtgcttattttgaattgtttcagttttttatactatattttttttctgagtattgtggtaatatatattttgcagaaaatttggaaagtagataaaagtatatgaaataaaaattatccataattcatcactcaaaatacctacctctgtattataatttggagtgttttcttctagtatttttttattatgtattcatttctattgtttcccttttataaaatcgaggttaccgtatcatgttctgttcacttaactctgcattgtgaacattttcctatgtttgtcatgataacatgtttaataattatgtaagccatttcatgtatttactgtaatttatttaatcattcacctgtgacatttgggttgcttgtttgctgtactgccatacctgccttataaagacttgaaaatatttaatgtttctgatatcctggagaaagttcacattttgtacatgttctcaagtaacatatatatatgtgacatatatatgtcacactggttgaaccttagatccgccaaataccaacttttagttcctattttctgtggaccaaattttatgggaaaatattaaaacctcactaatttggatgacaggggcatcagaagaaggccaatctgaattttagaaattattatcataactaggcttaagacaacttttcttactcattacttgttcttttctctatgtctttttacccatcactaccaaaatgtcatataatatacatattagtttgaaaattaatttttcacaatttctagattttccaaacattttcaaacattagagatgtagtagttgtgaatttttaggttagtgagtctggacatatttgacttttttttttttttaactattacaggcatacaaaaaatacagtgctggctgggcacggtggctttgcctgtaatcccaacactttgggaggctgaggcgggcagatcacctgaggtcaggagtttgaaaccagcctggccaacatggtgaaaccccgtctctactaaaaatacaaaaattagctgggcgctaatttttgggtggcgggtgcctgtaatcccagctacttgggaggctgaggcaggagaatcacttgaacccgggaggcagaggttgcagtgagccgagatcatgcaattgcactccagcctgggcgacagagagagactctgtctcaaaaaaaaaaaaaaaaaaaaaaaaaaaggaaactaagcaatatctctgatcccatcactctgctttttcaagtcttaacatttggctgcatttgcctaagcctcttttttttctttaaatttttgttatgaaacattttaaacacagaacaattgagagaataaaacaatactcatgtatatttaacacctagattcaacagttaacattttgccatatttgctttagtatgtgtgtatttttgctgaattatttgacagtaggtatctaaacatcatgacacttccctatagtatatctcctaatatatggacattcatatatatatatatatatatatgtatccataatagtgttatcacacttaagaaaattaatggtaattttttcaatactgcgtaatttctggtttccctagttgccatcaaaacactttaatagctttaaaaaaaattagtccaggcatggtggctcatgcctgtaattccagcactttgggaggctgaagtggaggatggcttgagcccagaaattggatacgagcctgggcaacaaagacccccatctgtacaaaaaatttaaaaaattagttgttcatggtgatttgcgcttgtagtctcagctactttaaaggctgaggcgggaagatcttttgagcccaggatttcaaggttgctgtgagctgtgattgtgccactgtattccagcctgggtgacaatgaaaccctgtctcaaaaaaaaaaaaaaatacttaaacaaggatccagtaagggattgtgcactgcatttagttgtaatgtttcttaaataatctcttttaatacagagcagtccctttccgtccacatgcaacttttcccctacatgacattgatttatttgggagagtaaagtcattgcacagataaatgtacattctggatttgtgtatttccttttgatattagtttaacttcctcctctatcctctgtatttcctgtgaattggaaggtaaaaagcttgattagatttaagataaaaatttttggtgagaaaacttcatgggtgatgcagcatacagttggtccttgaacaacacgacttgaactgtgtgggtccacttacacatggactttttttcctaccaaatgcagatagaaagtacagtgggacaccagacagaactacaggacttgagtatgatggattttggtacagtcaggggtcctagagccagtctcttgagtatactgagggatgactgtacttcatattgcattgaatcaggaggcacataatgttgttctgtcccacaatgaatgatgctaagttagatcatttggaaaggaggtgactaccagatctctacagtgaaaatataccttttcttctgtaaattagtaatatgctggtgatactttggcatgcagggagtgacctggtctgtgaggacagtgttagaaatttttcatctacagtttatcttcttttttccccctgagacggagtctcgctcggtcacccaggctggagcgcagtggcacaatctcagctcaatgcaacctcctcctcccaggttcaagcgattctcatgcctcagcctccagagtagttgggattatagggacctaccaccatgcctggctaatttttgtattttagtagagatggcatttcaccatattggttaggctggtcttgaactcctgacttcaagtgatctgcctgcctcagcctcccaaagtgctgggattacaggtgtgagccaccgcgcccagccctccaatttttctttacattcttcaattgcttaagaattttttaatgaataaaattttcttcctaagataaattttatcagggaactatctagtatttcagtactcacaacaaatacaaataaaaataataaaaggatacccattccatcttagattgatagaaattgaagtcgagggtacagagtatccttgagtacagcagagtgttctcaaggatgtagggagcaaaggagtctacaagctatgggtatataaactgcttgtgggtgtataaactgttacaatatttttatagggcactttagctagctagctagctatctataattttttttttttttttttttgagacagtctttgtcgcccaggctggagtgcagtggcatgatcttggctcactgcaacctctacctcctggatttaagcgattctcctgcctcagccctctaagtagctgggactacaggcatgcgccaccatggctagccaattatttatttatttatttatttttttgagagagagtctcgctctcttggccaggctgcagtgcagtggcacgatctcggctcactgcaacctccgcctcctgggctcaagtagttctcctgcctcagcctcccaagtagctgggattacaggttgtgtgccaccatgcccggctaatttttgtatttttagtagagatggggtttcaccatgttggccaggctggtcttgaactcctgacctcaggtaatctgcccacctcagcctcccagagtgttgggattacaggcatgagccactgtgcccagcctaatttttgaatttttagtagagatggtttcaccatgtcagccaggctgggcgtgaactcctgacctcagatgatccacctgccttggcctcccaaagtgctgggattacaggcatgagccactgcacctggccactttagcaatatttatacaaatatttcagtactctccccctagttttctgctgccaggaatttcccctgtgtatacttataaaagtacagcaggatgtatataaggatgtcattgcagtgttatttttaatagcaaaaaacaaacatgagaacaacataaatgtcatctagcagtcaaaaagaatgacttcatcaaactcaggttattgttattatcagaatgtttcttacagcattctgttttcatttgctgtaacttcttacctcaaagtgtctttttgtttttcctttactcattgcattgtgcataaacatggaaaaataaaaactaaatgaggtgcctctgtcatacttagccttctgattcttagaataagtagggttttgacgctgaagcactcaaagtaatattttaattttctttgttcactagtctcttgagaatacagtgtaaataaatcatataatggtgaaatgacacttttagtaagaaaaatgttggctgtatcctagttatactgaaactcatgaaataggaatacctgtcaccttcaatatctttagttatctttaatatctctatttttttgtcccttgaaacagttcgttttcctgaagatcttgaaaatgacattagaactttctttcctgagtatacccatcaactctttggggatgagtaagtaacttagtaaaatatttgtcaaattagtatggaaaaaaaaattttcattctttttcttttagatttagaaatcaaattttattttcttcttatttttaatgtggtttatcttaaaatatatgttataatggtgtttttttacattgagacaccagttattttaatacctaccatttagtgctgtaaatgcattatttaattctcacagcagtattaatgatggtattattatttgctgctttgtgcattgatagaattggataattgttcatgaacatacaaatggctggagtatagattttaggcaatctgactccagagcccataatcataactactacttttttctgctaccattttgctaaattacttctagtagcatgtattcccctaaagctgtaatagaaagcttaagttgttattctatgatcaaataagcagttgagagaagtttatttatttattatttatttatttatttttgagatagggtctcgctgtgtcacccaggctggagtgcagtagtgtgatcaaagctcactgcagcctgaacctcctgggcataagcagtcctcccacctgagcctccgagtagctgggactacaggcacacaccatcatgcctggctttttttaaaaaattttttgtagagattgggtctccctatgttgcccaggctggccttgaactcctggcctcaagtgatcctcccacctgcgcctcccaaagagctgggactacaggcatgaaccactgtacctgccctgaagtttattttttagaaggaactttaaatatatgtcccaggccaggcgcagtggctcatgcctgtaatcccaacactttgggaggctgaggcgggcagattgcctgaggtcaggagttccagaccggcctggctaatatggtgaaaccccgtctctattaaaaatactaaaattagccaggtgtagtggcacacgcctgtagtcctggctactcgggaggctgaggcaggagaatcacttcaacctgggaggcagaggttgcagtgagccgagatcatgccactgcactccagcctgtgcgacagagcgagactgtctcaaaaaaacaaaaacaaaataaagatatgtcccagtatatttagcactgttctttaatttcctatactttgattacatcattgaaatagttacttttttaaaaaaaacttttgattttgaaaacattgcacatttgcagaaagttgcaagaatagtacagtgatctctgtatatttttttacctggattcaccagttgccatttagctacatttgctttaatcattctctccttgttgttgaaccatttgagagtaggttgcagatctatcctgatcctttacacctcatttcttttcactatgtatttcctaaaaataagattaataaccatggaagagttgtaaaaattcaggaaatttaacattgatacagagtctcgcgttgttgcccaggctggaatgcagtggtgctatctcaactcactgcaacctccacttcctgggttcagatgattcttctgcctcagcctcccaactagctgagattacaggcgcccgccaccacacccagctaatttttgtatttttagtagagacggggtttcaccatcttggtcaggttggtctcaatctcctgacctcaagtgatcacccaccttggcctcctgaagtgctgggattgcaggcgtgagctaccatgcccggcctgatacagtactatcttctgatatacagctcatgtttcagattttgtcagttgatttctagtaattcctttatagcaattttctccaatcctggatccaatacagaatcatattgtatttcgttgccatatctcttcattcttctttaatctgaaacagatcctcagcatttgttttttcctaacagacatttttgtagggtataggctaattttgtagaactgttatattggattaatttgattggtttatttgtgattaaactcagataatgcatatttttgctgtgccattacagaaatggtattgtgtcctcagtgtatcacatcaggaagtccgtgatgtcagtttgtcccttgttggttaagttaacttgggtcacttggtttagaggtggctgctaggtttttccactataaagttagtgttttttcctttgtaatttataagtagtttgtagggagatactgtgagaccgaaaatatcctgttttcctcaagctttcacccagaagcatccattaatgattcttgcttgaatcagtattttactatgatgattgtaaaatggtaattttgtaactcttttgtacctttttcatttattagttgggcatgctactataagaaagagctcttcttcttcttcttatttatttctttatttatatcaaactcagggatgcttttttttgtttttgttttttgagacagggtcttgctctgtcacccaggctgaagtgcagtggtgcgatcacagctcactgcagccttgaattcccaggctcaagcagatcttcccacctcagcctcctgaggagctgggactataggcgtgtaccaccatacccagctaatttttaaaaattttttggccgggtgcagtggtttagacctgtaatcccaaaactttgggaggccgaggcgggaggtttgcctgagccaggagtttgcgaccagcctgggcaacatggtgaaaccacgtctctactaaaatacaaaattagccaggcttgctggcgtatcctgtagtcccagctacttgggaagctgaggcaggagaattgcctgaacctgggaggcagaggttgcagtgagctgagattgcgccactgcactccagcctgggcaacagagtgagactctgtctcaaaaaaaaaaaaaaatttttttttaagagatgggggtcttcctatgttgaccaggctggtcttgaactcctgggctcaagtgatcctccaagtgctgggattacaggcgtgaaccaccgcacctggctaaggagtcttttacaattcagtgggctatgtacaatctgttactgctactaattttgatgctcaaattatcccagatttggcaagtggccaccctttcagacacttttgagtctttctgatatgtccttataattttggtgatactttactttctcacacaacaagatgtttccagattcatctggtactttccctgttagttctggagtcagtcagtctcccatggaacccctggtttgttgtagtaggaaagggtatttagacatagtggacatttaaatatttcccttcatgtcttttttccccccatgcattattttaacatcattgacatatttctttaatgtgtgggggttttgggtttttttgtttgtttgttttttgagacggagtcttgctctgttgcccaggctggaatgcagtggcatgatcttcttggctcattgcatcctctgccgcctcccagttcaagcgattctcatgcctcagcctcccgagtagctgggactacaggtgtgtgccaccacacccagctaattttttttttttgtaattttagtagaggcggggttttggcatattggccaggctggtcccgaactctggagcttagacagtctgcctgcctcagcctcccaaagtcctagaattacaggcgtgagccactgtacccagccatatttaatgtgtggctttttttgttgtttgcttgttttttgagatggagtctcactctgttgcccaggctggaatgcagtggtgcaatcttggctcactgcaacctccgcctctcaggttcaagcgattctcctgcctcagcttctcgagtaggtgggactatagacacgtgctatcccacccagctaatttttgtatttttagtagagacggggtttcaccctgttggccaggctggtcttgaactcctgacctcaggtgatccacctgcctcagcctcccaaagtgctggcattacaggcgttagccactgtgcccagccttaatgtgtgttttgttttgagacgtagtttcgctcttgttgcccaggctggagtgcaatgaatggtgcgatctcggctcactgcaagctgcgcctcctgggttcaagtgatgctcctgcctcagcctcccgagtcgctggggttacaggcgcctgccaccatgcccagctaatttttgttatttttggtagagatggggttttgccgtgttggccaggctggtgtcgaactcctaacctcagatgatccacccacctcggcctcccaaagtgctgggattacaggcgtgagccactgcaccaggcccttattgtgtttttaagtcaacaaatgtctcttcctgcaacgaatttcctgtgaatttttcattattgatgtatcagattaggcattttatgtgctttcacatattaataattgtatcttattatacatagattaatgccaaaatttcagcctttcatattttaaataggttttactttattataaaaataagaatattttctctttggagttctatctctaaagagacattgttttattctctactttttactactttaaaaaatctgtgtaatatcttagtagataagatctagttttacagatagtgcttctttttaattttttgagacggagtcttgctctgttgcccaggctgaagtgcagtggcgcaatctcagctcactgcagtctccacctcctgggttcaatctattctcctgcctcagcctcttgagtagctgggattacaggcacccaccaccacacctgcctattttttttttttttttttggtagttttagtagaaacgtggtttcaccatgttggcaggcaggtcttgaactcctgacttccagtgatcccccccgcctcagcatcccaaagtgctgggattactggtgtgagccaccgtgcccagaccagttagtgcttcttaatggcattttgcacactgttttgcgtaatatcactgaaagtggggtgcttgtataccactcttctaagatgggtaggggacagtaacataatagtgatatccctgaactgtatgacccaagcatgataattggtcttgatcctagtatcattgccactcctttcttcttcacataactttcagagttgctggaatggacagtgctccgtattttcgtagcctagacagaaatttggaaatgacactgcttctttcaaacacttttctttcacaattcactttctaaaaaaatcagaatacagctttattgagatatatactgtgcaattcatttatttaaagtgtacaattcagtggtttttaatgtattcagagttgtgcaaacacagtcaattttggaacattgtcattacttccatcaaaaaccctaaaatgcattaatagtcactttaccctgacccctagtcttaggcagtcactaatttactttctgtctctatagatttacctattttggataatttagagttcactttttagaagactcttttaagctggaaaaaggaatattaaggcataaatgtgatagcagggagcaggggtggaagaattagcagcagttccatatctgccttttgagttcatagagcagtttacatgtagtaaggcaggtgctattgctgcagctctggattttggtgattcagtaagcagtaagttggagggactggtccaaggcttggtagctgcttgcctagccaggtcctaatttaacactacttctctcatttgaaatgccttctaatactggtaatggtagcagcagcagcaacagtagcaatagtattaaatgtctgacatttagtgagtacttatacaatgtgccagttttataagtagtttacatgtattaacttatttaacccaaacaacattcctgacttaggcaacattcctgagttattctattttatagatgaaaactgaagcacattttattgtagattttttttttaagtatagtttaaaatcttgaaactacccatgaagttaaacttgtttatatgtagggttaatactttttaatgactgcaaaaattcattccattattgctattttttccatttcagtgaaactgcttttggttacaagggtctaaagatcctgttatactatattgctggtagcctgtcaacaatgttccgtgttgaatatgcatctaaagttgatgagaactttgactgtgtagaggtaagaacagaaatactttttaaactgttttccaatttaatttattttaaaataggttttaggccaggtgcggtggctcacacctgtaaccccagcagtttgggggaccaaggggggcagatcttttgatcttaggagttcgagaccagcctggccaacatagtgagagcccatttctcaaaaaaaccacaaaaattagtggggcgtggtggcatgtgtctgtaattccagctactcaggaggctgaggtcagaggatggcttgagcccaggaggcagaggctacagtcagctgagatcatgccactgtactacagcctggatgacagagctagaccctgtctcaaaaacaaaacaaacaaacaataaacaaatagtttctaaaaattaaaggtttgggctgggtgcagtggcttgtgcctataatgccagtgcttttggaggctgaagtgggaggatctcaagcccaggagttggaaaccagcctggacaacatagtgagaccctcagctacttgggaggctgaggtgggaggattacttgagcccaggagcttgaggctgccagtgagccatgatggcaccactgcactccagcccgggcaacagaacaagaccctgtctcttaaaaaaaaaaaaaaaaaaaaaaaaaaaaaaaattaaggtttgagggaagagagaatctgttatatggtagttttaaaatcacattctcaggctgggtgtggtggctaacgcctataatcccagcactttgggaggccaaggtgggcggatcacctgaggccaggagttcaagaccagtctggccaacatggtgaaaccccgtctctactaaaaatacaaaaattagctgggcgtggtggtacacacctgtaatcccagctacttgggaggctgaggcaggagaattgcttgaacctgggaggcagaggttgcagtgagttgagatcgtgccactgcactgcagcctgggtgacagagtgaaactgtctcaaaaaaaaattaattaattaaataaaatcatatactcagtctttagttatggaggcatttgcctccctgtcattacagttaatcctgtgatcatgatcctgttctgtttcctgcatggaccttcttcataaaaatctttgcctttgtgatcagagttttatttttttgccaacttttgttttttattgtggttatttcctataagtcaaagaagatggagggaaatagctaaattttccacttttacctagtgtggaatctattgaagtttctcttgctgcatttctaatcccacaaattttgctaatatattcctttatggatggaatacatggatgatcaagctgatcacattataaaactatttaaagtgagtgtatcaaaaggggataaaggtaaagagagagatgaggccgggcacagtggctcatgcctgtaatcctatcactttgggaggctgaggtgggcggatcacctgaggtcaggagtttgagaccagcctggccaacatggcgaaaccccgtctctactaaaaatacaaaaattagctgggcgcagtggtgcatgcctgtaatcccagctactcgggaggctaaggcaggagaattgcttgaacccaggaggtggaggttgcggtgagccaagattgtgccattgcactccagcctgggtgacaaagcaagactccatctcaaaaaaagagagagagatgagtatgcatctgtggtagactgaataatggttccccccaaaagatatccatgtcctaatatctggaacctgtgaatggtgcctcatattgcaaaaagcacttcgctgatgtaattaaatatcttgatattatcctggaatatttgggtggacctaaatgtaatgacatgtatcctaatgagagggagacagaaggaaacttgatgacagaaaaggagaaggcagtgtgaccacagaggcagatgtgatatggccagaagccaaagaatgcttactcactagaagctggaagaagaaaggaacagattccctcctagagcttccagagggagtgtattaccttggttacagcccagtgatactgatttcagaacacctccagaccgtaagagaataaatattgttttaagccaccaagtttgtggtaatttattatagcagccacaggaaacgaatacaggttttcataccaggaaatgggatgctgctataaccaataactaaaaatgtagaagtgtctttggaaataggtagaggctggaagagttttgaaggtgcatgatagaaaaagcatagattaccttgaatggactgttggtagaaatatggatgttaaaggaaatatgggctgggcgcagtggctcatgcctgtaatcccagcaatttagaaggccaaggcgggaggatcacctgaggtcaggagtttgagactagcctggccaacatggtgaaacccatctctactaaaaatacaaaaattagccgggcgtggtggcaggcacatgtaatcccagcaacttggggggctgaggcaggagaatcacttgaacctgggaggcagaggttgcagtgagccaagatcgcgccattcattgcactccagccggggcaacaaaagcaaaactccatctcaaaaataaataaataaataaataaaggaaataatggactgttggttagggctcagaatgaagctaggagtgtaggagagaacacctgtatcatcttagagaatatatatatagtcataaacttagttttggtagaaacacgaacatgagctggatgcgttggctcatgcctataatcccacagcactttgggaggccagggcgggtggatcacgaggtcaggagtttgagtccagcctggccaacatagtgaaaccccgtctctactaaaaatacaaaaattagcccggcatggtggcgcatgcctgtaatcccagctactcgggaggctgaggcaggagaatcaccggaacccggtaggcggaggttgcggtgagccgatatcgcgccactgcactccagcctgggcaacagagcgagactctgtctcaaaaaaaaagtgcctctgctactgaggagaatgaggcaggaggatcatttgaggccagcaggttgaggctacagtaaggtaagtatgatcatgccactgcactccagcctgggtgacagtgagaccctgtctttaaaaaaaaaaaaaaaaaaaaaaaaggccaggcttagtggctcacatttgtaatcctagcactttgggaggccaaggtaggtagatcacttgggctcaggagttcaagccagcctgggcagtatggcgaaaacccatctctacacgcacacacgcacgcatgcacacacacacacgctgacacacacacgctgggtgtggtggtgtgtgcctgtagttccagctactctggagcctgaggtgggagactggcttaagcacgggaggtgaaggttgcagtgagccaagatggtgccactgcactccagcctgagtgacagagccagaccttgtctccaaaaaacaaacaaacaaacaaacaaaagaagtgcctctggttggtgagggcttagaataaaatgaggaacatgtatttggcaactggagaaaaggatatccttgttctatagtggcagaaagcctagctgagttatgtcctgcagttctgtggaaaggagaacttactgtaagcaatgaacttggatgtttagctgaggaggtttttatgcaaagtattggaggtgtggcctgatttctggctgcttatagtaaagtgatgaaagagataaattgagggaagaactgttaaacaaaaaggatacaggacttgatgatttgggaaattcttaacctatccagattgtagaagacactagttaggatattcattgtcaggaaggtggaaagtgtgttctggagagaaagccgtgagtgtgacaggataaccttttgctagtgctgaagggattaggcacgtgactcatggatctcctcagttgtctcagcaaaaagctaggaatgtagatctggggaacatttgtggaggaccctcttgtctaatggtatgaaccctcatgacgtacacaggcgactcaagggttttgagaattaaaactttatagtgcagcttggattgacaggacaaaatgaaggaaggctgtatgaactctccaaatttcacaggcaggaaacaggctaataaaactgctcagctgccaacatgtgctacctttaaagaaagtggaagaatgactctgagggcaaagctttgggtccagagggtggagctgcaggccacagttattcttaggccttgaaacctaatggagtttgccatgctgaattttgaaattgcttggtggcagtggctcctttcttccttccatttccttttctggaatgagagattctataactgttgtcctatgcctgtcctaccattgtcttttggaagtgatactgtgttttctaatttcacaggttcatagatggagaggaattttgccctaggatgtatcatacccacagtcttacctatgatgagaggtgtgacttttgaactgactatatctagatgagattttgggcttgagttgatatggtaatggttgagacttttaggaatgtttggatagaatgaatgtattttgcatgtgggatggacatgaatctttgagggccttaagaaaattatattttaggcttgttctgtttccgagcattcctcatttaagggcattgaaacttcaccattgatttttttaaagattaaatcccattttgtcactaaatcatatttataaaattgaaagttaattcttatagcaaaatctcttttctttgcacttattaatccagcaagttttagtaaattatatctgatatactgttggtaatactgtgctagacacaagtatggaaaatgaaatatattacttcatactgtatgttataactttcctctgcagaagtagcagttcctaaagaattaacaattaaaccaactttttcagggctttaaactgattttaactgttgactttacctcttttgccacccctatgccccatctatatttttggttaaaacctcctctcattactggaactgacttacttggcccttttttattatttaaattttgagggatttgttatatttaaaggttttgcccaaagtcatacaactagtaaataatcagtattgtactaggagatgattatttagtgttattatgcataatatataataatatcctgattaaaagatgttaggaatatttatgacctgttctaagaggatccaggctcttgggcttactgctttttctctctctctcccgttatttttttttttaattttaagttctgggatacatgtgcagaacttgcacgtttgttacataggtatctttccccttttgaccatgtgtttttccccctcattaaaaaaaatatttttttaatttttaattttttgtagagacggggtcttgctatagtgcccagactggcctcaaactcctggcctcaagcaatcttcccaccttggccttccaaaatgctgggattacaggcacaagccaccgtacccagccttctcctgtgttttatgccatgtgctcccagtttactgctatcattgtaaggagcttcacactagcaaaccccttatggttaaaaataccatattggtaagcttgatggaatctgattacttcatactgtatgtcataactttcttttgcagaagtagcagttcctaaaacattaacaatgccaccaactttttcaggactttaaactgacattaacttctgactttacctcttttgccaaccctatgccccatctataaaactaattgtgcgtagcatgaaaaagatctgaaatagtttcatataatatgaattgtgcatagcatgaaaaagatctgaagtagtttcatattcattattcaactttagtattagaaatattttgagttctatttgttttttttgtgtgtttttccccacttcccagccatgtttgagatgactgagcttgccagataaataatatgtaactacatttaatatttgttttattttatatagtttgtttcccaggataacttttgaaattgtgcagatacaaaagtgattctgagtaatactgtagtggtttgatgtttgaaaagatgtaatcttagataaactagcatttaacacatttattaaaatagagttttttcataatcaaatatgtagattgctaaattctccagacccaagcccagctagatattcttattaaaaatgcaggtgatgtttttccttgtgtgtaaacccactgttggagggtttttgttttttacagttgcagctgatagcactgaattgatttcttccaaaggaactattgatttagttatagataaatcttttaaatatttcatgcagtgaaaatagctgtgtatttgcattgacatctaattgttccattcttgaaaattaggtttttccatttagaaatactgtgttaggaataaggaatcaatcttttataatgtctctttgtagagttacttatttgctttgtggtcaaagatcatttatattgcgtattcaaacaaagacttttttccccttattaaaaacgattgggtaggggatatgtgggtcatgggcttgcttcttctatctcagtttgcagtgagtgttcattccatagtgccttctgtgttgttgatgccagcgatacagtggcagacaaagtcatggagcttacattctagccaagaggaacagtcagtaaacaaaatagtaaatacacaaattaaattcaggcagtattatgaagatacattttgctcatttctgaatgataaaggaggaaccagccatgttataatctgagggtaaagcttactaagatacaaaggctctaaaaatacagcatttttggcatttttgtagtccagaaagattaccagggttaaatcattgtggtgatggagagaggggtaggagatggttgaaggggatgcaaagctagatcatcatataggatcttgtgttctgtgataggtgtttgcaagaaataagagtagttggcattctttagaggcattcttaagtaggtggaggtcataaacaatgtgatttatatttttaaaatatgattctggctgctgtgcagagaacacactgtatagggcaaaagtgaaagaagagaccggaacattgcagtgttagaggtgacactggacttagttgtcagagtaaggaacattttggaggtctgctgttgaattagatgtgacagatgaagaaaaaaaacgagaaccccattgcccaagttcaattatggtactgttaactgggaaaactatagaagaaataggtttaagtggaaaaaataaaaaaattttattttggatgttaggtttgagtctaatatattagggctttgcagatcatactgcatagatggtcagcagccataacatctgcttagaagttatttcttattaggattatgtcattacattaatttttaatcatccattcttttacttttccaagctgaatgctctagttgcacctaaaattcttcagtcacaattaagatgcctataaaatctctactagccaccatctttaaaggaaacataattctgaattttacaatacaataaacttgattattcagacactgatgattttttcatctggttgtccttgacctttgcttttattaacacctcctgctctgtgcttgtaatgccagctactctgtaggctgactcaggaggatcatttgaggccaggaatttgagaccagccttggtaacataataagaccctgcctattaaaaaaaaaaaatgctgaacgtggtggctcaaacctgtaatcccagcgctttgggaggccgaggtggacaggtcacttgaggtcaggagtttgagactagcctggccaacatggtgaaacctcatctctaccaaaagtgcaaaaattagccaggtgttgtggtgcgtgcttgtggtcctagctactcaggagggtgaggcaggagaatcacttgaactcgggaagtggaggttgcaggaagccgagttcgcgccactgtactccagcttgggtgacagagcaagactctgtctcaaaaaacgaaaacaaaagctaggcatgatggcatgctcctgtagtcccagctacttggaaggctgagacagaaggatctcttgagcccaggaggtcaaggctgcagtaagctatggttacactactgcattccagcctaggtgacagagcaagactcttgtcttaaaaacaaaaacctcctgccttttcttgggggtaatttcattgccttttagtgaagtagtgggtaactaagattgttgtcttgctaattgctagcatttctgggaaaagtttggtacaggaagttgaaatagatggataaagtttgtattaactgtgaatttcagttattttatcctagtgtcccactaattggattgaatttgagaggatatgagagcagattttaaaaattttatggagtgtttagcctctttctaggaaaatcctacatccagaaatttcgaaaaaatctttggtagactagtaaaatttcaaattgtgatggtgttcttgataagtaatactttttatgaaatatcataaagagctttaaaagtatatattgacaagtttatcttgtttagttcaagtagcaaaatactaatgcagtgtaaataaacataatatgacctttgtttttccattagtgaaaaagttcacacttttaatttctcaacaatacattctgtagttaaagcttaaatattatcagagaacatgagattgagaacattaagtagatacagaatttcttttgcttgttttttttttttttagcatattttaggtagtcttagaattatagttaagtctatgtaccactttagccaagtaaagaacaacatgttaccacctacttaacgtgcctttaatttcaatctcaaaaataactagacaaatttagacaaatggtgctgcttaagataagatgttagagaggttattgggttttcaaatgtgtataaatacaaatataaacattaaaaaaatagattactaattatcaggcatatcgctttattcaataatgaggaaatgcaaaaattgctccatatgaacatgttcatgtgtaataaagtacagaacactggaacttgaaatgaccatagttaaatagtatacaatctaaaaatatttcataatgacccacctaccagaatatctaactagaatacttttgcactttcctttttaaaaataaattaccaagcgttaggaaaccatttgtaagagatgtctttgttaattaaatatatcaggttgtattctggtttctttttttgagacggagtctcaccctgtcacccaggctggagtgcagtggcgcagtcttggctcactgcaacctccgcctcccaagttcaagtgattctcctgcctcagcctcccaagtagctgggattacaggtgcacaccaccacgcccagctacttttgtatttttattagagacagggtttcaccatgttggccaggctggtctcaaactcctgacttcaggtgatgtgcatattttggcctcccaaagtgctgggattataggtgtgagccaccatgcccagcctggtgtctttttaaaaatttttttgaaattctagttccctggtgtgtctagtcagctgaatttcttaccctttctatatttctgtataattttagttgaagtttagaataatgctctggaatacagggaatttttcagtgatcttcagaaatagattctaaacttttagccacaaacattggaattaaaaagtttctgttcatttttaactctattcaattaacaatgattaaatgaggtcttgctcttgtgctgattttattatctgatcagtaatccaatctgaaagacgaatattttaaattaaactaaattatatatttgagaaaagagtacagatctctaagacatggtagtcaggatttttttttttcttaaagcagaatccatttaatagagaaatgcagacattttccctttagtgaagcgaagttgtaaattctaggttgaagaactatttggttttaagttgtatattttatgtaagtatatcagatacatatttatatacataactatttataaatatatatttatataattatataaagattccttgctttaaaattgccctttgccccgtaaaaattcttaatgtgtaaacttacacaaagcaaactattttatttgaagatatttattacaggaaatagacatcctttgaaggctgaaagccctttttcaactttgttgggctcaaaccttctggttgctctgcccgccaccaaaagtgctacttgaaacttagagtttctgagaagtctttgaagtagatttgatacaagatatgtaaagtgatttgcaatgccttcttgagaagacaggacataaggaaagtttttaaaagttaaaattatacatgctatgaaagtcttaaagtgatttttaaactgatagattataaatccctttttaaaagtagtttttcttggctttttaaaaaccttaactaacatactatactgttttactcatcactactttggattttaattgctacacaacacatctattacagctatccctcattatgatagtttccttgatagctgttgaaattgtactgatactataaaatatgcttacgatggcctcttcacgttagcaatttcaaggaaaaatatttatcaaatagtactttaaaaataagcaaaaactgtcctatgaaatgcagtttatttgatctagagtgtgaatgagttgcaaggactgatgtacatattagaaataaactgttgggcaaaatgctgaagagctatattttcaataataggtcttttttatacctataaacaaattatatataaatgttggtggtaccagagcattgaaaataaaacttgtttgtgataaacgtcatcactggttctctatcctgaaatgtaactgaatcataataaagtgctattcatctgcaggtgcattgcttctacttagttaaaagatggttgaaaggataggaattagtagcatgttgtattagccttttgtagtgtattttgtcctaagcatcttaatttccctgttttgaatgctaagtagcaagggtcttggtttagaactaatacccatcatgcatgtaaacggtatgaaagagctgcttagtaagttaacacaaagtgttcttgtgtcagtccttgtggaaatagatacaatacaaacattacagctgaactcacggcaaactccattaagtaaaaacctggcctcattgttcaggaaaaagtttgaatagaatacaagctcattttgttgaatgtaatgtcaggcttttagggactgtattgagggataaggttttgttaagttgagaccaattcattaagttttattgcctggtgagaagcagcaatactttattgtaagacttcatcaaatattcatggttaaagagaagtagtaaatgtattcaatcaagtggtcttttgggattttgaaaaggattatgaagtctgctcagctgataacattgatagaggttgtttaacaagggtaattttaatctccgagtttagttttgttgtccagtcttgtctcttttttactgtcacaaatccaggtctgtaagaattgtgtcacattctaaggataaaagaatgatatatccattcatataatttatgttatttcctaaatatgtatattttaagttatcatcttagtttgagtttggcatatgagggaattgtgacccatctagttgtgagattgctattcatttggtcagactctagtctcatctcaccactgctggtgatcttttcatgtcttggataatatgatttctttgacacatataaaataataagcaaccttttgccttggccagttcagactgtcatgaaggggtatagtcagctgtttctgcataatggaaatgtccatagcattgcccttattattgtacttggtatcaggtcacctgccttctcttatttacttttatattatgctcatctcagttttgtgtgatgcagtttgtgcacaggaagctcatccttttccaattcgctgtgtgtttacgtctttagttttcaaccaaagttttgtaatttgtgttggttttgtcagttttaaagaaataaaccatattcaacttaaagtcgaatttgttattaattttttatatcctttattctttaggcagatgatgttgagggcaaaattagacaaatcattccacctggattttgcacaaacacgaatgatttcctttctttactggaaaaggaagttgatttcaagccattcggaaccttacttcatacctactcagttctcagtccaacaggaggagaaaactttacctttcagatatataaggtaaagataaatctaaatatttattgagtaaagttctatttgcctgaaacctgtatgtagttttgttgtcagtgatttattctaactgcagtaaacaagttttaatcagcattataaaccaagatctattttgtgtgtatgtctgtatctatgttcacatcttaatctgagacttctaaacattttcccacaggataattttgtgttctgcggactttcacttacctttgtgatgagtttcacctgacttttcctggctttttccctaggctgacatgacatgtagaggctttcgagaatatcatgaaaggcttcagacctttttgatgtggtttattgaaactgctagctttattgacgtggatgatgaaagatggcactactttctagtgtaagtacagttctaaagcaacagtagaccttattacctccacaaagccagcattttaattgtggcagcccaattattgggacagtataatgatatttttcccaggaaagaaaaactattgtttatgaggcttgagttttccttcattatgctttgggagaccttgagaatagagctgaattaaatgctgttgtccgttagggccctgaatgtaggcttaaacagtaaaatgagctttgcctgtgttttcttttacttgccacctattcatctttataataggcaagtgcactgaagtgatgtaaagaggtctgatttatccaagttgctgcacaccaattaagtgaattgtacattcagaacatagcaggtgtacccattgggccctcacagagtagcttgctgacactgaaaattcagtcagagaatggaaaagaaaatggacactgcatgggagcgcgactgtaattgacctgcttggctttctgttttatctgcagatttgagaagtataataaggatggagctacgctctttgcgaccgtaggctacatgacagtctataattactatgtgtacccagacaaaacccggccacgtgtaaggtaattggcagtataacacgtgccttgtcttttatttcagaagaaggaactgctgaagtttccaatacttgttataatagtgttgatttgtttaaaaaaaaaatcactattattcatgggctatgtactgatttatttcattgttccctttgaaacagtgtagaagattaaactaattttgagtatcttgataatttttgggtatctcaaaggtggattgaaaaaaagatcacacaaactttaaagtgtttgtaatactatagtgatctgcaggttttaaactggtcatgttatgatattttaattttaaaataatttctttactgtagtcagatgctgattttgactccatttcaaggtcaaggccatggtgctcaacttcttgaaacagttcatagatactacactgaatttcctacagttcttgatattacaggtatgtaaaatttgatttgttactgaaagagcctttctaaaaatgtcttcttactgattgattttatttttgtcagaaataactattttaaacagcaacattttcctagggtgtttaagccatctaaagatggcttaagtttatgttttagagcataagcctttgtggggattggattacatccctaactgtgaagtgcataatggaacaaattgaagataatgagctgaatatatatggggaagtcttggtcaggcgtaaatacgttgaaagtatggtataacttatttgttcactttatttggcaaacagttgcattatttagaggcagcctgcactttaatttacatgtaggggcagaatattataaactttactgagaaaaaaagtcaaggtaaatacttcttgaatagaatacacatttcctaaagtgtgtgttttgtattcctaaaatgcatgccttcacaacagtagtagataaggtgaaatgtaggcctatttgttttggaaatgtctttcagtatggattagccatagaagtagtagtatgaatagaatgcttaggagaaggaaagacgacttactcgacttactcgacttgactcttcaaaaggagaaggcattattagatggagtttcagataatatgttaaagtgtgatccaccaaaaaacaaagtggcccaaggaatatttatgttattttctaactttcaaatttgttgttcataaaattgctgatgaaactgaaagttacctttttcttttattgaaaaatactttaccagatagttacatgcaaattggtattaaaatttattaatcttacaagtttgaatttggatacatctttgttacaaactatactatttaacatgcactaaaacattaacatgttaaaaaatgctatttgggaattttgtttaaagacaccacctcccacccacccacccccaccaaaaaaaaaatggttgtaagactggcaaccacataaataggctagtaagcagattgtttcatccttctttatatagactagtaatccaaggtaaataaaattgaagttgcttcagaacagtgaattgatctgtagaataataaactggagggaaagcacgttgtctttaaaagggagtttcacatttatagaggtgaattatcttttcatctgactttcctgctactgttaaatgggttggaaactcaggagataaagtagtagttactaaacttcgtttataacaaaagttataaattgtttaagcgacaacttcactagcttagtgacttataaaattgtagaaacataatacagactatgtcacttcttttagttgagcagaaaattgtttagcttctattaacttatagagcttagacttgctgctacatgaagggacatttttggtgattttaatgtggagttcacataagtagtctttgtctactctagtgggtaatgtgccagcaggggttgtttctctgaagcctcttaaccactttcttctgtctactccaaccaataaagtccttgatacttagcaccaattagcagataaagaattttatttcttaaatctcagtgaagagtcatcaataatggtagcctttattcattggtgttattcattagaaactgaagtctctaaaaagaaaagactaaacatgctaaaggacttctgaatttgacaactgggtattggcctttattttcagcattaacatttctcagcatttaaaaatactaaaaatgccttatcagctgttctcattaagatatttatttctcctagatttccatacccagtccttaaaaaacaaaactgcagatttttctactcttctgtcatttagttgcctgtttctccattattgtgtgtgcttttttagctttgtggttcttttgcaggctctggatctccatttgcaatccagaatattctttatattgagatggccttttgcttacttgacagatagccagatctaataataattgaaacttcctgtagatggcctaagttatatcttacttccaatggatgggtgtttgtggtataattgccacccattttcatttttttgcactcaattttaaggtaaaatactggcagacaattccttgtataccatctgccttttgaagatactattctcttaagatgtacagcatttgaatacatctcagttgtataactttataaatagaatcaatgatcttgtttcctctggacttctgaaaggagttgcatttggcaatagaaatcgattctgggctggaatacatatcagtattattatctatcagtagtacattaagagctaattatatttgtcctttaaatgtactttattgttctgggatgtgccatatagctttttagaatattatgtgaattgtttataacttaggtgattgtgctgttatctcatttcccttctttagaatatgattttttatcactaatatgtatgttaatatgagaagctttaaaaaaacgattgctagatgatgtattacatttagaaaaaactcagtttttgatcctgcatatcattgtagatttaaattcaagaaaattttatctttaaatatgttgcttatctttgtagcatagaaacaaaggaattgaaggatgtcatacattattgggtgtcgttttaagttcatttcagactgacactttcaaagggcttaaagattgagtggtgacttggttccttatattaagctgcaaacaaagtattatcagtcataatggcttatttaaaactggaaatttttttgcatgttttttgacttatgtgaaaatttcaggtaaaaatgtggcctgagtagtttttctcaactgtaactcattttcctatgatacctatttcctaaacttttctgagggtatagaagttacttaaaatttcactcagctggttacagtggctcatgcctgtaatcccagaagtttgggaggctgagctggagggttgcttgagctcaggggttcaagaccagcctgggcaacatagggagattcccgtctctataaaaaaattttttttaattagctggatatggtgtcacacacctatggtcccagccagctacttgggggactgagatgagaggatcgttagagcccaggaggtcaaggctgcagtgagctgtgattgcgctattgcactccagctagggggacagagcgagaccctgtcttaaaaaatacacacacactttgggaggtcgaggcaggtggatcacgaggtcaagagatcgagaccatcctggctagcatggtgaaaccctgtctctactaaaaatacaaaaaattagccaggcgtggtggcatgcacttgtagtcccagctactcgggaggctgaggcaggagaatcacttgaacctgtgagccgagatcctgccactgcaccccaccctggtgacagagtgagactctgtctcaaaaaaacacacagattcacacacacatacacacacacagccatacacacatacactaaatgttagtttaaatcagtattagcaatgcagtttctttttttttttttttttttttttttttttgagacggagtctccctctgtcccccaggctggagtgcagtggcgcgatcttggttcactgcaacctccacctcccgggttcaagcaattctcctgcctcagcctcccaagtagctgggactacaggtgcgtgccaccatgcccggctaatttttgtatttttagtagagacggggtttcaccgtattggccaggctggtctcgaactcctaaccttgtgaccctccggcctcggcctccccaagtgctgggattacaggcgtgagccaccacccctggctgcaatgcagttgtttttctcaaccaatttagaaagaaatagacttggaaaaactgacattggataagcttgtacctcatctattagtacttgaaaaaatgtggccgggtgccatggctcacgcctgtaatcccagcactttgggaggccgaggcgggcagatcacaaggtcagaagatcgagaccgtcttggctaacatggtgaaaccctgtctctactaaaaataaaaaaattagccaggcgtgatggtgggcgccctgtagtcccagctacttgggacgctgaggcaggagaatggcgtaaacccagaggtggagcttgagtgagccaagatcgcgccactgtactccagcccgggtgacagagcgagactccgtctcaaaaacaaacaaacaaaaaaatgttttacaagagatacttgcttaagcgtttgtctctagtagagtttttaattaaaacaactttattgaggtataatttccagaccataaaattcacccattttaagtggacagttcagtggtttttagtaaacctgcctgttttagaacatttccatcactgaaaagatccttcgtgtccatttgtagtcagtttccttccctacacccgacgtccattgaggtccttggtccattttgaataaattgttgtgtatgatgtgaggtaagtatctcgttcatcttcttagatgtggatatccagctgtcctggcaccatttgttgaacggagtgtctttcctcattgaattgccttggtacttttcttgaaaatcagttgaccataaatgtgaaggtttattaccgggctctctaatgatctatacttctacccttatgccactaccaagccgtcatgattaggttgatatagctttatattttttatttatttatttatttttaaaacgataatgtcaagtttagcctgtcaaatatacgagttgaatttgtggaacatattttgcctgtgtgctgcaaggtaaacagaagtttcttgaaacgctcgatggtgtagggttaaaaatgggtcctagccctggccaggcaggtgggaatgggacaaagaagggtagagatggaggcttcagagtggactggctgggcttgggccatgaccctcaaggacacaggagtacagggtcccaaagggcagcccctttctgagtgagcacccaagcaacacacataggggctgcatgttgcaaactcatcagtgctcaacccctggcacaaccaccccctactgtgtaatgtacctgacaaaaccctactttctaaggcactcctcccaggcccccgaccagaatcctgaactcttaaagatagtttttaagaaaacatttaaacggttacatatgaaatgctatctgcatctttccagggtttttcttttgttttttttttttgtttgtttgtttttgttgtttttttttttgttttttggtgaggtaggggtagtgtttgagacagggtgttgctctgtcacccaggctggagtgcagtggagtgatagcttattgcgccttgaactcctggggttaagcaaaactcctgcctcagactcccaagtagctggaactacaggcacatgccaccatacttggctaatttttaaagtattttctgtagagatggggtctcactatgttgcccaggctggtcttgaactccagggctccagctgtcctcctgccttggcctcccaaagcaagggatcacaggtgtgagcagctgcacctggcctggcacacacaaagttatagcaggtgccctgccccaacccccacaggcagcaagctgtggggtctcctagctgtaaagggctgctgcagtggcgacagcacagagtgggcaaggcacagcagaggttttggcagcatggcccagttcctggtatctgctcctatatagtccatgcttacttcttcagggagagtgactgcattcactttcctgacaaacatgaatcatcttttgctttcctctctttcttcctcttggctttctcctgctatttccagataatcacctgctctgtctccccagctaaatgcaatttcatgtaatgctcttttgctttctcttctcaatgtcttcttttcttgaaatctcctttggcctgcccagattcagttgtgtgacctttctggttatctatggcatccaattggggttcttcatgtcaatgagctgttctgtgcctttgtacttttgttggcagtcagtcatcttcattctcaggcaatctcttgcctgatgctagagatttcttcttttttggggtcacttgcagcctccattctccactctcttcttgtgtcttctctggccttctgcttttcaacttggagctgtgcgttgatctgcttggggaatattgtactgccttgcttagcctttgtggcctccctttctccttcctttaggcacagaggctctggcaaagcagcacctcaaccacatatgagtcttgaaatcagaagtgaaagtcctccaattttgttctttttcaaaattattttgtttataatgtcccttgtatttccataaaaattttagcataagctcaccaatttctgcaaaaaaaaaaaaaaaaaaagtctcttgggtcttgatagggattgagggattacattgaatctgtcattaatttgaagaaaattcccatcttaacaattcagaatcctctaatccaggagtctcaaaatcccgggctacggactggtactggtccagagcctattaggactgggtcacacagcaggaggtaaatgatgggtgaacaagcattactgcctgagctctacctcctgtcggatcagtggtggcattagattctcataggagcacaaaccctattgtgaactgcacatgtgaaggatgtaggtcgaatctaactaacgcctgatgactgatctgaggtagaacagtttcatctggaaaccatcccttgtctgttcccctcatccccagggaaatattgcctcccacaaaatccctggtgctagatatttttggcacttctggtaccaaaaaggttggggatcactgctctaatccattaatatgaaatgtcttgggccaggcttggtggcttgcacctgtaatcccagcacattgggaggccgcagcaggtggatcgcttgagcccaggagttcgagagcagcctaggcaatgtgatgaaatcccatctctacaaaaatacaaaatttagccaggcatggtggcaagcacccgtgggcccagctactcaggaggctgaggtgggaggatcactggagcccaggaggttgaggctgccgtgagccaagatcgtacactgcactgcagcctgggtgagtgagaccctgtctcaaaaaaaaaaaaaaaaaaaaaaaaaaaaaagaaaaagaaaaaaaaaagaaatatctccatttagttagatcttttaaaacttttctcaacaatgttgttttcagtatacaagttttgcactacttttgttaacttcatttgtaaatatttttgatgctgttggaaatgggattattttcttaatttcttaattttgtttttggatcattgattgttttagtatgtagaaatacagttgggttttatatattgatcttctatcctgcacccttactgaacttgtttattagttgcagtagttttttggttagaattttccacatacaggatcacattgtctgtaaataaagacatttttacctcttcctttgcagtcagatgcattttctttctttttcttacccgattgcttagctgagaactccaatataatggtgactggcaatggtgaaagcagacatctatgccttgctcccagttttagagggaaagcatttggtctttcaccattgtggatgatgttagctatagctttcatatgtgttaattatgaaattgaggcagttcccttctatttctagatagttgattattgagcgtttttatcatgaattgatgttggattttgtcaaacgctttgttctgcatgtattgaatttttctcatttattttgttaacatggtatattacattaattgattttttttggatgttaaaccaactttgcatttctgatataaatcccatttagttctggtatgtaattcattttatatattgccagatttggtttgctaatatttgttgaggacatttgtatctacattcatgagggatattgatttgtagtttttgtcttagatccttagtgtcagcataactctggcctcatagaatgagttggaaagtgtttcctctattttctttctttttttttttttttttaatggagatggagtctcactctgttgcccaggcaggagtgcagtggtaccaccttggctcactgcaacctctgcctcccaggttcaagcgattcttctgcctcagcctcccaagtagctgggactacaggcctgcgccaccactcatggctaatttttatatttttagtagagatggagtttcaccatgttggccaggctggtctcaaactcctgacctcaggtgatccgcccgcctcagccttccaaagtgctgggattacaggtgtgagccactgtgcctggcctgtttcctctattttctagaatagtttgtgaaggatcatcgttatgtcttcttcaggttgtttcatggaatttaccagtaaagccatctggttgtagacttgtctttgtgggaagatttttagttggtaattaaatgtctctgttatagtcagttcacatagtcatttactttttgagtcattttggtaatttctttctaaaagctgtctgtttcatctaaattgtctcatttgttggcataaagttcatggcatattcccttttaattcttgtgatttttgtaaagttggtaggaatatcccttctttcatgcctgattttggtaaatgttgttttctctcttttttttcagtcattctaactaaaagtttgtcaattcatcgatcatttcaaagaaccaactttgtgtttatgtgaacttgtctatttttgttttctttttcattgatttctactctattattattattgcttcttattactttgggtttaatttgcccttccttatctagttaagagtgactcttaggttatattgatttgatgtcttttttcttttcttcttttagacagagtctcgctctgtcacccaggctggagtgcagtggtagaacctccacctcccaggctcaagcgattctcaggcctcagcctcctgagcagctgggactataggcaggggccactgcacccagctcatttttgtatttttggtagagacagggcttcgctttgttggccaggctcgtcttgaactcctggcctcaaatgattggaccactttgacctcccaaagtggtgagatgacaggtgtgagccaccatgcctggcctttcttttctaatatagacatttaaatacctaaatatttacacataatatacatttatatataaatataagcgttgatgtagctgcatcacaagtttttagaaattgtgctttcattttcattcagttcaaaatatgttttaattttccttgtgatttcttttttgatccatggattatttaaaagcttgttgttcaatttctaaataatgtggattcccatgtttccttttgtaaagtttgaatttaattccactgttgttaaagaacatattttagggccaggcgcggtggctcacacctgtaatcccaacactttgagaggcggaggctggcagatcatctgaggtcaggagttcgagaccagcctgatcaacttggagaaaccccatctctactaaaaatacaaaattagccgggtgtggtggcacgtgcctgtaatcccagctacttgagaggctgaggcaggagaaacgcttgaacctgggaggcagaggttgcggtgagccgagatggcaccattgcgctccagcctgggcaacaactgcgaaactccatctcaaaaaaaaaaaaaaaaaagccgggagcggtggctcacgcctgtaattccagcactttgggaggctgaggcaggcggatcatgaggtcaggagatcgagaccatcctggctaacatggtgaaaccccatctctactaaaaatacaaaaaattagccaggcgtggtggtgagtgcctgtagtcccagctacttgggaggctgaggcaggaggatggcatgaacctgggaggcagagtttgcggtgaaccaagattgcgccactgcactccagcctaggcaacagagcaagactccgtctcaaaaagaaaaaaaaaacaaacaaacatattttgtatgactttggtcctttttcatttatttatgtgattttatatttaatttttgcatgaccttccagtgaacctttttcatttattctgtttgtctatttatctacctatgtagctatcttttgagacagagtcttgctctgttgcccacattggagtgcagtaccacaatcatggctcactgcagccttaacctcctggcctcaagtgatcctcctgcgtcagcctcccaagtcgttgggcctacaggtgcacgccaccacacccagctaatttttactttttttgtagaaacgaggttttgccatgttgcccaggctggtctggaactcctgggctcaagcaatgcccccatcttggcctcccaaagtgctaagatcacaggtgtgagccatcatgcccagccctttttcatttattgagttttgttttctgttcaagcttagaggtcagcaaactttttttttttttttttttttaaggataggttgtattttatgctttgcaagctacacacagtctctgttgcatactcttggtttttgttgttgttttggttgttttaaacaaccctttagaaaccattcttagttcacataccatacaaaaaaaggccacaggcaagattggcccatgggccatcatagtttattgatccctggcttaacattaagtctttcctggatgactgttccttgtacacttgtaaagaacatgtattttgctgttattgagtacaatgttctgtaaatatcagttgggccaagttgattgatagtgccgttcaggccttctatatctttgccatttttctgtctaattgttctatcgattattgagagtgtagtattgaaatttcagactttttattgtattgtctatttctccctttaattctgtcagtattttcttcatgtattttgggactctgttgttagttgtgcatttgtttataattgtaatatcttcctgatgaataaacttttttatcattataaaatgtgccccttttttgtcttaaactctttttaaaaaaaaaaaaaaatagagacagggttttgccatattgcccaggctggtttcaaactccggagctcaagcgatctacctgccttggcctcccaaagtgttggaattacaggcatgagccactgcacctggccttacactctattttgcctgatattaatatagccactctagcttgcatactgtttgcttggtatatcttttttcttttttttttttttttttgagacaaagtctcactctgtcactcagactggagtgcagtggcacaatcttggctcactgcaacttctgcctcccgggttcaaccagttctcctcccttggcctcccaggtagctggaattacaggtgcctaccaccacacctggttaatttttgtatttttagtagagatgggttttcaccatgttggtcaggctggtctcaaactcctgacctcaggtgatgtgcctgccttggcctcccaaagtgctgtgattaaagaaaggcgtgagccacagcacccagccttcttttttcatcattagactttgaacctatccatcttgaatctaaaatgtttctcttgtggacagcatatagttggaacttttaaaattcggtctgacacgctttgtcttttgattagaatattttaatatacatgcatttaatgtaattattactatgcttggaattatgcccgccattttgctgttttctgtatgtctcatttcttttggtggggaggggggacagggtctcgctctgtcagagtctgaagtccagtggcatgatcatggctcactgcagcctcaaactcctgggcccaagctgtcctcccctctcagcctgccaagtagctaggactacagtcgtatgccaccacactttggctgatttgttttatttttagtggagacgaggtcctgctatgttgcctaggctggtcttgaactcttgagctcaagtgatcctcccgccttggcctctcaaggtgctgggattacaggtgtgagccaccacacctaaccctttttgttattttgtttcttttttactgccttcttttgtgttaaataatattttctattgaaccatttcaattcctttgtggttttttaaattttttttaagttattttcttaggctgggctcagtgactaatgcctataatcccagtactttgggaggccaaggaggaaggatcacttgaggccaggagtttcagaccagtctaggcaacatagcaagaccctatctctttaccaaaaaaaaaaaaaaaaagaattagcagagtgtggtggcacacacctgtagtcctagctactcaataggattacattttttttttctttcttttttttttttggaggcagggttttactcctgttgcccaggctggagtgcaaaggtgtgacctgggcttactgcaacctccgcctcccaagttcaagcgattctcctgccttagcctcccaagtagctgggactaaaggtgcatgccaccgcacctggctaaatttttgtacattttggtcccatactcctgagctcaagcagtctgcctgctttggcctccgaaaatgctgggattacaggcatgacccactgttcctggccacatccttatgtattactataagccaaacactggtttataattattgctttatgtaattgtctttttttttttgagacggagtttcgctccgtcgcccaggctggaatgcagtggcgcgatctcggctcactgcaagctccgcctcccgggttcacgccattctcctgcctcagcctcctgagtagctgggactacaggcgcctgccaccacgcccggctaattttttgtatttttagtagaggcggggtttcactgtgttagccaggatggtctcgatctcctgacctcatgatccgcccgcctctgcctcccaaagtgctgggattacaggcgtgagccactgcgcccggcctgtaattgtcttttaaattagttgaaagaagaaaagagaaaaaataatctaagttttatatatatttttatgagtattcttaatttcttcatgtagatttcagtggtactatgttcttttagcctgaaggagttctttaatacttcttttgggcaggtcagctagcaccagatttcctcagtctttggttttctgggaatatctttatttcacctttattttgaaggatagttttgctggatacagaattcttggttgataggtttttttttctcctgttggtactttgaatatgtcatcccactgacttctgacctccttggtttctaatgagtcatttttctcttgctgctttaaagattttctgtttctctcacttttgacagtttgattatgacatgtttgggtgtagatctctttatgtttttcctagttgaagtttgagcttcctagatgtgttgaccagtgtttttcatcaaatttgggaagtttttgaccattatttcttcaagtattttttctgttccttcctttcctctcttatatgcttgaacaattttaatatagggtggtgtcagagttcagtttatattttataacacaggggagaataggtaaggagaatgagtttaaaaaaggttattagttgacaaaaatactggtggaagcagatagaagaaataaatgtcctccaggtttctgggtggcttgtataactggatgatgcaggtaaattaaagtgagaaaagactgaagaatgggatagggtgacaaattacataacagtcttaggtttattttctgtgtaggtctgtattttacttattttgttttactgttgatttcaccattcttaatagatcataatttcatcccaaattgatgcagtgacttgatttcaattcttcctattttaaagtcatagtcaaatagcacttaataactacatgcatatgatgtgtataattaactgtggcatagaagcataaaaaaggtatttagtacaaatcagttgaatgaatgaatgtgtttcttggaatcatgagacattaccctgtctcaggctttttaaaaaaatagctttattggtatataattaacacatcatacaattcattcacttaaagtagacagttttaagatgatatttacagcacaaccatcaccataatctttctgttggtctgagacagtctcactctgtcacccaggctggagtgcagtgtgtgattgcagctcactgcaacctctgcctcctgagttcaagtaactctcatgcctcagactcctgagtagctgggatcacaggaatgtgccaccacacctggctaatttttgtatttttagtagagacggtgttttgccatgttggccaggctggcctcgaacttctagtctcaagagatctgtccacctctgcctcccaaagtgctagcggccctagcgaataatctaattttggaatattctgttcccccataaaagaaacccccaaaagaagtccctgttagcactcctttcctcccctcaactcctatccctaggcaaccactaatctactttctgtctctataaatttgcctattctggacattggaatcatgcaatatatgactagtttctttcacatagcatgttttcaaggtgcattcttacagcatgtaacagtacttcatttcttcttattgccaaataatattccattgtgtggttatatcattttattcattggtcagttgaacattttagattattcccacattttggctcttatgaataaataatgctactaggaacagtcatgtacaaatttttatgtggacctgtgttttcatatctcttgggcatatacctaagactggaaattatgggaaatctggtaactatgtttaactttttgaggaatcaccagactattttccaaaatggctacaccattttacatttccactaccagtgtatcagggtttcagtttctccacatcttcatcaatacttgttactgtgtttttaattctagccatccttgtaggtatgaagtggtatatcattgtggttttgattcacatttcctgtggctagggagactgtgcatcttttcatgtgtttattatccacttgtatatatcttattgataaatgtcaacttagatcctttgcccattttttagttgggtctttttttttttaccaaattataagagtttgtacaccaatttatatgaatctggatacaggtgctttattagatacatgatttgcaaatagtctcccattctgtatgttatttttttcatttttttactggtgtcatttgaaacacaagagttttaaaatttttgtcacctagtttatttgttttttcttttgttgcttatgctttggtctcattatctaagaaaccattgtctaaccaaaggtcatgaagatttactcctgtgttttcttctaagagttttgtagttttacctcttaaatttgggactgtgatcaattttggttaatttttatgtatggtgtgaggaaaggggatcccactttattcttttgatgatagagatccagttgtcccatcaccatttgttgaaaagactcttctttcccccattgaattgtctttgcaaccttctccaagattaactgacctaaatctatggttttatttctggactatcagttcagttccattcatgtgtatgtctgtccttatgctagtgtcacatggtcttgattatcataggtttgaagtaagttttgaaatcagaacgtgttgagtccttcaagttttgttctttttttattttttcccagatggagttgctctgttgcctaggctggagtgcagtgacacaattttggctcactgcaacctctgccacctgggttcaagtgattcttctgccttagcctcccaagtagctgggattacaggcacccaccaccatgcccagctgatttttgtatttttagtagagacggggtttcaccatgttggccaggctggtctcgaactcctgacctcgtgatccacctgccttggcctcccaaagtgctgggattacagatgtgagccaccgtgcctggcctgctctttttcaatattgttttggctattctgggtcctttgtctttctttatgaattttttcctttttttttttttttttttgagacagtctctgtcacccaggctggagtgcaatagcgcaatcttggctcactcactacaacctccacctccaagagtcaagtgattctcatgcttcagcctcctgagtagctgggaggaatgtgcgtgaccacacctggctaatttgttgtttgtttgtttgtttgtttagagaaggagtctcgctctgtcgtccaggctggagtacagtggtgcgatctcagctcactgcagcctccgcctcccaggttcaagcaattctcctgcctcaatttcctaagtagctgagattacaggcatgcaccactatgcttggctaatttttgtatttttagtagacacagggtttcaccatgttgatcaggctgttctcgaactcctgacctcaggtgatctgcctgccttggcctcccaaagtgctgagattacagacgtgagccactgcgcccaacctaattttttatttttagtagagataggactttgtcatgttggccaggctggtctctaactcctggcctcaagtgatctgcctgcctcaggtcccccaaagtgctgagattacaggcgtgtgccactgtgcctgacctgttcatccaaatttgaatctctcatttacacagctactgtaattggaatcaaaactaagatgcatgtgataccatgccagttaaaaagtttaaatttgaggctgggcgcagtcacttatgcttgtaatcctagcactttgggaggctgaggcgagttgatcacttgagcccaggaattcgagaccagcctgggcaacatggtgaaaccctgtctctacaaaaaatacaaaaattagccgagtgtggtggcgggagcctgtagtactagctactagggaggctgaaataggaggatcacctgatcctgggaggttgaggctgtggtgagccatgatcatgccactacactccagcttgagtgacagagtgagactctgtctcaaagaaaaaaaaaagtttaaatttgaaatgggtagcttttgattcacaaatattaatacaaatgtctttgcaaaaggattggatttattattttgacaaagataatagttttatttataaggaataatcctttcatgttgtaacttttgtatgtgtaattttttaaattacacattaaaaattttgtatttttttatgtgtaattaattttgtatgtgtaattttttttaatttgtcttcctagcctagcatatatgttgagattgcaaaagatgaagaaattatattgagtatcagggaaatgttaatattattctgctttatttatttagcggaagatccatccaaaagctatgtgaaattacgagactttgtgcttgtgaagctttgtcaagatttgccctgtttttcccgggaaaaattaatgcaaggattcaatgaagatatggcgatagaggcacaacagaagttcaaaataaataaggtatttttattctgtaggaggaaaacagatttaaattacaaacaaatttttgaagtgtataccttaactaaaatattataaagacattaagaatacatgtgtgggaactagcaatggttaacagtacagctttgaagccaaattgcctgagttcaaatctagctccaacacttgctctgtgatttatggcaatttaatttacctcgtgcctcagtttcctcattaataaaatgggaagataataggtgttattgctatattaagcataacaagcagaggaaagatggataataggatcttatttttactctttaaagtagttgtacccctggagacattattggtgggaagaatggttgaagtaaaacacgtatttcattttatatacttttatatatttatttaaattttaaagtggtaaatgtcttaagataggtacagaaaaaataaatatggaagttcagagaagaaagtttattacatttatgtaagcaaggaaatcagtggttatttcatagaaaggatggcatttgatataaaccttgaagaatgagtaggatttggattatgaaagtatgtgagatgggctgggagtggtggctcacgcctgtaatcccagcactttgggaggccgaggcggacagatcatgaggtcaggacattgacaccatcctggctaacacggtgaaaccccacctctactaaaaatacaaaaaagctggtcatggtggcatgcgcctgtagtcccagctactcggtaggctgaggcaggagaattgcttgaacctggggaggcggaggttgcagtgagctgagatggtgccactgcactccagcctgggcgaccgagcgagactccatctcaaaaaaaaaagaaatttgtgtaggccgggcgaggtggctcacgcctgtaatcccagcactttgggtggatcacgaggtcaggagttcgagaccagcctgtccaatatggtgaaaccatgtctctactacaaatacgaaaattagctgggcgtggtggcgcgtgcctgtaatcccagctactcaggaggctgaggcagaagaatcgcttaaacctgggaggcggaggttacagtgagccgagatcatgccactacactccagcctgggcaacagagagagacttcatcttaaaaaaaaaaaaaagaaaagaaatttgtttaatagctcagcttttaaaagaacaggcatatgaatatatatatatatattttttttttaatggtgctttcttaaaaaaagaattcaaactccctacctagagcacaaagagcccatgataatctggaccctgcctaccttgctagcttcagcctgttagtactttgccacatgctctggctactttgccacatgctctggctttactcatcttctagccatttcccaactctgccacatccttcttccttctgtattcctttacatattctgttctctttacctgaaatactcccttttcctaattgcctggccagatagtactcattttttcaggttcaactcaggttcccttccaggaagtcagaaaatattaccttcccaacctatccataccccaactccctgcccaaataaatacataagtgaaacaacatcaacagaaaaactgtggttctcctttggcttcagtgctaccaaaaacttcctgattcttctgatatttccttgataccatttgtctttttttttccttttcctttttttttttttttgagacagggtctcttgctctgtcacctgaggtggagtacagtggtgtaatcacggctacggctcactgcagcctcaacctcctgggctcaaatgactctcccacctcagcctcccaagtagctgggactgcaggggtacgccaccacacctggctaatttttgtagagacagggttcctacaggctgttctcaaactgctaggctcaagcgatctgcccaccttggcctcccaaagtgctggaactacaggcatgagccaccatgtccagccctgtctgctttttaactgtcactgtactagcaggtttctgacctttctccttttatcactgtatatgctttcctcaggtgaccttaaccagccttatggttttaactcttacctatatactgacattgcttaaatccttgcccttagactagaattttcttcagattttctattttctgctgcctcccaaatctctcctaggctgtgaaaactcacattttcacatccttctctgagtcagtttttcctctcatatgtttctagagtccttgaccccttggtcttcttgtgctgttccagttcatgccctcatcgttttttatgtgatgtaataactcagcttcttgattggtctctatgcacttctttttgctaccatttctttgtagctgaaagagtgacttatttaaaactcaaaatttgtgcatattgcttacattcctatttaaaatctgtcatgaaggctggggcagtggcttacgccagtaactctaatactttgggaggttgaggcaggaggattgcttgaagctgggagttgaagatcagcctgggcaacaaagtgagatcccatttctacaaaaaaaaaaaaaaaaaaaaatagccgagtgtggtgcatatgcctatggtcccagctgctcaggaggctgaggtgggaggatggcttgagtctaggaggttgaggctgcagtgaactatgatcgtgccacattaaattatccataccataatcatttgtgttacccactagactgcttgagggcaactacttttattgcctttcctctggtttctagcacaattccttgctcatggcagatattaaatatatcctgtgttcttttgggaaagtgtcattatttttactttgaaaatgttcgcattttcttttgtttcattctagcaacacgctagaagggtttatgaaattcttcgactactggtaactgacatgagtgatgccgaacaatacagaagctacagactggatattaaaagaagactaattagcccatataaggtaggactttcaagaatcttaaacactgtattcttttcactgtttaaaacagaagaaaagctaccaaatatcagtatatgagagagtccaagtcattttgtaaaattaacttttacaaaagtagaaatattcttccagtaatttataaaaattctcactcatggccgggcgtggtggcccacacctgtaatcccagcactcagggaggccaaggcgggtggatcacctcaggtcagaagttcaagaccagcctggccaacgtggtgaaaccctgtctctactaaaaatacaaacattagctaggcttggtggtgggcgcctgtaatacagtgacttgggaggctgaagcaggagaatcgcttgaatccaggaggtggaggttgctgtgagccaagattgcaccattgcactccagcctgggtgacaagagcaaaactccatctgaaaagaaaagaaaagaaaagaaaaaaaacccgggtgcagtggctcacgcctgtaatcccagcactgtgggaggccgaggtaggtggatcacttgaggtcaggagttcaagaccaccctggccaacatggcgaaaccccatctctactaaaaatacaaaaattagctgggcatgataacacgtgcctgtaatcccagctgtttgagaggctgaggcacgagaatcacttgaacccaagaggtggaggttgcagtgagctgagattgtgccactgcacttcagcctgggtgacagaatgaaattgtgtctcagaacaaacaaacaaacttatcccaaggatagtctaccatggttagcttttctttcatttgtatgcatctttaaaaaatctgaatgcctagtctcttccctaacaaattatgttgtttttcccaagtttcttgtcttctcagttgttatatatatatattctcttttttctctcttcccagataaaagcaaagttatacatatatattctctttgcttttgctttcttcttcctaaaaatagcctttattgctatttattaatataatctttgtactttaccatagccgaaaccatgttagtactattatatttttaaacattcttcttgcccttttttcccacttcgtcgtcatcttccatattttccctcctagatcaaattggccttatcatttggacattgtcaggatggatattgtttatgccaccttatgtgaatgaaaatttgctatctaggcaaggcgtggtggctcatgcctgtaatcccagcactttgggaggccgaggtgggcaggtcaccagagctcaggagttcaagaccagcctggccaacatggcaaaacctcgcctctactaaaaatacaaaaattagttgggtgtggtggtgggtacctgtaatcccagctacttgggaggctgaggcaagggcatcacttgaactcgggaggcagaggttgcagtgagctgagatcataccactgcaatccaggctgggcaatggagcaagactccatctcaaaaaaaaaaaaaaaattaaaaaaaaaaaaaaaggccaggtgcggtggttcacgtctataatcccagcaatttgggaggctgaggcgggcagatcatctgaggtcaggagttcgagaccagcctggccaacatggtgaaaccctgtgtctactaaaaatacacaaattagccaggcatggtgggaggtgcctgtaatcccagcttctccggaggctgaggcaggagaattgcttgaacctgggaggcagaggttgcagtgagccaagattgcgccattgtactccagcctgggtgacgagcaaaattccatctcaaaaaagaagaaaatttgtcatctagttgcagctgagtagtgggatgattggcagaatatttaatttattcaacatataattattgagtacagttgctcaatgataaaatgttgttgctgcatttatatatactatacctatagggttatacatcacaatagctgggaacataaatgaccaagttgattctacattacaatttgagaaagtaaattaactaactgtatcaggtacacatagttttggttttcctttgtaaatttaaagaaaatttaagttttatttgccatggattctgctttatagagccagtcttgaatgctgatggttcattggctgacactacttgctgaatcccaacttttccttcatagcatctttttactttgcagtgcaactgtatttcctaatttgtcattgtaattctgttcacattctgaatataaaattattatttgcctatgactaaatcattttatcttgaattcatacacagatgtatgaatagttcctcatagtgtcatttcattgcagtttaatagtttttctattttacagaccatcatctgcatatagcaggtttgtaataaattataatggtctcctcaaaagttatccaaagtagcattttattatttgatgttatcaattcagaaacatcagaaaatgggtaaaaatggtattttccaaaggttttgacctttaagtaatatttgttagctagaaaatgtcttaatgatgaaatttgggcacagagagcagtatagatggcaacatttaagagttattaagattttactaaagtaaaataatttattgaattatatattttagatattaatgtgacttttatataaaatataacaaatgaaagatggaaattctgagtacaaatagtagtcacacagctaatgccaaataatgggaacctctgtagttcataagtgcaagtattttctactcttaaagaatgataattcttttttatattattattaagtacctttacctgtccagccagttcaccagtctaaaaggccagaactgggccgggtgtggtggctcatggctgtaatcccagcagtttgggaggccaaggtgggtggatcacttgggcccaggagttctagaacagtatatccgaaacatgaaagcttcatatttgcaataatgccacccaaccaggaatcctggagttattcttcattcttccttcctcatatcacccagtattttctcccctaaatctgccctgtcctctccatctctgctgctgctgacttgatctaggctttcatcaactctggcttgaactactgcagtagctgcccagtcctccagtcccatcctaaacatctctgacacagtgtcctgcataaaagttgttatcagctacctgttgcaaactccttagcatagcggtatcctaagtcaaaccaggagggtttagtatgataatgtatgtctggaacttaataaagactcaaatgctatttaatatatttttaaagtatagcagttttccatttgtctttctgaaacatttctaacagtttatgttaaaattagcatgtggcccgtaagtacttcactgggtggaatttaaaatgtaattaattaatgactgaatagtaaaatgaagaataatagcacttaatctcagttgtctttcttcagctaatgtcttctatctattaagcaaatatttgagtgtctatactgcccagagttctttaaagttttggagggggctgctagtcacatgtctgtatttaccatcattggacacaaataccaggtcttcttgttaactctttttagagggtttgcaattcatggttaacattatgtttaagcttccttaaaaaacaaaacaaaacaaaaaaaaaacattgtgggacaagtttgggcgtattcatactattcttatttttaacattggagacttaaaattgtaagactataaggaaatatatttactttcttcgtctaacaaataattgtttgtcacttagaaaaagcagagagatcttgctaagatgagaaaatgtctcagaccagaagaactgacaaaccagatgaaccaaatagaaataagcatgcaacatgaacagctggaagagagttttcaggaactagtggaagattaccggcgtgttattgaacgacttgctcaagagtaaagattatactgctctgtacaggaagcttgcaaattttctgtacaatgtgctgtgaaaaatctgatgactttaattttaaaatcttgtgacattttgcttatactaaaagttatctatctttagttgaatattttcttttggagagattgtatattttaaaatactgtttagagtttatgagcatatattgcatttaaagaaagataaagcttctgaaatactactgcaattgcttcccttcttaaacagtataataaatgcttagttgtgat
